United States Patent 7,892,730 (COMPOSITIONS AND METHODS FOR CANCER) - sequence listing, part 15

SEQ ID NO: 1570 - DNA, 61588 bp, Homo sapiens
gcctggccaacacggtgaaaccctgtctctactaaaaatacaaaaattagccgggcatgggaaggggtgcctataatcgcagctactcgggaggttgaggcaggagaatctcttgaacctgggagaaggaggttgcagtgagccgagatcatgccattgcactccagcctgggtgacaagagctaaactccatctcaaaaaaaaaaaaagagaagttggtagcctggctgtggcagagatgactagttattcaccaaagaccggccctctgtctccaccccatccccacccccaccataggtagagtcactgctgaactgaaacaggagctgtatttctctgacccccattctcacaatagtcaatgaaatgttgatggaagcggcatttcccattgttagacccagccctaaacctcctgcaccatcctccactctcatcttctggcctggtattgatgcctgaggctttcttgaaagccacgtgttgaagaaagcagagcccctgtcatcccagtctccaaatgactacatcacacagaccttccaccagtctccctccctgctgacagtacatataaacctattacaaaaaatagtttcatttttaaagttcacaaaaataaacttttattatggtaaactttcatagtgatggggtagaagaataaattgacaaaacacttcaaaagtgtgaatttaaagtttctggcgcctgggcgcggtggctcgtagctataatcccagctctttgggaggctgaagcgggcagctcacttgaggtaaggagttcgagaccagcttggctaacatggtgaaaccttgtctctactaaaaatacaaaaattagccaggcgtggtggcaggcacctgtagtcccagctacttgggagtctaagatctgagaatcgcttgaacctgggaggaggaggttgcagtgagccaagatggcaccactgcactccaacctgggcgacagaacaagactctgtctcaaaaaaaaaagaaaagaaaaagaaaaaaaatttctggggttagccttgacaatgacaagttctaacaatgtaatcccgtagctacctattaatctctcttcatgttatgtgcaccgtctgattagaacagaatttcctggcgagtgaaggaagaactgcatcgttatagaacagtttggaaaaggcaacagggtaggactgccagtttctagttttgtaaaaccctttacttatcacttccactcaacatagagacaagatataatcatgacatcaatgattgtctaatggtggaaggctataattctaagtgtctcatgatagaattcataacacgtgaaattagatgtaggatagtacttaaattttatcatattcataaagttctattatgtatagtattttcttggcaaacataatgctatgggtttgccaaacctattttcttttccctctagtcacatagataggctgtatttcccagccaatcccatggttagatgggtcatggtgacagagttctggccaacggaaaatgggcacaaaaatgtgagccattctcagaccgaatggagaactcaaggcccaagggaaaatcagaaccaccaactagaaggaggcaggtccagaatgaatgattagaacagctcctctccatccaacctgcatgggactatagggtgaaaaagaaatatgccactgagattttgttacagcgatcagcacagttagcataacataatgaatatgttaagactatttcatttgtctcagagaactatgtcaaagattaaaactggcaggggtgggggtggaatgttaagtatacttgaataaagccatgattttaaaaagaaagcagggggtctttagagatgtactgcatcccctcacctactcccacttccaccctgttcaatttagttcttcgtaattatttaccaatgtctacaaatgaaggccatgtttcttgccatggccttctcaggaacaccatggcttgaccagagcccaccctccttgggcctcctctcccattcaaggctacttaagtgaatgaatttcactcttctgaactttggctgccttacactattccctctctggaatgctctttcccctcacccctgcctagctgaattgcgctgttctccctgccacttctactgcggcctttctgctggaaggctcagttggaaagggcagcatcctgctgtgactcctgcagccctttccctgtacagcccggaggacacttcttacatgccatgctttgtgatgatgacaggtgcatatcttctctgccctgctaggtttcaagttccatgcacacagaaactccatgtgccattacataagatattcaataacaaatgcttaatgaatgcatgaacacaatgcactcatggcattcatttattgcataagtcaatgaataattgaatggaatgccacaacatcagcttgaatggaagacccctttccctccaaatgagtctgaattacccgtggcccccagctaatataaagatggagccactatgccaagggcagagcttgtgagaggcaaacccaacaattccaaactaggctccacttgaaacatcaaggttcacatggaaaggagtctgcaagaatgtagcaggaaaaggagggtggggtgggcgaggaacactcttaattgtttaagaaagtatggccaggtacagtggcttatgcctgtaatcccagcactttgggaggccaaggctggaggattgcttgaggccagcagttcgagaccagcctgggcaacacagcgagacccatttctatgacaaatttaaaaattagccaggcatggtggtgcaccacctctagtcccagctacttgggaggctgaggtgggagaaactgcttgagccagggagatggaggcttcaataagccctgtttgcatcactgcactctagcctgggagacacagtgagaacctgtctccaaaaaaaaaaaagaaaagtatgaaagtatggaaagtagcttaaatcttcaggtaaaattaatttttgacattcacatacagaaaagtgatcattgagtgcacaagctttgtatgtgccaagcttcatgaacttccacaaactgatcataagctaggccggcaccgcatcaagaaactaccagcaacccagaagctcctccccttcaggttgtacatactattttaaaagaaaaggaggcaagaggggaggaggagagaatgaaaaaggctggaggaatggagactgccaaggcatctatttgaaaagaaaatgagaaccgctatggcagcagaggggcacacccgggggaactcgagccctcactgagacacaccctgcaaggcatttcccaatctgcagaaaattctcacttgattcaacagacacacatgatgggtaattccagaaaatgcaggccaagctttgaaggcaaaaatattcctcctaggtatagagcaaggcaggtagagatcccttcctgtcccgccccaggtccctgcaggagctagtgcccgtggcccgcaaggtccttgtctacccatcagagaagaaagcagtacagaggccactggaataaagttgatttttgcttgaaaagaagaagaaggaggtgcagggccgtggcctcacagtgacccggctcaccctcctggggaccagaaaagcacttggctcccggccagccccaacacccacttcccagcccaagcctgctttgctcctgtgacctttttctgaacctggagaggtggggcaccctcttggcttccttccagctggatgtgactcctgccagactcaaagctgagaacccagggctttggaaggaacaatgttccctaagaaggcctgagaagcagctcctattataatctcccttccagcctcagggccagggatttgagagcagactccaactaagctggtctactcattcttcctctctcctaggaccctctgctatgctcttgaacagggaaaatcctatgaaggaaggaaacagatttggttcggaaactactcccttattgcaatcagctttgtctctgtcaggatcatggtgtgtgtgtgagaggtggatgagacagttaggtaggtgactagataggtgcataggtaggtagataaaattccttagcagcaagcaggtaattctgaaggcagggactcagggatgggtctggatatccattccatgggaggatttctggctcacaggacacggtaccaacggtctttggtcttatacttcagtcaatattaggaatggaacaacaaagaaaactactaaattggaccaaataagagctataaaggagatgtttctaaaggattgtggtttcttataatgtcaaactaggttccctcctaagttccacaccctacagaccattttcctcccaagtttcacattgcaagatttgaagaggaggcagattggagagttttacgttacatggttacatggaagggaggggctgtctgggttttggttagcctgggaggctttgcgaatatcactcagtactcccattgcttcctgtaaatacaaaggaatccaatggcttccaaaaagagagactctatacaaactaaccattccaccaacatttatcaaggccttggctttgtatgtggcaagcactgtattaagctctggggaatacagcgagtcaatacagagcagtcactcaaagaacccagtcgggtagaggaggcagcccagtcaccagctgtcctcacccaggagaagtgctatgatgactgccacttaccacctgtggcaccaagggcaagccactcaacttctctgtgccttgcttttagcacctgtaagtggagacaatagtagtgcctctccccttggaaggatgtgaggattaaatgaatgaatgtactaaagttcttagatcaacgtaagactcaaagaaagtgccataaaagagtttgtgagccaggcacagtggttcacgcctgtaatctcaacactttgggaggccaaggcaggcagatcacttgaacccaggcgttccagaccagccagggcaacatggcaatatctcatctctagtaaatatacaaaaaattagccgggtatggaggctcacacctgtagttccagctacttgagaggctgagatgggaggatcacttgagcccgggaggtcaagcctgcagtgagctgagattgcactactgtactccagcctgagcaacagagtgagacccttccctaaagaagagcttccacttattggtggtgatattgttattgtggtggttactattgggagaaagcttccctaaccctatgctttcctgaccagaaagccctctcagtggaggttactcactctgaataccaatgaagcaggagctggtcaaatggctgaggggatgagagaagggggagggagaggagagagaatgaggggagggaataggacatagggagtggcacacagaggcacagaggtgtggtggaacacagaaggtatgaaagcagaaattggtggaattcaatcatggaagggaattggaagaggagaatctggaagaaagagttaaggatagttcataagggataaatcataaaaggtctaaagtattatgcaggccaggtgtggtggctcacacctgtaatctcagcacttttggaggctgtggcaggtggataacttgaggtcagaagttcaagaccaggctggccaatgtggtgaaacccagtctatactaaaaatacaaaaattagttgggcatggtggcgcatgcctataatcccagctactcgggaggctgaggcaggagaatcacttgaacctggcaagtggaggttacagtgagttgagatcacaccaccgcactccagcctgggagacagagctagactctgtctcaaaaataaaaaataaaataaaaataaagtatcacgcaaagattttggatttttaaaaaccaatttatagaaaaatcttttccagaaatttgtgaagtgcttactactatgtattgtcaaagtttaactaaacaaggaaacagaaaaatgtgctcaatggtcagtttctgatactaagaatggagaacaaagtggaaggtcccatagggacctagatctggctgtaggtccatggagttgtgttgactgtgactgatttcccatagcttcttttctcagaacctgaagtggctcccctccacccacatggcataataatagcctacattcctaatggcatcaagactgtggtacagtctcctacaatcctccctaatcccatttgtccttacagtcagagccctgacatttggttctggtgtccaccactctctagccagccagaactcaggggacaaattctgattagcttaaaccattcacataattctatcccctttcctattgattggctgaggtatcaatgcgcccttgccacaattctggccagagacataaggggacccagaagacctttgggaaagtcttcctctctctgaaaaagaaacacacaagatggcatggactcttcttcctctgtgtgtcgtgttggtgtttgacacctggaattctgtaccttctagagtcatctaacataatatcttacatagtacggtgagataagtttttgttccattgaaaactgaagatttataacaacttcctgtgaaatatgtagggtggttgttatcatttggtagattaggaagccaaaagaaatgaaggggcatatatgaggcctaaagaatgtgcagaaataaacctaggtctcatgaatgtgtgtgtttctacaataccaggatgcttctcttaaatcttaccaaatacagaccaaaaaatatcaggcacagcttcataaaggtttgcctttgtgctcggacaacaaagcaaggtatgaaggtgaactaaactgtcagattagattaaaatgcctttttgcatttttatcacaatgtataaatcatctgaagctgagctaaaaaaaaatatgacaagatgatcatgttttttcaagatgaaagattccctcgagtctgagtgacatagctactccaacagtaaataaccaataacagagttcccagccagtatgcccaaagcggtgaggtccttggggatgcacccgttgtctcacgctttgaggagcttcctcagttcaccccagtgtgccatacacatgtcaccactatttacatgtggcaacacatgaaatacgtatgggaagcacacacttgtctggccatgtctctccctgtctctcacactgctatctttctcagactctccatttcagtgaactgatctgttcactgtcccacagatgccttctggcttgaggacttgcccctgtgattcctcttgccttgaatcctggaccttcccctgcacatttaaaacaaaaattttcaaatctcacccaaagtgaactcctccagtaaactgttggcttgcataatgaaagttgcatcacacaattaaaccgcttggactgcatatgctaacgcattgcacatgttattctttcctctgcatgttctgtctctccaagtagaccataaataatctctctgaaggctgttggaaagagccttcctcaaaacaaataatttttaatgtctattgatcactgatacttcctactgtgttcttattttctaaactgttctatcttgtcattgctgtgaccactgatatgatatagaaggtcagagcctttgattgtgttttttttcccaaccaaaatgatttctgtgtccacagattcacagaagggaaaaatattattaaaatgggatattaatgaggactgaaggtcttctaaatattctggggatataaaatattcttactcgtaaaggatgcctctacacggaggaagtatccacagaggaaggaaatctttgccattacttcttactgggaacatttactacagatagtcaaattttagtggctatattaagatttggggaagagcagggtacttttaatctcaagccaccaataaacctgacatatttgccagtttagtcataaaacagaaaatcctttgcctaatcaaacttagcttaatagttccttcagaagcaggcagggccaagaggctgagtctcgtgtttctggaataatgtggcatgtgtgtgtgtatgtgcagtgccagattgggacttggccccctggaagtgactgagccaggacagggaagggatctattgaatggtctggggaacagggctggccaagctcatggtccctctgaggtcagccctcccaccctcaaacctcctcccactccacccacccccaggaaccctcccacacactctgggtaaaacacagcttggcaagctctcacatcatggcttggtggctacagtgtgttgatcttccctcaggaccaaccaagaaagctagccttggtgcttctaaagctgccagcctcctaagggagtattcctatataggaatatactttgagaagctgataagacccctctaaatatttgggaggcagcctttgaattaaattatttgcctgctgatgtcaactattagagtgctatttaaaagttaaaacccaagaggcatatgtaaaaggaaataagtcaaatcaatcatttatctcaatatcagagtaattcagaggaactcttaattacatacctccaagagacttgtgaggtcaactccattctatctgctgcccttgaagctcagctggagtccctcaacaccccgattggaggatgaactctagcatagggaattctgagatggagggagggggcgctggttcaggatgcttggaggttctagaaagaactgaggtcacctggaagatacaacgctactctaaaaatgattcaggatggcttttctatgcattctctactcccataggaatcaggggccacctcccaggatggaatctgcctgatgctgtaacagtgttcagctccccaatttccccatgataacaggcaacctccttctgttttgtctacagttaattaatcagtcattgctgacagtaaggctccatcctcaacacaggatattttctgaagcattaatttttgtttcaatagttgatccttgtttggaatataatgtgttacaatgtagtggtacttagtattaaaatcaaaatacctttttattcatctttcaattttaatacttttagcatttcaaccattatttgaagggttacttactgcagtatgtcacatttatatacacacatgcacatgctgcagtgctttcagtttgagccagtgatattttaggccccaaatgctctgaaaaaatagagaaagctctcaccaagctaaggaagtgagcttgcagaccatgcctttaaaaattttcagcttgataacttagtcctcaagatgactaggtttctcttcccccacccctcagttagcatgtgcgaacaaggattcttttgaattcccaggaggggaatgagtttaatttgactggtaaaagtcttcctaataggatacctaatactgtggctcttagaactagctacaaaaatatttcatatgtttatgtctcataatgggtaattttggtttggatttatgtcattttgtctcagtatcacaatttttgaaaaattagttcaaagagaaaaaaaaaagaaaagaaaaaccatggtaaacattgctcagtctcatactcctaccctctctatgctaaaacaggaaatgcatttctgacacttttaaaatgagcaatcacacgtataatcaacttggttaaaacttccttcctggtaactgcaacacttcctctgcatctggatatgaagggagccccagaaaagcggaagaatttagacgcacactgggtaggtttgaatttgttttgttttcaaaaattaaacaaatgatccttcagcatcatcgcctccgctgctttatcaggtattgcttccttctattttttgctctttgtggggtctgactcggaatagtggcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtgagtattagtcagcctgttttcctctgcatcttataagatcgtttggtatcactgaggcagaagttattgctgtgtatttatatgctgcctaaatttggacatgttttatttcaagttagtgtcaatatcaatgtatcttacagttctcttctttgttagttattctataatgtagcaaaagaccaaaatgaatgttttaagccacaagagacagttctttgggacagttggtttcacttactaagtataacttcatattttaagagagggaatattggttttaaaagttaagccaagatttgaacataagtttggatcaaatgaaatttgtctttcttatcttcttatcaagctctcctttttggtatacatcaaatgctccactatttcttaaggaaataatgtagttttaagtctaacattagttatttaagagagtaaacgatattttctgaaacattaattttttgtttcaataattgattcgtttagaatataatgtattacaatgtagtgatactaaacattgaaagcaaaatacctaatctttcagtgttaatacctttcaaatttcaattattatttgaaggatttcctattgcagtatgtcctatttatacgtaagtgctttgtgaagggtaggtacttactgaattttgtggaaagagtgagtaggttaatgagaataaatttgtgaatttgtgttacaaaaatgaaaatattagagcaaaaaagaagttaaatgattgggggtcttaacagaaggtcactggagtccagaaatcctgccttccatcctgtagctcctccattattaagtagagacagatcaaatgaattttaattaattaattaaacaatgttaaaattacctaaatgttcctattgggagagtacagccttgggtgactcttctaagatactgccctaatatagcagtgacagccagaatgctgacaaattccatgattcaaaattttacatatctgcaaatggttttgactgtaactttactaattccgatatgttttagctttacaaatgaaatgacttgctttcctaattagaaagaaaaaatgaaaccaagaggcaggaaatttattagggagtagatcctaggtccaggcagtttgaaaacaggcaacgtgaagcaaggctgggtgaggtgtctgggttccaagaagtgtgagacttaacaaagaggaagtaagttaaaggcctgttttcaaagtgagattttttggcatctcgtgttgcaccttgtaaactgggacttgaaccttaactgtactattttagtaatctatatgtttcagtatgtttaagaacaatgtccattctgagccattataatgtgtcatgcgctgtgctggatgagtgttttacctacctctttaaaattttcaaagtatacaaaagtagaacgaccaataagcccccatatacctgtcacccatattgaacaagtattactttatttaactctccctctggggcattcattactaaccagtttgagagatgagaaacaggctcagagattaagcagcccaaatcacccagaaagtaagtggctgggccaggactcaccggcccgactccaaagcccacgctctgaagggctgtagtgcttccagtttaaaatacttggtccctctgggtccctgtgcacatgtacgccgcctatacctcctcttccctcatctcaccagaaaatataaggggaaagtgcctttcttgtgacaaatccctgtgtccctccgctcccaggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccgctggtggacgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggtaggggatgttggtgttatcaatggaagccttctcaaaaggaattgatttgcatatgcacaggcactccattcagttgtcatcaaatgccctttgttcagagcttcatcatcggcaaaagtagatatgatgaagctgcctcaaaaagtagtaaactgttccatgtacatttttactgtctcggagggtttgctgacaagggttttgcagacattagtacttcacgtttttaggagaattggccctgtgggaatactttgttctcatttattattttaatgatagattgcacttactgaatgctttcttgtgccaaggctccaagtgactgacatgctttcagtgtattatctcatttaactcttccaataactatgatggaggtcaaattgacatttgcactttttacatgaggaaactgaggtacaaagaggctaagtaatgtgcccaaggtcacatactttgaaagaggtagaccagaattcaaacccaggaggtctccctccagatcctgctcttttcactaccccaaatccttcacaaatccaccaccatatccttcatcagtctggtgtcaggattctggggctagagataaaaggtcttattctctgtgtatgtctgttacagttcacagaataatatctcatatctgggtagagtcttgaaagctcctctctgcagataggtacaggactgtatgtatttctgctccgtttctcatgatgttccctggggtcctgagaggacaagtgatttttctaaggtttagttaagaagttaaagaaagaagggggaacagttcccctgctcactttagcagttctcaacttatattgtactgcttgacaagggaaaagaagtaaaggaatttgaatagaaatgctattttagagcacagccttcattcattaattcaacaacatgtactgagaagactggcattaaatgagtacacacacaaatagatgtttaataccaaattgtgacaaatactttagggaaaactataccgtattatgagaaaacagtccaggggtccaagggacacttaattttgattaagagaccccgggacagttctgagtaagtgacatttgacctgagatctttaggattagccagactaaattttacacactaaactatctaatcactatccgtatttataggaagttctggagttttctgataagcattttggatagcctcaacttaaactctcaatcttcaccttcctgttagatacttgaaacattacatttggctttgttttcatccattaaatatattcagtagttttttcactagttgagatatttgtataacactaaagaattttagaataattaaagaatcttcagttttctagctctccataacagaaacaacatgaaaaaaacttggatgagctctgttgcaaaccccaaggctaacaggaattatttttcattgtcatgttcacaagtaaactttaaagagctggaaaatgaataatgttctttttagaaatgtgttaaatgaaagaggtcaatacataatattaacattgaatttgtggtcttaaatctgaagaagaatagtcatttgtaaaactacttgagacattttcagctatggctaaatgactcattcctgatcaaaatggtctcctagttgagatctgcactgtctttacagaagtgaaacctgaagaaggtcagaaagactcacatctggcttagaaacttaaaacattgcgaaaatgagtactggtggctaaaagaccacattctcagaattaaggcctttgatgcagctacagtggcacctatttgaccatacttttgaaaagcatttttgtaaacacttgtataattgaaacatgatgaagccactagtgatcatgtccaaactggaaaaccagaggaagaattataaatccttccaagaagcctccagttcctaaaatataaactagaatgtgaatttcttccgttccttaggaaaaaaggatacaccatttctattcataaagtgtatactctgagatatttaatattaagtctttcttcatgtttacatatgacatctatcctctaactttatatatgcttttataataatctgaacaatgtttgttagtgttgctgcttttaaaattatgaactatttcaaacttacagaaaagcacagagaacaatgaaacacctatgcactcacaagatttaattgtgttttttacattttatcagttcttcctcatcagtaatggagctgtactaagtcaatattctctaacatcagccaagtgatatgaaaattactaaacactaaaaatgaagatcaaattatacttaagaaaacataaaatcagggacttttggacagaaagctctgtacacaccacagtgtggcagagggtagtgattgctctgtgtggattgatctagagccactgtttacttgtagttaaggacctgtgagacagttcagtgacttgccagtgagatgccgaaaagggaagctatagggcttttaggatctttccatctaacaaatatttttctccttacgtgtattatactatatctccactgtccattttctttctcacattctctcttaccttccactttatagattggttacagtgtctccatcttccccctctacccctccaacaaaaccagtaagacctaattagagcaaattccctcacctcttcacctttgaatttatcagcagcacatgactgtgagtcaaaagtttcatcctctaatcccagttatgtcatcggctgctctatgatcttaagcaagtggttcagtctggtcctaagtgtcctctaacagacaggattaaacttaagtgactgttaagattttcatctttctagccgtgaagacccagtaaagcagagcaccagttcttctccatttccttttccctgattcaacgacatagagtacagtcctacaaatgccaatgtgttcttcctttaggctgtgaaatttgaaccataccatgatagtgcccttgccagatttctgctgaagcgtggtttaagagtaagtacttccattttgataatagcgtgaaattttaagttgccaagaattaactggtagacctaaagcattagtcataataatttcaactttcttgtacctgccctcagaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaaggtacggtggctatattttctgtgttctctttccaaatgccttcatctccaaatgccattgttcctataattctttttcttcctggaatccaagttgcatcctcctgaaggcaccaagaacacatttttgagttttctgtctgcatggagtaaacaaatttaaagttctccttttacaagttcataatttttaactatatatttacatattcttaactgaaaaattaagcagcattatgcagatgtaagatgtagtttttaagaacagttgcatacacaaagattagatatttccaaatctttacctttttcttcacatctctgaatatgcacatacagttttcaagtttacagtcttataaaatgatgaatttttgagaggctattttaattttttggcatttcttcatctatatatctcagagtgatatatagagatacattcattcttccctatctggggtcctacatctgtaaattcaaccaagcatggatagaaaacatttgggaaaaaaattgcatctgcattgaacatgtacagactttttttcctgtcattattccctaaacagtacagtgtaacaactatttgcatagcatttacattgtatcagatattataggtatctagagatgatttacagtatatgggaggaagtgcataggtcatatgcaaatactataccattttatatcaggggcttgagcattcatggattatgatatctgcaggaggtcctggaaccaatccttacagacagcaagagacgactctgtatctgtgtgtgtgtgtgtgtgcataaaggtaataaacacacacacacacacaccaccttctctctcaagctgtttccaatatcttattcctaccctaagaaaacctgcccctgccctaggaaaattaatcactccttctctgtatttctgtagattttgattgatactacattaaattaaagtctttaacatatcttcctggtctggtaaactgtatcaaccttgaatctagagaatatctctttttcatttttatatacctagacctagcactatggctcattacatagacacttcatgtactcaaccagtattttaaactcctgaatatttaaaatttctttctccctttgattcttacaatgcttcctcctaaaaatgatgatggtaataataatattttatttgcattttaagaaaggaaaacatttgtactgaccctcattctgtcagtcatccagtaatttttaattcacatattttgcctttagaattttaaggctgtcacatccatcttctctacttctctacagaacctaacttcctcttctgaaaagaaattacagaaccctaaccaaattccatgtattattttcttaaaatgtctgttcctcaaatcagatggtagtttaaagtttaatgtgctggaaagaaaactacagtattaattccttagcatcaccctcagagcatacttctctacttggattgtgttggtgtctatgtgttatcccacatatattcacatatttctgtcccctgttgtagtatgtgtacatggttatgttgctcaccttaagcccaatgtatcttgccacctcatatggttagctcctcaaaggcagggcccacccacatttctcctgctctacaccagaacaaatatatagaatgctatgaataaatgtgttctcaggaaatgtaatagataatattgatgatttctggaactcacataactcttgtgtacttttgacaattacagttatttcacaacttaaacaaaagcttgaaaacctgcagaattctcaactccccgaaagctttagagttccatatgatcctggactgaaagcaggagcgctggcagtaggtatcacttggatgtctccatgtggtctttatgtcttgaagatgtctaacgtgcttgctggggcccagtacttaaaagctaatgtttatgcagagacagggaagctggagagtctctggatgggtttctcataagcccttgtctaatcactggttatgaaagcctcaataccagataatttcccttccatattttttaaaatcagcttgagatattctttgtatacaataaaaattgtccatttaaaatgtagaattcagggaacaggcgcggtagctcacgcctgtaatcccagcactttgggaggccgaggcaggcagatcacgaggtcaggagttcaagaccagcctggccaacaaggtgaaaccccgtctctactaaaaaatacaaaagaaaattagccaggcatggtggtgcattcctgtaatcccagcaactcgggaggctgaggcaggagaattgcttgaactaggacctaggaggtggaggttgcagtgagccaagatcacgccactacactccagcctgggtgacagagcaagactccgtctcaaaaaaaaaaaaaaaagtagaattcagtgagttttgagaaatgtatacaattatataaccaccgccacaatcaagatctagaacatttccatagacatgttacagaaaaagttctgtcatgtcccattgcagttagtcctttttctcctcccattctctgtgataatgcaacagatctactttctatcataaaatgccttttctagacttttattaagaggaatcatatagtatatagttttatatctgaattattttactttccataatgcttttaagattcattcatgttattgtatgtatcagtaatttgtttctttttatgacttagtagtagtcccttgtatggatataccacagtttgttttccattcattttttgagtaaatgtttaacagtggggtagttgggtcagatggtgtgtgtgtgtaattttacaagataccatttttccaaagtggttataccatttaaattccagcaatgtatacgatgagttctagttgtttcacatcctagcaagcacttgttatcatcagttttttttttgttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatcatcagtctttttaaacttagccattcaaatgagtatgaagtggtatctcactattgtttttatttgcatttccataataaggttgagtgtctttctatgtgctcattttccattagagtacattcttctgaaaattttctattcaaatatttcaccagttttttaggtgggttgccttctttttttttttttgagacagagtctcgctctgtcgcccagggtggagtgcagaggcacgatctcggctcactgcaagctcctcctcccaggttcatgccattctcctgcctcagcctcccaagtagctgggactacaggtgcccgccaccacacccagctaattttttttttttttttgtatttttagttgagatggggtttcaccgtgttagccaggatggtctcaatctcctgacctcgtgatccacctgcctcggcctcccaaagtgctgggattacaggtgtgagccaccgcacctggaccttagttttagttatgagagttacttatataaactggatacaaattctttatcagatatacattttacagatattttctgttagtctgtggcttgcctttttattttcttagaggtgtctttcaaagcagaagctttaaattttgattaagtcaaatttgcaactttttcttaaatggtttgtgcttttagtgtcttatctaagaaatctgtctaggactagcacagtgtctcacacctgtaattccagcactgtgggaagccaaggcgggaggatcacttgaggcaaggagtatgagaccagactgggcaacatggcgagactccatctctacaaaaaataaaaaaaaatagccgggcatggtggcacgtgccatagtccccactacttggaaggctgtggtgggaggatcacttgagctcaggagtttgatactgcagtgagctgtgtttgtgccactgcattccaacctgggctacagagcgagaccctgtttcaaaagaaatgaaaaagaaatctatctaatccagtgcctcagcctggggtaatccctctgtctgccaagggacatttggcaatgtctgaagacattgttgatggttataactgggagaatgctattggcatctagtgggtagaggccagggatgctgccaaataccctgcagggtacaggatagtcccccagaaccaacactatccaccccaaaatggcaacagtgccaaggttaagaaattctggtttaactcaatgtggcagatattttttcttagaagggttatggttttaattcttacattgaagtctgcaatccaatttgagttaatttttgtgtacagtgtgaggtgaaggtcagagttcatttttaaatatgaatatccagatttttcagcaccatgtgttgaaaagactgttttgttttgttttgttttgttttgtttttcctggagaactaccttggcacctttgtcaagtatcaactgaccgtatatgtgtgggtctacacctagattctctgttctgttccactgatctaaatgtctgtccttacatcaataccacacattcttgattatgtttaaataacaaagcacttcatatacgtgtgcttatacaggcaacagtatacttccattaacccccgcatcctttgcattatttttattatgatttcaacttctatatatgttataaatggcacaataagttactatttttgccctaaacagttaaaaaatagacttaacagacttaatagatgaaataatttttaactattcacctacatatttaccatttttggtactctttattgccttatatcggtccacatttccttgagcttctaacatcttttctactgcaagtttgctgacaataaattctttcagcttttgtttatctgaaacactttttattctgctttcatttttgaaaaatattttccctgaatatggaattctagattgactggtttttttctttcagtaacatttttttctggcttgcatattttctgatgatgagtcttatctttgattgtgtctgcataatacgtctttttccccaggctgtttttaagattcttttttatttctggttttcagcaatttgattatgatgtaccctggtatgggtttcctttgtgtttaggctgctggagtctatggagctccttgaatttgtgagtttatagtctatcaaatttggaaatttttcaaccaattttttatgttgcctcttttctctcctctctgagacttcagttacagtaatttagactgctggactctgggctcagtctggatttccttcctctgtgctgtagcctagaaacagcccccaggcagtaatctggggcaattacagggctcacttcatttgtcttccttttcttggggatcacggacctacactgcctgttcaatgtctgaaaagagttttatatattttgcatagttttctagttgtttatggcaggacggcaactcccgtagcagcgaagccacatgagaagatgaggaagttcttcccctgaatgtttaattttatatacaattaccagcaaactggccctatagtaaaagcacacactatccactgtccattatttaaagattggtaggaattatgacatattaatacagtttcaaattgtgtttgcttctttaaatgactacatcacaattttgatctgtggtgaactcacctttgcctgaaacacctaccttttttatgtttaagtgagtaactgccaagccacatttcccctgccttgaatttatttagatgtatgaggtttagggggagggcgtgttgtacctaaatgccagattttccatttatttctgttaaatttcatctgcttagatgtagcctattgcatctgattctgcaataatagtttttttgacattgtggtagcattagaattcttttttcaaattaaatctcagaaggcggacaaatataatagccaggttgctgtctattaaagaggatgtgggagtgtcagagctctgtgtgcgtggggagggtgagatctgccatacctcttaggcacttccaaagactcttgtggttctttggagcacagtttgagaggcactggtttaagagttgtgaattcgctctcacatggcatttccagatttgctcaaaacaacttctgtatttttacccaaatattgaaaatcattctccaactaggactttgtccttgttgtttatagtgatgttttgcaagagaatttgtgtctccaccatgtatattcgttattcattgtgtgtggggaacatgtgactgcttccttacagattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacaggtatgctaattttaagattgttttcaattatctgaaaacaattctatattacatcaaaaacatgctttctcctactggctctattcccactctcttctttcaagtgatgaattgtgatcaaatattacatcatagagagttttcacttggggaatttggctgcagactattagatatgcaatctaatgagcattatggttctgtccaagttgcatatctaacactcccaagtagccagatatacctccctcacctaatgtcttttttatacaccccattctaagcttgataacatagaaaatagccatatttatccccagcactcacttcattcctgcccatagacatgtctgcacatctctaggcactcttttagatacatctcctctgatgcacataaacaaatcaagcaaatgattttatgggaaggagaaagatgaacaagtaggtcaccacagaaatcctgcaggtaagtgacaagagtgaagtactgttagggcagaaggtgaatggtcaatatatcagtgctaattattttcatattttctaacatttctagataaactttagcttcacaagtctgtaaagtaatattctccagattctagttggtcagtgttgtagaggtaataatttctaatacttaatatggtttatttgaagtagacaaattacattgatttcaaggtagcctatttaaaactggtcatgtttccaattgtaagtttctgtttttacttatttctaatatagaaacaggaatacctttgctttgcctttgctttgctttcaagaatgatctatgttttgtccaggaggtattttagaaaagaaaaagagaaatccttcaaactttttgcaagtttattaaatttcaaataaatctgtagaatattttgaattgtttgaagatggacactttaaaaacacaaaaattaccctgttggtcctctcattttgagtgaaagtttgcctttgccctttatgtactttgtggttttgtttttttttaatttttttaagatgaggccttgctttatcgcccaggttggaatacagtggcacgatcacagcccactgcagcctcaaactcctaggctcaagcaatcctcctgccttagcctctgaagtaactaggactataggtgtgcaccaccatacctggcaaattatattttttgtagagatggggtcttgccatgttacccacgctggcctcaaactccttggctcaatgaatcctcccacctcagcctcccacacaactttcacagtcttctccttttctttcccttcctcataagaaaaccaacagtgtggacctggaaaatagctctctggtcaaaaaaaacctctctgcccttcactcaacaaaaacatagcctttccttctctgggccaggcactagcccacaatctccattagactcttcatccttctataggaatgatcaagattgtgaaagacaccatgacaattgccaaaattgctgggattctaggcacgagccagttaatcgccaaaattgctgggattctaggtgtgagccatcatgcccagcctactttgtttatttgttggggcacatagtttggcagctaagggcaagttatttaagctctttaaggctttgttccttcacctgtagaatgggaataataatcctatccacattatagggcaatgcaaggatcacacataaagcagcaatcagtatatattcgctatcattatcatcattgtagttactgctgctttggttattgcctttgataaatatgtgtaaggatgttagagttttgtggtaaaatagacacaagtaaagcagaacatttgaacagagaggtgatgaaccacagctaaaacccactccaaaagaaatgtattggccaagcatggtggctcacgcctgtaatcccagcactttgagaggccaaggtgggcggatcacttgaggtcaggagtttgagaccagcctggccaacatggtgaaaccccatctctactaaaaatacaaaaaaaattagccgggcatcatgatgcgcgcctctaatcccagctactcaggaggctgaggcaggagaatcacttgaacctgggaggtggaggtggcagtgagctaagatcacaccactgcactccaggctgggcgacagagcaagattccatctacaaaacaaaaacaaaaacaaaacaaaacaagaaatgtatttatcctcttccccaaggtacatttcggaaaacaaaattaacaagctcacaaagaagagaaactttagagtaccagattgaccaataaacgtacagttgttacttatatgttttacatttactcttatattttgtgttactagatatgattgctatttttaagggagaagaaaaatatattaagttaatatatatataatataaacatttctgtgtttcgatgcccagattctacgaatcatggagtctatttgggagactgaatctttggatctatgcctcctgccatatggttgcatttcaactggtgacaaaataggtatgtagttacctcaggagatgaatagacctctcagctcgtttgaaaagattataattccttcagtgtagacatttaataactgaaaaatcataatcttaatctgtataaaaaggaagaaaacatttctatgctggtgaatgtgactctcaatttaatgtggatatattgaaaatacatgaatgcatgattcaaatccctgtgactatacatggaaatgattttagtaagaacttgttccctcctctttccttctccatctctaaactttaactcatttcattacacattaaacttttctctcacaaaaaacatttaaaaatagatggaaagatctgtcacttattttagtattccagaattcacattatcaaagctattacacactctactatcaggtatttttatagacattcagcattagtttcagtcaaacatatgtttattcaagtttctgatctgagaactctacaaaaccatttacatttaaccctgtaatttaaaaaaggaaaaggcacagattgccatctgaggaaggatatgctcagcatataaatgcttttatttattactattcaaaaccagccctttcctcttgtcattctgggatattgaaaacatatcccacacaacttccatatcctccttctttcctttctattcctcataagaaaaccaatagcatagacctggaaaatagctctctggtcaaaaaaaaaaaaaaaaaaaaccctctgcccttcactcaacaaagacatagcctttcctcctctgggccaggtactggcccccaatctccatcagactctgtgcatccttctgtaggaatgatcgagattgtgaaagacgccacgacaattgccaaaattcagcaaagcacagtgggcaacacgggagcatttaaagatgaagtcctgaatcactggctcaaagaaaaatcccctactgaagaaaaggtgagctcatgctttttcccagtctaatggctccttacaagttgtcatttatatagcagtagtggcttcaagttttcagagaatctgccagtgtcttgcctcctgacatattagtgaagttttttacttgtgaaataatggaggttttaagtaccctcccgtggtgacagcatatctgtgtgaaacagaggcactcagttcaggactccatgagcatttgcttctcttttgattatcaggcatactttgcttaaaatttggttctgtaaaataatctgttagcactttttatggctatctatttttgttgttcagccaagatatttagttaccatgtataaactcttacgtacctgggaaatacaacatacacaacaaagtaatttataatttactgctgaactctaatctaaatggtaaatcatggatgctgaaaatgtcacttccaccattccttggaagtgcatatgctcaatccttcacaagctgtgttttagctgtttggctgtcgtttaaagttctgctgcacaggattagcacttctcatttgcatggttagcagccttttggggaggaaatataatgagtagcacttattaatctgttatacatggggatctgtgaacccaagcatactcttagtggtcacaagcaaaacatgttcacaaatgaaggagaaattaccatgggttctatatagttgttggcaagtgatgcatggagaggaagtgaaccctttgattaaattactgttgccctttgactcttgtttcttcctcatgccattgtgattcactgaatcttcacctaaaatataagcagagcaatgagaaagttggcaattcatagatataatgctaatgaaatcaggcacaactaacttgctctctgaaaatggtttccagaatattctctttttagaagtcatttgtagattcatgatgctttttgtagttagaagacaactaatattcaaatgcattttaattagtttcaggcagcagtggagagatttgtttattcctgtgcaggctactgtgtggcaacctttgttcttggaataggcgacagacacaatgacaatattatgatcaccgagacaggtgagtttatttagtgcagaataaacttttattgtggtaaaatatatataacataacatttactattttaactctaattaactgtaagtgttcagttcagtggcattacatatgttcaccttgttgtacaaccatcatcaccattcatccccagaatttttccatcttccccagctgaaactctgtacccattaaacactaactccccatgcctccctcctttcagaacggagtagtctttaaatggagtttaagactggagcacatatttagaagtcattgtgtagggacactggtgcttcagttactctagagcagtggcccccaacctctttggcaccaaggaccggcttcttggaagacaccttttccacggacaggggtgggggagcaaggatggtttcaggatcattcaagagcattacgtttattgcacacttttttttcaactcacttgccactataaagcctgccaccagatgcagctcaattttcacttgccactcactgagagggttttgatatgtaaggaattgatttattatggtctctgtgcagtgaaacctctctgctaatgttaatctgtatttacagccactgcccagtgctagcatcaccacctcagctccacctcagatcatcaggcattagattctcataaggggtgcacagtctagatctttctcgtgcacagttcacaatagggtttgtgttcctatgagaatctaatgctgcaactgatctgacaggaggtggagctcaggcagtaattcaggcaatggggagcagctgtaaatacagatgaagttgctcacttgcccatcgctcacctcctgctgtgtggcccagttcctaacaggccatggacctgtccatggcccaggggttggggacctctgctctagagagaccacctcacttgaggactaaggtgtgagtgaaggaggaagaggcaggaaatgagtcttaagaaggcaaagttagagggaccgctggaaaactaggagagggtcatatcccagaagctggcgaaggtgggagtgatcaccagtgacagatgttgcagagaaagaacagaaagaactcatagatatccttaaatctccctaacccactccactttagtggttcactgtccactctgacagtagtcagtagtggccaccaaagcatgagatttttctctatgaatttgggccattttaagagtagagtctggaaaaggcatcagatggggacagattgcttacttcctatgagaattaaaagagataatatatttatggacaatagaaatgataaagggctaaacaaataagatgatgattattgtggtggtgatagtagtagtggtagaaattgacccaaaggagactcaaaatgatttgcttctatcatgctgcccaagtttctgagatcagatgagcttagatacattcaggatggtatggccgtagatggctactcaaaaggaaaaggtgaataacccctgcccccaagcagagtgaaacatcagtctatcctgagttgcgtaaagagcataagagagtcttagggataatgatgacatagtggccagagagtttgatttatgtttctaagaataattttgagatgagaatcttatagtggcatctggctgtcatctaaagaacaccagaaggatatcaaaaacatacttggttcaaagaatgttttgtggctacgactttcacacacctgctaagacgaaaaatatcacaaactgacaaacattgtaaaaaatgctttcaacacaagatagctcatttttaggcaactcaaagaaatattttaaggaacaaagtgctgtgccactgtaatgatgtcagatactttcttctcttaaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggtaagtcacctccttcatcgcctgctgagaatagcaccgaagcagatggttcctgcagcactccgcagccttcacctctcactcagcttggaggccagtccagcctctacccctaccctcttctggcatggccaaccctacctcctccctttcacttccattcattcctttcccaggtgcaaaatgacacttctcagtaatcctcccacctaaaaccaaacagaagtagaaatatttcataagcagtgggatgggcaaatgtggaacaccaggatgatgctggcactaaagagggctttcaggaagggtgtctgctgagcaggttagccactagatatttgtctattcaagaccttagctagaagactcaaattttacacatatttttcagaactcacaaaaggttgtgagcttctcttggtttttgctacaggtgaattctcgatgtgccaactgggcttatctcatttttataaggcagaatacccaatatttcatttgaaatcttgttggtttgaccacaagttctactaagacctctagcttttcctgcttacctgtaaacaagctcctacatgagtctgtccatctccctgagagtgtgtagatcaggggagtccaatcttttggcttccctgggccacattggaagaattgtcttgggcaacacataaaatacactagatagctgatgatctaaaaaaaaaaatcacaaaaaagcctcacagtgttttaagaaagtttatgaatttgtgttgggccacattaaaagccatcctgggctacattcgggttggatgagcttggcgtagattctactggctttccattccttcctggtctgtatccagttttgactatcaaatacttcaaataccaaagagaattaaatactggcaaaattaataacttaatgaacataattcataacagttgtaactactactgtaatatacctatgttatagcaatacaaacacaaaacaaagacaaggaataattacttttatgtacatttgccttgggtgccctttaaatagccacctcccttagtacatcttaaacatgatttgctttgcattgcacatctcagacttgctctcttttccctgagtctcttcttgagtccaaggttacccttgggagacgacatgacccttgaagttcagtagaacaggaagtaggatacattgttttgaaacctgtctgttcttgtttgttctcctgactgattttcaatttggtgattacaagacttaccctcccacagttccagtggtgttgtcagagaaactgagatctctgtggccagatggtcttgtgattttttagtgtgtgtttttctgcataaactcaattgagtttcaggctatttccagggacttgacacatttcagtcctgtttttctttaaagttaaaaatcacatgttttgacaacttcctggaacagagaaatggttccaaaaaaaaagaaaaccctggaagaatttcaccatttaaaggggggaaaacactcatgtcttctctcctgtcagcggggttcatctgtttgtctgtttgcttcggacaaacagagcagcaatgaactgcaacttaaagatcagacatacgcaaggaatttggcctcattgacgactctccttttttttttttttttttttttttttgagacggagtcttccctgtcacccaggctagagtacagtggcatgatctcagctcactgcagcctccacctcccaggttcaagcaattctcctgcctcagcctccagagtagctgggactacacgtccgcgccaccatgcctggctaatttttgtatttttagtagagacagggtttcaccatgttggccaggatggtctctatctctcgaccttgtgatccgcctgcctcggcctcccaaagtgctaggattacaggcgtgagccactgtgcccagccgactctccttctttttgtatatatgttatcttcctttttgccagtaatttttcctagaatgactgcacatctgtcctgttgctgacaacattcccatagaccccctggtgcccatatcaccccgtcagatcccagcagtacttctctttttttgctgttgttgctatttttaagtttcaaaatatgctttcacaaaaaggtttgcagtatagggaggccaaggagaggtttcttcccactatcggcatcttccacccaaagcaacaaacctttgcggtgaggctttgtgcagtctgtcctctcagtctggagtatttctccatccttagtgaccaaagtttgtttctcaagccattaaaaccttttttactaaagcaacgtttaggcagtgtgctccactaaaaacacacttttgtacatttgttgtacttgtgtgtgtccgtgttttggagtactgttaaacatacgtgttaagcatacatgttaaatgcctgtgaatctgtgcacgttgagccttaagcacacatacagcataacaaggtggttgaaaggatgggctttgtagtggagaaacttgagtttgaatgctggacctgcgacttaataaccacatatatgattattattcatcctttcataacatcagtttcttcatctgtaaagtgggaataataagacctacttcctgtgctttttctagggattacttaaatgaaatattcagaatgcttagcccagtgcctagatcatagcagaaaatcaataaatggtagccgccattgttgtagtcatcacagtgtgtcttcaaactttgaaaacttttaagttgagaaaccatttttgaaatgagatctcaggtaatatataaaacaaagtagcatgctctgcttacagagtaagtggggttccaactccacttacacctgttctgcttccccttccccaacccctctctgcttactctctccctgtgttccctcatccttcacaacaggaaaaaaacctgaacaccacagctttaacatacatatatgcagaatttccaaagtttacagcatgacaaagatggacagcagagtttttcatcatttgactatgaccttgtggtaatttttttttcttttacatactgctaagccttccaaaaagattttctgtttcttggttttatgttttcttttagaattgaagttcttcaagatcagggaccacatctctaaattctccaaataatgtctcagaatcttgtataataaaggctgccatttttagggaagctgggaaatgttgtatacatttgcattttgaattaaaggtgtcctcatttccagtgaatcacttattttgaattgataaggttaactaatacatgctgcgtatttgaataacctgttaggaacaatggagaaaaattgacccacttttttgttaagggtggggtgagcctggtccacaaagaaaaacatacctaactagtggcttgagcatggaagtaagaggaactgaaataagctctactgcatcccacctctctgcttcccaagggagctactttagcctaggaccatagtcacacttacttctagaataggggagagttcaggaacaagctataattagatagagaaacacaaaaccaaggcccagcgtttgaacccaggagtatctattagccattggagcagcatcctacaaacaggtgctaaacaaacacatttcaatggtgacaattttgataaattctccacagaaaaatctcccttatgggaggaataaaaaagaaaagtgtttttactcattggtaatttattctagaccatgttattttaaatttcactgaacagttatagaatatatataataaacaaatgtatttatatcattggcaaatgaaatttggcttctaagttttttaaatgtcagaatgtgttttttattgttctcgttgttttgttttgtttgagacggagtctctctctgttgcccaggctggaatgcagtggtgtgatctcggctcactgcaacctctgcctcctgggttcacaccactctcctgcctcagccttccaagtagctgggactacaggcgcctgccaccacatccagctaatttttcatatttttagtagagacggggtttcaccgtgttaaccaggatggtctcaatctcctgacctcgtgatctggctgcctcagcctcccaaagtgctgggactacaggcgtgagccagcgtgcccagccccgaatgtgttgttttttaaaattttaaaactagtaaatgttgtttattaaaatcaagagccagcaaaatattgaaaataccaaaagacataaaaattcattatcctgctttccaaagataatactgtcaacatgttagtttctagaagattgtaaattaatcagcatttgcttaaaaactgaacttaagaaatagatatgttcgtctcttcaaattgagtaaggctgattaacatccatgagatggtagtttgtcattctgaataaaatctaaatatccaggcttggcctgctaggccctgtgtgaggctgtccctccagcctcatgccacactgttcccctcatctgctccctcatcactgtggccttcctccacatcttcccccatcccagctacccactgctttcttcccagaatgctctgtgctgccctgtggtctcagcataaatgtcattctgcagagcagttttctaaatcaggttccctcctgttaccctttgccacagtcccctgccaggtccttcattgcatgtatcacaaaatacatttatttgtactggttttctgtttgtctttccctatcccaactgtgagctctgtgcagcagggccacatgtgtcctgtgtccctcacaaggggctgagccacggtaagcactcagtaggtgtttgctgagtggagtagtggagggacagcaccttgtaggggaggagctggatcaaactggataacctctggggtgtcttccttccatatcatacattgtattctgtgagtttcacaataactcaggcccagattgacagaccatcatcacatggaaggtaataagccttcaggaggcaggttaacatgcgtacattggatgaggaactaaatccaactgtgaaatctaatgtttcattaaataatacaaatatgtgagtgtaatatggtacatattcacatttttgtagagatttccttattgacataaatcttacatatttctttccagtcagagctgtaccttttgccaagagaacagggcatggagtatatacacatagtgtacattcaatacaggacagtggataaagggcaggaacaactcgttcttttataaacaagcattttggagatgctctgtgcacacagtaggcaccaagcaaatctgaagtcatcaggggagccaaataacacatctacagacaaatctatgcaaagcaggtcgtttgaggactgtctttaaaaggcacttgcccctagatgtcactcttaagaagcattttataggagaaaagtctggagcccattcgttgtgttattttaatctaggatgactgtggaaattttcttgccagttttatcaggcccaccctgtttccagttccgcagtcttatccccatgccagcgtatacccaagcctccaacctggaggctcagccacatgcccagtctctatgcagggtcctgactcaggaggtttttaagaacctttattcaaccagagtccatctcttctgtggtctagctctactcttgggtcccacattgttttaactgcttctgtttcagtttctccaccagaggtctctctgtttgttacccagctgctagaactagggccctaatccctcctgtcatttttcttgctggagacttgagtattctcccaagcccagccacagggaccacagagaccttgtaatctgacattcttccaagggctgcagccatctcagcatcatttccggtcactattctctacctccccttcctttgtgtgataaccctcatccttgtctatacttataacctgctaggctggattttctcagcctcctgctctagcctgttatagttaccaggccttattcaccatatccaaaataggacactaattcaacgcacactgactaaatacatactacagtttaggcaccgtgccaggcataaagaaggatcaggtactgcctttggcaaggcaagatattttcccagtttggtccctttcaaatacagttgttccctaattcatcctgattttaaagtagtgaatcttgtccaatattgaacttggcttctgaacattaagcattcatccatcttatatatgcagattatctgtagtgtatcagacactgcattgggcataggtgagacaatagagcatggccccagaacatggcaagaaagctacttacacaactttgtgccaagaaataccttgtgctaagagtgtccacagtggtttgcagagggagcaattaatcctgccctagaggatagaaaagggctattcagagaagcatgtgtttttctcaggccttaagggatgaattcagtttcatttttccaggcagatacagggaagggagggaacatccagacagaaagaacagcacgagcaagtgcatgaagttagaaaagtacatacaatcagtatttaggaacaagaagtatatttacctggtatggatagaaagtggtatttctggaagtgtgtagtagaatttgagtcaagaaaggaaatttgggtccaacttgaagcagtacataggctggattagagaggtggagggtagagcaaagcaaagaagtcatttggagctcattcgattaatcacaaataaccataattaaggtctattataggtcaagcaggagatgaccagttcatctgtcacccataatgtactgagctgataaaggattccgtcttgggatctgcaccccgacccactgactaggccaggctcaggctcccctgtctcagtgtgaagactttcagtactcactatctctccatgttatgcactggaagatatcctcaaagaagggtctgatttcagccatttgtaggagtttgaatatgttggtgtgatatctcccccatatgcagacttgtgcggcttgtcaaactgttaggactttattaagcttgtcaaatttaaattactattctggaaaagatacgaatccaaaactggaaagataataaccttttaattgacatcattctctcaatatttagtttctttcagaacattttgtctaacatagaatattgtcagggacattgtttaccatattacaaaacatactctctctattaagatcttcttgtgaaaattctactggtctcagtttctagaaaagctgtgcttctcctaaatagagatgttttcttttaaattttctgaacattgactacagttaacagattatgtccttttagctagagatatatttgaagacttcctatagcaagtactgtcatgcattgcttaacagtggggatacatacagagaaatgcatcattaggcaatttcgtcattgtgtaaacatcagagtgaacttacacaaacctaggtggtagtcttccacacacctaggctatatgatatagcctattgctcccaggctccaaacctgtacagcatgttacttactgaatactgtaggcagttgtgacacaatgttatgcacttgtgtatctaaacacatctgaacggaaaaggaacagtaaaaatatggaattataatcttatgaaacaactatgatagatgcagtccatggttgaccaaaacattgttatgcagtacatgactgtatataggacttgtgatgtacagttttaaattagcctccttccccaacccattgtggattgtttcctttccttttttcagccaattctaactaatgctattttgacttttgtatctccaaatagtccaccttaaatcctttttggaacaaggctgaaggataaatcacacacacacacacagacacacacacacacccctacgtgcacgctatcagaatattgactaaagtagaatagcttattgtagcatttaggtttctaatgtgcttctagctaaatattcgagaagatgacagtacagcccttctcctggtaaacagagctagtctgagaatcacttttcaagtacttacagataaaaatcctaattcaaactcatcaaatgcatggccaagtaccagacacactcctcttttggatttaccagaaagtgtgctctcatgcactgttaggtctaataatcagtgaccttctctgttttgccaaaataattcctaaagactggctagccaatgcattgatttttattaaaaaaacaaaataacaaaataaaattctctgcctttgactggaatgatttttatccattgtctccttcctctagcagacagaggcaacattactatttaggaaaagtaagtggaggttccacttcatttctagatgaaaatggaggattttgatgttaagtatttcatgtgacctcagacagtctgtagcagccacagctcatcagtggttaataaattagtagattgtatataaaagtagtttgttttcagtttagtgaactgatagttggggcagttagcaaatcaagtaaaagtttgggccctgaaatgataatgaattcctttgttcccaagacttctaagggcagtagctttgtaaaaacaattctttctgttagtactagatgctataattaaggcatttgaatcaacaatgaaattgagagcagatgtactacgtaggctcaatctatttattagctactaatggagaatgttctagctaatggcattaataataatgtaatgttccccacatttgtagtcattaacaagtgcattaaaccaagtcctcgaagtcagatttttcccttactcttcttctctcaataatacaaatccttcaacagtcagttgagaaggagagaatgaggatgtttgaggtcaaggagaggcagccctggcagaagggaaaattacagccagtaacttctgtgttctgtgttttcccctgagctccccaggccacatcctcatagtccctgaaaccacaggcctctaggccaaggtagtgtcagaacactcccacagaccctgtggctgagtccaaaaggcagaaatgaaacttctgggactgagcgggcagggcaggtgctcggctgtgccccccagggtgagagaaccacctgcaggaagccagtgttgctgtatgcttccatcctgcccacctcagtgggccagcaccatgacagcctccctttgacactggttggagtgaggcttatccccaactccaacctacctcaccccctaggcctttactaagagaccttgtgggcagatggtctagagggacagtgagccccttagcgttgaacagtatgtgtattcaataatgcagctcctcgtggtattgattagtaatcatagccaactacttatgtagcacttaaatctcaccacaacaacatgaaatgggtatcattcttattattcttaatctatatttaaaagaggttaagtgacttctccagtgatatatagtttaccagtaataaagccaaaattagaattcattcagcttgatgtgaatctgtgttgttaaccaccacagcacactgcctttcagcaaaggctgattaaagctgcaccaagtctctaagtgtgtacagcccatcagaatctcgacactgtgtttgacaagcatgggacgtgcagttaaactggggaagaaatttctttctcatagaagagatccttgtgtgtgaaaattagaactatctgaataaattagaatcaacagaaattctttatgtgagtgaaatagccttcgagaaaagcaggacagttatttcctttaacgcctctccttgggtacagcagggataggtgaattcctgcatcactgcttaacaagtatttactgagcaccagtggattggtgttataataacttggcctcaggttaatttccctccttgaaaatgttctattaaaaagagtttgaccacacagtgggctcacacagcaggggatttatgtggatcccccagtgtatggaaggacagaaaataattaaaaatcagaatgtactctaattcaaaaccaaaaggcgtccccatctatgtccttgtgaaaattgtgcaagttggcaaattaatgaggctgttgcctggggtgaagtctgcacttagcctgtataattactaagaaatgagagagacctcagtgggtcctacggatgagcaaaagaaaataatttccggacataagtggagtcattaagaatgcaagagcactaatgcactggggccacttccaggggacaagtgatggctgggcagcagcagcaacagcccacacaagtctcccgcttcttggtgaacagggaggaaatgcagaggggatggtaggcaagggagaggactgacgtttattgagccttcactatgtaccggcctccatgctgggcgctttatgtatattgtctcacttagaaaatgccagaatattccatgggttttgtattgcttaggatgatgtgtaccctgcccagccttgacatacagaatgacacaagcctgacctcaattatcattgcagttaccctaccacacacaaatgtcacagacaatatcagctaaaagcaaaagaaaactcactattaatattttgtcctataaatttatattcttttttctatataaatattttgtgttaatttaccaaaatgggatgcattgttttatacctacctcttaaacacttttacatgtttattaaatatccttctacagtatctttctagtagttccaggacatgcaattttaagtactttttgtgaatctttttttatcagtcccctattgtaggacattattaatagattgctttcaagtttccacaattttaaaccatgttctaatgaacatccttatagataaatcactgcaaaattattcagtatttttaaagatagattcctagcatggaagttgctgggtaaaaggatatagatgtttttaaagccaggtttattgaggtatgttttacatagagtaaaaatcaccctttcttttatttttggctgggggtacatgtgaaagtttgttacataggtaaacacatgtcacaggggtttgttgtacacatcatttcgtcacccaggcattaagcccagtacccaatagttatcttttttgctcctctccctcctctcattctctcccctcaagtagatcccagtgtctgttgtttccttccttgtgttcataagttcttatcatttagctcccacttataagagagaacatgcagtatttggatttctgtctctgcattagtttgctaaagataatagcccccagctccatccatgttcccgcaaaagacatgatctcattcttttttatggctgcatagtattccatggtgtatatgtaccacattttctttaatcagcctatcattgatgggcgtttaggttgattctgtgtctttgctattgtgaatagtgctgcagtgaatatttctgtacatgcgtttttatggtagaatgatttctattcctctgggtatatacccagtaatgggatttctggatcaaaatggtagtcatgcttttagctctttgaagaatcgccacattgctttccacaatggttgaactaatttacactaccaccaacaatgtataagtgttcctttttctccacaacctcgccagcatctgttactttttgactttttagtaatagccattctgagtggtgggagatggtatctcattgtgcttttgatttgcatttctctaatgatcaatgatgttaagcttttttcatatgcttattggctgcatgtatgtcttcttttgagaagtatctgtttgagtcctttgcccacttcttaatgggattgtttttctcttgtaaatttgtttaagttctttatagatgctggatattagacctttgtcagatgcatagtttgtaaatattttctcccattctgtaggttgtctgttcactctcttgataatttattttgctgtgcagaagctcttaagtttaattagatcccacttgtcaatttttccttttgttgcagttgcttttggtgtctttgtcatgaaatctttgcccattcctacaaccagcatggtattgcctaggttgtcttccaggatttttatagttttgggttttacatgtaagtctttaatccaacttgagttgatgtttgtatatggtataaagaaggggtccagcttcaatcttctgcatatggctagccagttatcccagcaccatttgttaaatagggagtcttttccttgttgcttgtttttgacagctttgtcaaagattagacagtcatagatgtgtggccttatttctgggctctctgttttgctcctttggtctctgtgcctgtttttgtaccattaccatgctgtttttgtagccttgtaatatagtttaaagtcaggtaatatgatgcctccagatttgttctttttgcttaggattgccttggctatttgggctcttttttggttctatatgaattttaaaatagttttttctagttctgtgaagaatgtcatttgtaatttgatagaaatagcattgaattcctttgggcagtatagccattttaatgatattgactcttcctatccatgagcatggtatgtttttccatttgttggtgtcttctctgatttcttagagcagtgttttataattctcattgtagagatctttcacctccctggttggctatatccctaggtattttattctttttgtggcaattgtgaacgggattgcctttctgatttggctcttggtttggctgttgttggtgtataggaatgcgtgattttttacactgattttggatcctacaactttgctgaagttgtttatcagctggaggagcttttaggcagagactatggggttttctagatataaaatcatgtcatctgcaaacaaagatagtttgacttcctttcttcctatttagatgttctttatttcttcctcttgcctgattgctctggccaggacttccaatactatgttgaatagaagtggtgagagaggggttccttgtcttgtgccagttttcaaggggaatgcttccagcttttgcccattcagtataatgttggctgtgggtttgtcataaatggctctcattattttgagatatgttccttcaatacctagtttattgagagtttttaacatgaaagggtgttgaattttatcgaaaggcttttctgtgtctatggagataatcatgtggtttttgtctttagttctttgtatgtgagaatcacatttattgatttgcgtatgttgaaccaaccttacatcctggggatgaaacctacttgatcatggtggattagctttttgatgtgctgctggatttggtttgcaagtatttgaagatttttgtattgatgttcaccaaggatattggcctgaagttttcttttttgtgtgtttctgccaggttttggtatcaagatgatgctgctctcatagaacgagttggggaggagtccctcctcaattttttagaatagcttatataggaagggtaccagctcttctttgtacatctggtagaattcagctgtgaattgatcaggtcttgggcttttttttggttggtaggctatttattactgattcaattttggagctcattattggtctgttcagggaatcagtttcttcctggctcagtcttgggagggtgtatgtgtccaggaatgtatccatctcttctaggttttctagtttgtgtgcatatttgtagtagtttctgatggttgtttttatttctgtggggtcagtaataacattcccttcttcatttttaattgtgtttatttggattatatatatatttaggctactttatatatatattaaggatagttaagtcttcttgttgaattgaacccattaccattatgtaatgccattctttgtcttttttgatctttgttagtttgaaatctgttttgtcttaaattaggacaaacccctgctttttttctgttttctatttgcttggtatattttcctccatccctttattttgagcctatgagtgtcattacgcatgagatgggtctcttaaagacagcattaccattgggtcttgcttttttattcaacttgccactttgtcttttaagtggggcattttgcccatttacattcaaggtcagtattgatatgtatggatttgatcctgtcattgtgctattagccggttactatgttagcttgtttgtgtggttgctttacagtgacactggtctgtgtgtttaagtgtggttttgtattagctgatagcagtctttcctttctatatttagtgttcctttcaaggtctcttgtaaggcaggtctggtgggaatgaattccctcaacatttgcttatctgaaaaggatcttaagtctccttcacttaggaagcttagtttgtctggatatgaaattcttggttgaagatttttttctttaagaatgttgaatataggccccaaatctcttctggcttgtagggtttcagtggagaggtccgctgttagcctgatggggttcccttgtaggttacctgccctttctctctagctacctttaacattctttccttcatttcgaccttggaaaatctgatgattatgtatcttggggatgatcttcttgtgtagaatcttgcagttctctgtatttcctgaatttgactgtcagcttctttagcaagcttgggaaagttttcatggatgatgtcctgaaatgtgtttccaagttgtttgctttatcctcctccctttcagggatgccagtgattcgtagatttggcctttttacataatcccatacttctcagtggttttttttttcatttcttttttttcttttttctttatttttgtctgactgtcttatttcagagaaccagtcttcaagttctgagattcttttctcagcttggcttattctgctattaatacttgtgattaaattgtgaaattcttatattgtgttattcagctctgtcagacccattaggttcatttttataccagctatttcattcttcagttcctgcatcactttattgtgattcttattttccttggattgggttttgccatcctcctgaatctcaatgatctttgttcctgtccatattctgaattctgtgtctgtcattccagccagttcagcctggttaagaactcttgttggagaactggtgtggttgtttggaggacatatgacaatttggccatttgagtcacgagagttcttgtgttggtcctttctcatctctgcatgtgggtgctcctttaaccagttgtagattgagaacagtcaacagaattcttttctggatgttttcaccaggccaaggctttgtgcagggtctttatttgaagctgacttcttgtccctggtttcagagggaggtatgttagtgaggtatttttggtgttgaagctttggggtatgatccagcaggtggcacttaggcttattggtcggttggtagactcttgcttggttgtgtggctcccccatgttaactcacagttgcagccatgttctctctcaatgctctgaaagtgtgggtttctctcccccttgagtgctgtctgtagatcatgacttggcactcctcggatgcccactgcagctcttgtgtaatctcagtgtttatgttcctttcccaacttggaggcagcagaggaagggactttggtattggttgtggccaagggtcatttgcttgtcacctggggactccaccccagagagatgcaggtcagcagtggctcagtgcaagcagcccaggatggagagtctgtgctgtgggcccaagccaggggtttcctgtcttgtgtcaagcaatgcggggggtgtgtgggatgcacgggagacacactggcctcctctccttgggtcagctgcagcttgctggaggtgtaaaatcaccctttctaggtgtacagttctgtgaattttgacaaatgcatcagtcatgtaaccaccatcacaattaagttatataacatttataagcactttaaagcttttgatgcatgttaatcaaattacctgctggtaacattatatgtattcctatctaccatcagcttataaaatgtgaacattgggtattgtccttaaaagactaaaaaaaaaaaagtccagtttttaggtaaattttccatctcattttaagttactttttttaatattaatgaagttgcattttttttgtaggtttatctgtttttatgtcttacagtgtgaatttttgttatgtttttggcctgtatttctggccaattatctctttcttattgatttttaagaactattagggggctggggttgaaagagtgatctgtcatgtcgcaaatacattttcttttgtcattaagccacttttaatattatgtatagctttttttctctcaaaagttttaagttcctgtagtctcaccatcttttcctcatagagtccaccatggaagtcatcttcataaagtcctttcccactccatgattatttaaatgttttccctttttaaatttaattcatctggaatttatttttggtatatcacatggagtagaattttattttctcccccaaatgatgagccacttgtcctggtcccatttatcaaataatagatcttttccccaccaatttgaaaagccacctgtattatatatcatatttatatacttaagtatgtctctgaactttcccttctgttccacaaaattccttgtctttttgggagaagactacttactggttcgcactgtttttaataatgtagttttataaaatggtttaatatctggtttggcaagtactacttttcattattatactttttcaaaatgttctctcaggccctaattatttcagatgaactttaaaccatatctgagtttaaacacccaataagaatttgtattgaaattttatgtttatagattaatctaagaataatttatatcattataagcagtcttgtcactgagggatgttcaaaaactgactcattgctcttcagagattaaagttttataattttttaagagtataaaaattataaattataaaaattataaaagcataggttctacatgttttatgtgttcatcctaggaatcatgttattgttgttaccattgattttagcatctgtttttgcattttactttccaacttgtggatcctatttacagcattctatttattaatttttataaaaacctagtttattaaaaactacttacagtaatatttgattttttaaagacaattaggtcatttgtaaataataagttttccttcacttttctgattttattttatttatttatttatttatttatttagagacagagtctcactctgttgcctactttggagtgcagtggagtgatctcagctcactgcaacctctacctcccaggttcaagcaattctcttgcctcagcctcctgagtaactgggattacagacacatgccaccacacccagctaatttttttgtatttttagtagagacggggtttcatcatgttggccaggctggtcttgaactcctaacctcaagtgatccacccaccttggcctcccaaagtgctaggattacaggtgtgagccaccgcaccaggcccacttttctgatttcatacttcacttctttttctggtatttcattatttagaattatttttataatttcaaataattcttcacattgtcatattttaatgacatatgaagtaatatattttttaaatcaaaaatagatgttaatgcagtaccttatggtgaattaatccctcagctttagaataaaccttatttggctatggtgtattaatcttttaacattatgctcaatatttattatttgaaatatatatataatcactaactttagttttctttaatatactatctttgtcaagttatggtattaaggttggattattctcatgttgtaaaattgagactcttgcatttttctatgctttggaacaatttaaatggcataaccatacctgttgcttaataagcagacttagctcacctgtatcacctgctccaaagctttttgggggaccatgagccatagcattttttaaagccctctctctcactcagtgttcagaatttgtattaaaatttcaaagttcatttaacaattttgattatcagagtgaaaagctaatgcatctgttttcttagacttgaacagagtataaaataaagatgaaaactaaatctcaaacacatttccatcagtgctttggatttcattagttcttggcaaacattatttacacttacataaagtttattgattccagtatgatgttcaaaagctgactcattgctcttcagaaattacagaaatgtctaccctcaatctcttgggaaagaaactgaattaaaaaggtagagtaagaaataagctgaaacttgtctgtatcaattagttttccttgagcactccctggatatatgcaactacacggaagtatttaagagattataaaaacagtttctcatcaagtttttcatctgaggcagggaccttgatggtttcttctcatggacaggtaactctatgtacatttcagtacatccctgtaatcttcagcctacttgttagttaccataacaacagtaacagcattttcttcttctttatccaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaacacccttgcctgcgctccattcccaggttataatttaattactgtgggatgagacccagacatcaatatttttctagattcttcaggtgattctaattcacagccagagttggaagccctgcgtggcctttgaaggtctagatgattcttcttccttgccctttgagcttttccccatctcacaggtatctagaaaaaaactcctcttctttggcaacctgtccttttaaaatcacactctacccacctgtacagaagaccatgccctataatgaaatgtttattcctatctataaatggaggataaacattttgtggcacttctggaccaactattccctactattcttttgaagaaaggcaggaagagtactttctaattcagaagaggatgttttcactattctgataaacaatagccaagttcagaccttgtacagattctttttatttgaattgctgaaataatttattgatgatgaaaaaaagattagagaggaatacatttatatttagcttattggcacatgtgcatacatatttcctcttcaaatgaaccagttctttcatttcattatgctaatatatatatataacatatatatgctaatatatatataacatatatatgctaatatatatatatcacacatatatatcacagttttatatatatatatgtatgtgtgtgtgtatatatatatatatatatcacagttgggcttgattcttccgtattccaaagagcataatttcagttctatagacttatagataaataaaaatcatctttgtgggcttccttcctttactgttcgcagtgaattacatgacgaacaacttctatacctttgaaaatgttctagaactagaatcatcctgctactgggaactacccacagctctatcttcaatgccaggtgaaaacacagatcacaagtcagatgaatcaggccaaagcaacttttatgtatatctaggactggcgacataatttgcagagcccagtgaacagtgaaaatgcagtcccatcattcaaaaattattaagaaattcgagatggcaacagcagttgtcacaccaagcacagtgcccttctgagcatgaggctctgtgtgactgcatgggtccatgagaccagcactgtgtgggtctgaatgatggctttggtgttcagtttagcacacgcggtctaccacgtctgcatgagtggtaaatgtagtgcctgggtcaaaatgttccttctgttcaaatcgaaatacctcatctctatggctctatggctgtacattaggacctagaacagtggcccattgctcttagactggaaccatgtccactaaaataaacctaagcagatgttgtagacctagccccacaggactgcatttagctgcttcagtgacactttgatgaaagtatggagaagtggagacattatagataaaatatatcaattcccagagaaaactcttgacttaaaaacttaactgtagtaaatatatctttttcaggtgatgaattatttttttaaaaaaggttacatataggaattctgcagtataatttggaggctattagtgctatattaatggaaattaattattttttaagtaagtccaaaaaataatctagaaagtaagtttccagagcaaatctgacctagcatttggtatgctaggctctgcttttcatgattttgaaataaatcataattagacttaacaatatggagaaaataaacttgtatttttaagtgttctgttggcttattttctgtttcatccaactcaataattctgataaataaatttggttctagtttggtgcttgtctgcatagtctcaaagattcatttcaggacagctatctggggaacaaaaaacacacaccttggccaggcatggtggctcatgcctgtaatcccagcactttgggaggccaagatgggcggatcacttgagcccaggagttgtagaccagcctgggaaacaacatggtgaaatactgtacaaaaaatctctacaaaaaatacaaaaattagccaggtgtagtggcacatgcctgtagtcctgggtactcaggaggctgaagtgggaggattgcttgagcccagagggtcgacgctggagtgaggcatgattatgccactacactccagcctgggcaacagagcaagaccctgtctcaaaagaaaaaaaatcactattgagggcccaccacctaccagacactgcactaagtactggggattcaaatacggagcaagattgacctagtcccagtctttaccatgtttataatatgttagcgatagctgatacttcataatgggtgcatgtttgttgtgggttgaactttgtcccccaaaaagatatgttgaagtctcaaccctggtgcctgtgaatgtaaccttatttggaaatagtttccaaataaggttataacagatataatcaagttaaggcaaagttatgagagtggccccaacccaagtaacatccaaggtgagtaccatgtgatggaggcagagatgcatctacaagccagggaacaacctggggcaactagcagctggaaaaggcaaggaaggatccgcccctagaagcctccaagggctcatgccctgccagtgctttgattttggacttctagcctctggaagtaaaagaatatgtttctattgttttaagccaccagtttgtggcactttgttatggatctctagggaactaaaatagtgtcagtacccaaaaattttgtggaggcttttattttttagtagggggatcacagagtttatgtaaatacatctcttttctgctgttaacaaaaagatttaattgcatgcaaaatatgtgaagggctaatattcttaatatataaaaaggtctaataattcaataagtaaaagataaataccttatcaaaaaataattcacaagaaaagaaatatgtgtggccaataaacatatgacagcagaccccaagtcatgattgattaaacaaatgcaaattaaagtaagtttattttccctatcagcttagtaaagactggtaaagtccagagtgagtactaattttagagaaagggcactctatcaaactgttgaaagcagtgcaagttgggaaattcatgcatggcattttgacaaaacatcaaaatcaaggtatctattctctgacccagcaagtccacatttaagaatttatcctttagaaattattgcacaagtgtgggaagacttatggtcaaaaataagttgtcaacattctttataataaccaaatttcaaaatagcctaaaagtccttcagtaggagactgaaattacattgaaattacatccatacagtggactcacaatgaagcctttgaaaagataaattagatcaaaatgtattgagatctatgtagatatctatgacatactgaggagtgaaaaaggtggttacaggactgtattatgctccgattatatttgagttaaaatgtaggcttatatatgcatgaaaaggctgggaggatgtatttacaccacactgttaatagtaattttttttttttgagatggagtctcactctgttgccaaggctggagtacagtggcactgtgtaggctcactggaatctccatttgggttcaagcaattatcctgcctcagcctcccgagtagctgggattacaggtgcccaccaccacgcctggttagtttctatatttttagtagagatggagtttcaccacattggccaggctagtcttgaacccctgaccttgggtgatccacccacctcagcctcccaaagtgctgggattacaggcgtgagccaccgtgcccagcaaatagtgattttttttcttttttacctcacatttatttttttccattgagttttaggaaatgactttatattatttgaatttataaggggaaaaagttatatcttttcattttgaaaaacaacacagtctgcataataattatatcctttagcttacatcatgactcatttaaagctcagaaaatttggtttctcaaaggaaaaaaaattatgtgaagtcaataattattaagtagtggcatcaaagctattgtcagaacttcttggtgtaaaaatgtccatgtaaaagtttcctgctttaccagccacacctggttttgatctgttgtactgctaaggctggccttgatttctcccctaaaatagcaatgcttttggagaagggcctctaaggatgttgtctattaatcagtgagggatgccttggctcgtgcagctcttctcagatctgcagacctcatgcagccagttggccatgcggagctctctagctcacatctgaggtcccccttggaggtgcagacagcctcattttcacttctcatgaatgtcagattcttttctaagcatttgctcattagtatgagtaaagctcattgcctgctgcttgggtaagaattttctctctggggctggactctgagtctgcatccataatgcacttggcatctgtcttggggaccgtaatggggcacagggatataccaaggaacacagagtccatttgcagcacctcagtggcgattctctacctctcacagcagatggacagccatctgagaagttttatactcggagaatcaaactcagaatcttttgattacacgtaaaagttaaaatgggtccttactacctggcagagatccacccatcattatcaccactgtgtgcaaggtctgtagctacacagcacctcccatcaccagatgtgtatggtggccaaagctatgctggtccccagcaccctccactctgcacctctcctttgcatcactaagcaccctgttctacaaaaacaacaacaacaacaataacaaaaacagaaaaaaaaaacagccctgttactactgagggcttcctccggtcaaatcccatggccacacatcactgccaaatccctgacctctcccaggatctgctctccccaatctatggttcagagaagacagttcctcatttttgaagcaactccttgctcaggcactacctgcttaaagtggcagggcacattctacaggctttcagcaggtagatggatttgattactttaatctgtgcagatttaaaggagtatgagactcgtgagatcctggagaaaactcagagtgagcatgtgtggctgtggacacaaggtgaccttaagccagcaattcggggataatctattttagagcctgagcaagacactgcaagggcagttaataggtaagatagaagtaaagagtggtttaggtggctttggcattagatcatttcaaattcaagtaccaattgtcacttgaacaagctgccaagtttcagccctctcctctgtaaactagggaggacagtatagtacctgctttacagaattactgtgctgattaattgaaataatgaaagtgaagcattaagtagaattctggccaagagttactgctcaataagtgatcactatcatttctatattctttttaaagaaggataaaaaatctcaagaaattaaagccaaaagttcaatggcatcacccttggagtgtgacttttaggagtactttaaatgatgaaaatcttaacaattttctaagtacagtatcttctcagtaggacttcaaaggaaaaataatttccattctctgtcaacatcagataccaaggaatcttctaaatagcaaccttctctgatgagttattctaatcaatgcaaattagttcctgggtctgggcttaaagaaaattagagaagctagaatcaattgacaatgctaccaactcccatttgctttttgaatcagctttatggaacattgcatgaataactttcaccaattttaaatgtagaatttgaggagttttaataaatacataaacccatgcacctaccactatgttcaagataaagaacaattccatcacgccagaaagttctctcatacctctttgcagccaattctaacccctaagaaccactgaattgctttctatcactatagttttgcattttctaggattttatataaatggaatcctacaatatgtggtcttttgtgcccagcttctttcacatagcataatgcttttgagattcatctatgttgcctaaataaaacataatttaggaaggctcagtttctggacagatttgctgcagttcattctagagccaaatgccaagtttcatttttaattgtctgctgtgtatgattatccgtaccagtggctcctgctccattttagagtattaagagacctcattattattacattaccttgttgctatttatacaagatattaatagtaggtgataagaagctttcatttcagaggctttattttctcggatttggtttggtttggtttggtttgagatagggtcttgctccaacccaggctggagtgcagtagtatgatcatggctcactgcagtcttgactgcctgggctcaagcagtcctcccacctcagcctcccaagtagttgggacagaagcatgcaccaccacactcggctaatttttttatgttttgtagagatgaggtctcactgtgttgtccaggctggtctcaaactcctgggctcaagcgatcctttcaccttggcctctcaaagtgctgggattacaggcatgagccacaatgcctggctctgctctggttttaaaatagtgtaggaatagaacacattcttcactactgctaaaaaaaaaaatcccctcacagggccagcagacagaagagcacaggaacacttgaagtcagcagagaaccttaaagagaacttgtggagcagtttctcaaacttcaccatgtacatgtatcacctggggttgcagactctgattccacaggtctagggtgggctcttaggttctgcatttccaacaagctcccaggtgaagccaatgctggcagtccccaggccacactttgcatagcaaggctctgtaggacatagaggcagattcagtgaatgaggaaagtcaaatcaacaagagggctgaaaatatgtaccaatctgtgttgcgcaatacttctcagagacatgaattgtcatcatacatgatgaactacacacatacatgcatcatcaatctcttttttcaaatggtgcctcaattttctcagccataaaagaggcctgataatacctagctctgtgggaggtagacccctaatatggtcctcatgatcttagcctcctggttctcatgcctttgcgtgatccccttcctttgagtatgaactggacctgtcaacttgcttctaacaaataaaacatgacaaaggcggtacaatttcacttccaagattaggttataaaaagcctgtgactttcaccttgcaggcattctctagctctcttttgaacctgctcagcttgatggaggcccttgccatgtagtgagatgctctgtggaaaggtctatgtggcaaggaacccagggaggtctccagccaacagctcgtgaggaatagaattctgccagcacccgcactggtgagtcggggtgggtatcctttcaagtcaagccttgggagagacccagagctatatcatcctgctaagccatccctggattcctgacctatggaaactatgagataataaatactgtggttttaggccaccaagtttggggataatttgttatgtggcaataggtaactaatacatttcagagttttcatgaagattaaagaagacaaacacattaatgtatgggtaagaacttagcatagcgcctagcacatgggagttacttgatggtgtcagttaaatctaaaaacagccaagtcacaaacatcaccagtacttgtaaacagcacctgcagccagtaaactaaggataatccatgtgtataaagtttgctagtttccccttgtcaagaaactttcagacccaaaagtctgactaatacaaataagtaaaaagaaacaactaaatgtccacaggtgtgttacatatatgtagacaaacccacttttaaaatgtaagattgggccgggcgtggtggctcacgcctgtaatcccagcactttgggaggccaaggtgggcagatcacctgaggtcaggatttcgagaccagcctagccaacatagtgaaaccccgtctctactaaaaaaaaacacaaaaaattagctgggctggtggcagatgcctgtaatcccagctattcgggaggctgaggcaggagaatcgattgaacctggaggcggaggttgcagtgagccaagatcatgccattgcactccagcctgggggacaagagtgagactttatctcaaaaataaaaataaaataaataaaatgtaagattgttttttttccccctagatcttggagcaagatcaagtgccccagcaggtactcaggcaatgatgatgatgatgataatgatgatgatgatgatgatgatgatgatgatggtggaaggggagctcccactcagctgtgttttgtaaaatgatgatcccactttttcttctcatttcccctctcctaacttctagtttattcaaagaagcaagttcaatcgcaagcatcaagctaaatggaaactatcaagaaacatttaagggaagtcagtcccaggcttaaagctgctactctcttaatagcaataacagccattcatcctcagctagaaagaaagaaaaggatcagcattcagacagctcttgcagaagccctcaaaaggcctgaatgattgttagccatgcttttgcttctgccttcatttagattttagcaaacactgccacagatcactcagaggtagctaaaactggctagggtggctaataagatgttgccgagagctggagtgaagtcacagatgagagcattgaaaccagtggttgaaactggctcagtaccaccaaaacctctacgaaaatcactgtgaaagcctctaaaaccaaatccacattcagcagacatttattcagcgtcgattatgcatgtggccctcacccatactagatcatcctgtggaaacaaaaataagtcaggcactgtctggtggagggaacaggctcatgcacacttgactataatagaagaaaatctgtgataaatcatgatctactgatgcccactctgttctaggcttgagcatgggggcaggaatataaacaagacctcttgactaggaacacaagaccgattgtgatgtgttatattcaaggtataaataaagagctcttacaaaggtggtaagagcttttccaactaagggaccaggaaaggccttctagagaaagtaacatttgaggtaggtcttgaggtatgactaggatctcaacgtgtgggtcagagcattccaaatggggtgagagtgagagcagcaagacaaagacagcaaggggtgaacatgcaaggtgagtcaagaaataccagtagagcactatggcaggaaagccagcttaatgctgaaaagtagaagcaaaggttacaaggaccttgaaactgaggagaggaggctggatttattctgcatgtaatagaaaggcattaataactgttaagaacaatagtgatatggccattcgttagtaagaacactttaggtggctagtaactgaaacctaattcaaattggcttaagcaacaaagaatgtattggttcatttaactgggaagttcaaagatgcatctggcttcaggctcaactgatgccaaggaataaaatgatgtcatctcttggctctactttcctcttcttgatttctttctcaagggagttctttccaaagatgtggcaaagatggcaaatcaaatcagcttaaggcttaatcctaatagcttagcctctcttgggagaagagattgcttcttccccaatagttccatcaagatcctggactgagtctcatgtgataact

SEQ ID NO: 1571 - DNA, 5310 bp, Homo sapiens
rgcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccgctggtggacgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagtgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcat

SEQ ID NO: 1572 - protein, 1102 aa, Homo sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 1573 - DNA, 40568 bp, Mus musculus
  misc_feature (1)...(40568): n = A,T,C or G
ccaaccaacaattctgtatacttccaaggccttgagctttctttggaagcaatgattaaactcttaaacattgcttttacgtttctctcatggagattgaaaatgtatgtggcatattaagagcttgcagaaaattagcaatattcaacccgtttattttgtttaatcccatattgcctttgctttattttcttttttttcataattcattttttagatttaggtattaatttattgtatatgagtacaccatcgctgtcttcagacactggaagaggacatcggacccattacatactgttgtgagccaccatgtggttgctgggaattgaactgaggacctctggaagagcagtcagtgctcttaaccactgagccacctttccagtccctagctttattttttaattgagttatagtcttgcccagtccttggctcagctgcacccaggcattgtatacatgttgctgctcctcttttccttggaacctaacattgtgcctttctggtcccttgagatatccttctctgccactggctcttgtcagatctgaacacaggtcaactttggagtttttgcctgtgattttatttatgtattttttaaacaatttttattttattttactttttgagagcttcatgcatgagtactgcaacaccactaccacccttcctaccctcctctgattcctctcatgtacacccactcctaaattcatgatttctatatcttttatgtcacacaaatattcatctacatttatatacacatatgcatccaactgtctccatttactattgtccataattatatatcttttcattatcacatgagctgtaggattttatgaaatatagaaagagaactccagaagaaatgccaagtagtttcaccttgtgttttaagacacccatcttttgcctctgttggcatcttcatctcttgaatatgtatatctcctaactatgcttctcaataggtaaaaataaatcatctagtagatatgatgtagtccttagagtgctcttcatatgacccaaaggggtaatccaagtagaaaccagtgtggctgaggacatgctgggggctatcacgtgaaagccttaacataaccaagtccagtgaagaaagaccacagaatgatttgagcaggcaaagtttaaataattactgataagatcaggggattagagcaataaggaattgacctaacaaaggtaaatgaagtctaaagaatacagaaagtaggggacagaggaatgacttaactgttaagagtgttttcagagaaccaacgtttgatttccagcatgcctgtaactctagctccacggtatctgatgccgtctgctggccactgtgggcactgccggcacctagagtacttctctacatataggcaaaaaaaatcacacacataacataatcttaaaaaaaaaaacctaaaatgaacaaacaaacaatggcacagagaaaggggaggaaggaagggagggagggagggggagagggagaaggaaagggagggagggagacagggagggagacagggagggagggagagggaacaagtgctgagcctggtggaaaaggcccaccattctagcttctctggaggctgaggcaggagaacctcaaattctgggcctaatcgggttacggagagaattcaaggttagcctgggtaacttagcaagaccctgtttgataaataagtaaataaaaataaggaaaaagaactgagaatacagtccaataaagtagtaatgactagggggtgggggacaaagttcaatcctcaggactgaaagggagcaagaaagaggaataatagaaaatatctcctattctcagggcaaccaaggaagagtccttgcctgtgtacatgcaaagctaagatgcaaaccttccatagcttagaatactggaagacagaaaggttgtctgcaggcacctggactaagctgttccttaaaggaatattgttatgaacaatgcagatgggagggtctatagtgtagggtggggggctggctgctaactgcttttggttgatatgtgctgcttgcacccagcaacactggacaagggagctttgctgtagcacttgggtctggagtaattctttccctctctctttagtgtgtgtgtgtgtgtgtgtgtgtgtgtgtatgtgtgtgtgtgtgtgctgcatgtgttagactgcagagacttgctgtagacacaagagaactagaccaaaaattctttcttcccgaaatgtctcttccttatcctcttcggagtggaatatcattgccagctagtaatgagaaatagttaatgggccacagatacacaactggtgaaatgggagaactttgagctgagaggcagaaagttgataactgaaccttacaagggagaacaacggctctggaagcagaagctccgataggaatgtgaccaggagaaagacctgcccacctttctaaaaagtaaaattgccatattttaattaactcacataggacagcactgcagctggcctatggaagccattcagacactcgcccagtcccgatctggccattgaaatgatgtgttgggacagtcgctaaaggtaggaggagatgactagaccattgtttatgggacttgatcctagctagataggagaaaaatccatttccaggggatcttaggtggcaacgtgataggcagtttctgcgggtgagacctcacaacgcagaacaccactcatagtaacggactgcctgcgtacagtcagctggtaggacgatttggattcttgacacccggtttctttttctacttctttctattgtaataggagtttccgacatggtgaaaatggtgggttttgtactctgttatttggagcaaagatgtcatagtttccatttctcccattgtttgggcatgacatttggtcatctctaggtctaaaatgaggccttggtgccttgagcagagagattagaactgaacagcgccatcttgggtgagtttagggtgagaggagagcatttgataagatgattggattcccacaggaaacctttaattttaggggttctcatatgtttcatcacgaaaccctgtaaactttttatatagatcattccgccattgaccattgctgccaccacagaccaaaagccaaccaacacctaaatgccagcgggctaattaaggaaaattaatttcacttctctgaatggtggaaaatgaagtaagactaatttttagaatcttggtcttcaggtaaggagaatattatttaggaagttggtattttagtcaaccaaaatgtaagtcccctttaagggcataaagcttccacaggagctccctcgatgcagctctgagggatcacatggcaagcatcaccgctttacaacaacactgtacccttatgagggtctggaaatgcccccacgggaatgttaactagaacaatgaggagaggtttatgatgctaaaccctccgctgcgaacatttcatctctttttacagccatgcaaattgttacaggtccactgacaacaggaaaaatttactgggcttaaaacaaatcaggcagcatttaactgtctaaaattaaacaggaaaagcatgtcagaaggcctcggaatcacgggagttcttaagctgtcttaaaagtgtatgtaagacttgtgcacaccagaaaattctcggtatgtccatttgtgtgtgtgtattttgttgttttctttttgttgctgtttttgtttttttgaagtcagggtttctctgtgtagccctggctgtcctggaactcactttgtagactagactggcctcaaactcagaaatctgcctgcctctgcctcccaagtgctgggattaaaggcatgcaccaccactacctggcaaaaatttattattatacataattatactgtagctgtcttcaggcgcaccagaagagggcatcagatctcattatggatggttgtgagccaccatgtggtttctgggatttgaactcaggaccttcggaagaacaatcagtgctcttaccttctgagccatcccaccagccccatttgtgtttcttttggagctatggatggaaagtgagtaatgaacctagtaaatcctatctgtgctgccaaggtggcttagtggttagaatgtgcctagaaggatggctcaacagttaacagcactggctgctcttccagaagactttggtctaatcccaagtatccacatggcagcttaccaccatctgcaacttcagttgccaggaagaccctcttctagcttctgaaggtaccaggcactcaagcattgcaagacacacatgcagacaaaatgcccaatctacatagaatgagtaagtaaaaatggttaaaaggtcttgccatgcaggagaggatgtgagttcagattccaaagactggggatccccggttcaaattggctagtgggtttgagagcaatccagggtgattccccaacatcaactgagggcctctccatgcatatccacacacgtgtagccacgtggtttatgcatgaatgtacaaacacgcatacacattagcatgaacatcatagcatataggccagccaaaaagagactttaggccagatttagtctatgggctctgctataactgttggttgggtgacagcactgacctctaggctagcttcatacaatcaaagcccaaagaaaactctccaaagacctttctgctttcaacacccatcccatccccactcccctccatacacacattcacacatgagcagaaagctcacagtggtcctaattttccagtagccatcctattttatcagctggttcactgaaaggtatttaagattttacaggacttttcaacatgaaaaaaaaaaaaaggaaaatcacaagtatataaaataatgtggaaggagttaggacgggaaagcaaggagagagagacagagacagagacagagagagacagagagacagagagacagagagacagagagacagagagagagagagagagagagagagagagagagaagagactgttttaacatcacaccttctttggagagtgaaagttgccaggtgttatcacaaaacagttatattaacattaagaaggggctatgcttgtatctttcacagtagtcaaatcttcagaaaaaatgtatttattttagtgctgtaacctacaactgaaaagaagaatatttgtacagaggaatctagtgggtgtttttttttttttttttttagaagtgtgtgtatgtgttgcagggtgtatatataggatgtgtgtaaggtgtgtatgtgtgtatagggggtgtgtaggttatgtgtatatatagggtgtgtattcgtagggaatgtatttagggtgtgtattcatagggtatgtatatagggggtttgtgtatgtgtagggtgagtatagggtatgtttggggtgtatgtgtataggatgtgtgtgtgtgtgtgtgtgtgtgtgtgtgtgtagatgcatgcctgtagtggccaaaggtcaccctctagcgtgatccctcacatgtaatccaccctgtcctctaaggcaggctcttactggcctgggccccttgagtcagctaggctgtctaggcagcaggtcccagggattagcctagcttgccttcccagcactagggttcaaacaccatcttattttgatatctgggtgagtggggcttaggcactggcttcaggacctcctgtgcctgcagtaagcactttactgagtgagctgtactctcagtcagcccttggttagaacattttcacgtaggaaaaaaaaaaatctaagagacttagcatttcatggcagcagtaaggacgcatacacaaaagcccccacgtttttttcctatgcttttactgctaggggaagtttgagggaaggggctgtggaaatgtttcctacttgaagtttaatgttcagagcaaagaccacgccagttccagctgagagcaagagcgctcttgaaagcagactgaaatccagatacctgagccgttggtagggcattcagtggaaaatttcatttccacattataaataactgtaggatattttaagggatccaagactgggaacttccaagagctgcttacattagttctactgaaatgtttaatggagggaggatgcccagcaaggctataaagctgaattaccggatatgattaattaaaataaataatctcaccattgattaaattgcccttaaaatccccaaccattgaggcctgcatgtctcattatgcatcaagtaaaaaagggggagcatggagtggtggtaactaaacagcaatggcgggaaagcaaaggtccccaagataggatttcttatattcaaacgactgtagagtttcttgttggaaaaagccccactctgggagcccctatttgaaacatgggccgtttctcagttctgtcagtttgtggaagtcccttgttctgtgggtttcctgggaggagaacaaaataccctctcccactatcgacactatcgatttctggggactctctgctcttctgcagttcccaacacttaaaatgaggggcaatgaaagcaagccatctctgtgggctgtgccactaaagaaagctgtcccactaagggcaggaggggtaggtatgtaattgagtcatgacgtcaggttatgaatttgcgaggatacaagttagtttgggtgcagtttctctcttagatgggttaggaagcctggcttccttttctaggctggcgtctatggctggggcgattagtgcaagggagcgcacacacgcggtgaggcagtattcaggcttagagctctcccctgtgatcaaaaagatatttaaagtagcacccttaggagacagctcagtaactcgctccacctgtaatgtatatcgggagtgagcgctagggacacagaggccaccagctacgaggaagtcgggtgggagatgtgggcgccacaggtagtggcatagaggagcgggcagtggaagaagagggagactgagtggctcagggaggtgactcaagtctgagggaggactggtggaagaatccggaaagagagcaagagacaaggaaagaccgacatgggacgtgggcggcggcggcggcggcggcgggggggggggggtttgcatagttgtaagtggtgcaagcagaaaggggaggcagaagcagtgactcaaagggggagggcacaggagtgctccccagtatcatccctagcctgtgagagagcaagcagtcacactcaactctgtccactcctcaacccccagagcgcctctcaggcacaggagcacgggtccccagaccatctgagcacagcgatccactttttgtattttctagtctcgagctgcaaagaggcgcaaacaacctcttttgcgcgctccgggtaccttttctgggccctgctgggcgcgcggggagggaaggtcagagagtggcaactgcgctagggagggtcatgacaggtcccttgctgaatttggaaggcatttgcaccccagcagtaaaagccccaaattaatggctacgtgaagagctttaaataagacggatggtgagaaatgttacccagctagccctcttctttagtcctcctaggggacgactcccaatttttcattgatttcaccaaatcacagttgcgtcaactaccttgttacgaatcgccggggattttggtaaaatgattctatttggaagcgttggaagttttaaaataataggttaggcaagacatataacagaacatcacgctgagaggtgagccagcccgatattgcttctgcctggttcttggggtgtatcagcctccggcggatttcccggcttctgtgggcgccgccgcacgttgtttgatttgttttgaaggctcagaatttgaggctggtcggagacacccacgtgcttctgattcccatcagtataatgatcgcctcagtttgagtcgtgtctatataaaccacaaaaacctaatcattagaaatcccagcctccaaaaaccacattttaggtaaaaaaacaaaacaaaaaaaaacaaaaaacaaaacaaaaaaaaaaacaaaactgctgccgctccccgcactccttcatctctcaaccacaatcttttggggattccaaaatcgcctccccccataacgccgggaaacaaaaacataaataaataattactgaacttttttttaaactttttatttttaaccccccaaagtggggagtggctagaaagacagttagacactagacttagtctgagacgaagactacacttaataaaagattgggaaatgaatggacaaccgctgtgtattccccctttcccagcaagcattttatcaacttacaacttattttaattaccaagctgtcatctttttattaaaaaagcaacccatccttattctccaataatgacaagaaggaatatataagaaaagtgtccagacatccgttagagtttctaaaactattttgacaaacactcctgtcacccattttggtgtcacctaagggggggcactcccgaagcctgtaaaaacctgccccccgccccaaccaatgtggggtggggttgggggcagggtgaagagtgctcagaagtcaacgtggagacttgagaatttcccttcctcctctcctgaagttaacaacgaaaaattaacgccagtcggagcagcctgaggctctcccgcttctcagctttagcgtcgtcagaccgagaagtggttcccggtcctgagggtgaagtggggagccgaggacgcaggcggcgatgtcctaggcggggacctcctccctacagcttcgggcgccgagcgagcgcagcggcgcttctagcggccggcgggcggcggcagcggctgcgatccgcaggctccagatctgtcgccccgagatccgctctccccccgcccccacttacctcccggcaccttgaaacgcgaggggggcccggggcactttgcaaagagcaggagagacgaggctgcgagctagacggcggcgaaggagagggcgagaggagaagccggggaaaggaaggactcggcggccggaggactcggagcgcgctgccggcgcggggagcgcgcagcggcctcggaggaggaggcggaggaggcggcgcgggcaagcgacggcgccgcgagctgggcagccgcgctctgcttggcggtggcggacagcgaggagccacacgcaccgccgagatggactgctgaacctgcggggctccactaccgtactggaacccgggagcggggcgccagcgcacccaggacacggtgccccaaggggcccctactgcaagctgttaacttcaagtcccttgcggcggctgggccaaacacgcccccgcgtcccgctcgttgcagccaccgccagggactcccaagcctcccggtggagatccgcgcctctcgggtgtccccacccgctaccccgactctgtccggtctccagtcgccggcccccagcagactccgcccggcacacggcttcctcgaacttgatttctcacctcctctgtcccgtcacctccatccttctttccgcccccgtctcgcctccaacccctcgatttcctcctcctcgccccccatttccaccctcctccccctcccccggccacttcgctaacttgtggctgttgtgatgcgtattcctgtagatccgagcaccagccggcgcttnnnnnnnnnnnnnnnnnnnntccagcagcctgcagcccggcaagatgagcgacgtgagcccggtggtggctgcgcagcagcagcaacagcagcagcagcagcagcaacagcagcagcaacaacagcaacagcaacaacagcagcagcagcagcagcagcagcaggaggcggccgcagcagcagcggcggcagcggcggcggcagcagcggcggcggccgcagtgccccgattgaggccgccgcacgacaaccgcaccatggtggagatcatcgcggaccacccggccgaactggtccgcaccgacagtcccaacttcctgtgctccgtgctgccctcgcactggcggtgcaacaagaccctgcccgtggccttcaaggtaagagactggtcacccccagatcctggcccggccccatggaaccttcccgccgtggtctcggtgcccatgggtgtcctccaagactccagccttggtggctccactcaggggaccgaggtggctctgatctacataccccgcagcggccaccgcgagcagatcccccttctcacctgtgcgcccactaccatgtaagcctaggttcccttgcttcttcatccttcagtcttccaggcgcggttcttgcctctttccctgctgtgagactcctgggcccccagacgccccgaggcgcccactgtgagctgcaagcttcctcccgcctccttctcccggggtctcctcactccacacgggcatcccggcctctcctctccgggattctgtgcgctccttcccgctttcccctttgcagacgcaggcctctaccccgaactaggtgtccctttcccggattggttgccgtttggcactcccggctgctccccggcttggcccggttgcctgcagggtgccagcaccggagggcgcttgcgcctggggcgagatgaggtgccaatcgaggagcgtaggttgagagtgctcagtaaacttggggatggacgcgggagagcggggacagacgggacattcgcgccctcctcggccggcactggttcccgttacttggaggaaggcggggccgccggggtttcggcttctatcagggccaggcaggagcagggagttgcgggggttcggggctctgcgcccccgagtgcgggagtgatgagcgtcggggaaggggagcaaggcttaggctgcttccccccccccctcattttgcctgggaggaaaagggaatcctgtggagcaacttcagttggtcagaataaacagaggtgaaaactttatttgccttgaaagagccagaactcccagatgtcccttctgcttggggaaatcgatgggtggctcctgccggaggcctgggctccaaggtgcgtccccgtggcctcctcttccaagtcccgttagcttgccagcaccgatagcggtaggagtcacgcacagctgacagcaggttgaaagtgtgcgggtccccaggccctggccatatctatgatgcagtctggggtttggtggtggtgcggagcacccctcccaccccccatccccggaagagacttggctggatgggtggctgtccattctcctggtccagacgctagggatcagttgggggagccagcgagagagatgcatccagttttagtgggcgagtctgggacccggctctctgttgaacaggttaagaatggtcttgaaaaaaagggagagagaggaaagaaagaaagaaagaaaaaaaaaggcggaattgtgccagttccttcatctcggactctggtgccaaactcccacgggcccctgcatttcccagttgttgatcacccggtaccccacgcagcaattcagattccatgtgtgggtggagcagcaagaggggcccaggtcaattagagcagttatctctttaggtctcctatctgaacagaaatctgaatggattgttttggaaggggggtgcgtggccctgtagtggccagtttccttttgtagttggatcaagcagtggtcctaaacaaacacacgtgtttttcctttttgagagcatccattttggcgattgttttcttccttgtggtgtgaaaaggtcagatataggggaaattgtagaaaatgatatttccattgagagctatcttttacaatgtttatcagccaagggcccagaattttctaagtaccctcagcgagggtagacattattctaacaataaaaaacaaaactttttccaaacctggatgaaaacaggggaaaatacaaataagtagatattttgtataatgcaagggcatacattaaggtgtaaaaaaataactttattaattcaatgtctagtgttctgtgcacccttctggtgctgaatacgctcaggatataattgtcgtgaactgatcatcttaaatggtgcattgatttttgagtacaagtattctgcagggaaaagatttggggatgaagatgcaatgtgattcagtctgacggcttttggatttggaacctggattttctagtttctaaaactattttgaaagtgaatttctccctttgttgttatggcttctaatcagagtgcatttttttctttaaacagtaaacaggccattgatagcatagggcttattacaacatttacatttgtaataaattgagttaaagatcactgagactcaccctaatagtttcatctctctgcttaaaaaaaatatggattatctagaggttcagatttttttgacagtaacttttataattttcatttcaacaatataacaacagccttttcaaaataacttgctttgggaataaacacacgagcatagcgggcttcttatcctctctcaacataatcaaatacatctgtcctaaggaaatgctatgaagaagtcccccctttcaaacatggtaacagcaatttggctatcatatccagagctatgtacaaaataagttatggtattgtcaggtggaaagcagagagctaaatgctcttaaaacaacctcccctgccacccccccccctgccaccgactgagagaaaaaatatcgttgagaaatctagtgttcaaatcaacacaataattattgagcctatattttaggtttgtggcacaaagttcactgcagtcaacaagaaatgaattcagtagcctgttctgatatctgataacttaaaatagtgcttcaccatgatatcgacaatggattatattaaaaagtagagtctattggtattagtattgttcatgtaatataatttggggatttaaaaagagcccttatttcatttgtatttgacacgccaaaaatacaagacagctagtagtcttcatgcaaagttatttattaccattgcacttttaccaaagttctgcagttttgaaacagtcagttcttccaggtgtcaaggaaatggaaatgcatatttttaacatttctttcaggtgtatctcactaaaaccttaaaatagtttaggcctactattcgaggatactaggctctttctgtcacagatgattttagtgccaggacagagcaatttgcaaattcagctcagaagttgatgcttggtttggtagttggactgtatagaacacattgaccctgcatctagtagcgccctttgagttatagggtcctgtcagcatcttcactgtgaagccgggtgttcagggttcataactaagctgccttaaatagcttcaagctgaaacactatgttgacatccagatgtatatcttatgagtcaaagtagtataggcccatatcactgttttaagttagagaacagaagatcatatatattcaccaatatcacattctttctagtaatgttaaagataaactgtgtatttagatacatgatcaaatactcatagttaattttatatttttaatatcatctttcagtgctgatgaggtttttaaatgatgcgattgctatttgagactgacttgttggcagttattggctatttttctttctttaaaagtaagtttgcaacatatacataactgagtgttagtggtttgtatctttcttaagcgtttaatgttcagactttgtatctttaaaaaatctaattatagcttaagaagcgaagacattattaagcttgtcaaatctttattaagcgtaatgcaaactgtttttgaaaaattgtgtcaatcatagtacatcaggttgtatgacgacagggtacttttttgtaaaactcatttaaagggaaatattttggggctgaatacatacatatatatatatacaaatacatatatacacatacatacatacatatatgtgtatacatacatatgtaacttattagtaagttagaatacattttagatagaacatatatatttttaaaactttggaatatttccatttgaggaggtatggtagctctgcctctttgtattttctcctttaacatcaactgctgtgtattttcagagttctgggacagccactgttagatgatctaagctactgtgattcatgacctacagattgctggcttaaactgaaaaacgttttgtcaaattttttgttggacatatatttaaaattttttgagatgacacattgtacctgcttttcttttagaattcaattggttttcctccctcctgagtttaggaagccttcctggatggaattcaaaaaccacactatagtatttgttgaaaatgttctatagtttactttcaaaggatagttttgttttgtctttgcatcttgcaattactgagttgcctttctctttattacaaagaaagatacaatcagattctatcttgcaaataattatatttcattttcctgcacatgcattgtgccaacataaagttgctctgccagagcaattgattagctcagactgaattgctgtcctgggaatgtcatgggcaatgttcaacttccagtatggtgagaccacacgaacaggagtctaagttaagtttgttatcgctccttgttcagagtgaggcccagattcagtcagagtgggactcagacaaaatctcaacatcactagagttaaatattctttaacttcattttgtacaaactgtacagtgtgtggtttaaatgctggctacagtgaggtaagctaaataaagcaaattcttcctcaattctgtgagggcagaacagaaagtgacttctctcttctcttgcttttcttgactttgtaattcttatattttaagaacacctagaaatgtaattattatgagttcattgtgaattattctttgcagaacagtacttcatgttgggtaacattggaaaaaaaatttagttcatgtctagtcttaacagttaaagagtgatttttctctctctctctctctttctctctctctctctctctctctctctctctctccctctccctcttcctcttcctctttctctctcctctctctcctttctttctttctttctttctttctttctttctttctttctttctttcttccttccttccttccttccttctttccttccttctttccttcctcactccctcctcctctttctcccttccttctgcccttccttccttgattccctccttcttttcttccttcatcttccccttctttccttcctccctccctcccttcacctctatttctttctctctcccttccttctttccttcctcactccctcctcctctctttctctcttccttctgccctttccttccctccttctttccttccttcctcttccccttccttccttccttctttccttcctcactccctcctcctctttctcccttccttttgcccttccttccttcatcccctccttcttttcttccttcctcttcccctttcttgtcttcttccctccctcctttcccctttctactctttctttctttctttctttctttctttctttctttctttctttctttctttctcccttccttatgccctccctcccttccttccttccttccttccttccttccttccttccttccttccttctttccttcctcactccctcctcctctcttccttccttccttccttccttccttccttccttccttccttccttccttctgttccctttgatggattaatagtctatattctgattggaatttaattatgcagattgttgcctatgatagcagtagatccttatattgatttagtaggtttaataccatatatgagagagtattaaacatagtctacaagcaaaaataaatttacatagagatgtacaaacagaaatacatctatctatctatctatctatctctatcaattgacagacttacattttgcttatctctagtaacaagaagaaatgtcagtctgtaggtgatgcagccaggagcagcactttgggtacacagctgtagatattttcatcccactgttttgctttgagttaaatataaacagaagtgattagctgagagctaatagggggtgtggttcagatttgaagaggtcagatgtagtttggaagagaatatcagatgaatgggttagtagcaccggcggagttcaggtaggaagcagcagaggttagggctagtctggggctgcatagggaattagagaacagataaaaaccaaggcaccacccaaacaaacaactaaagcaaaacaacagcaaaccacaaacaagctcatttgaggtttatggtaataaatataagatgagggccactaatgggattctgtttttttctaaataccttcccacttttgggtgcctataaagagtactcagaaacttgtttttttccaaagagaaattcagaggggcagaggagttgaggactatatagaggagtagttttagtggtggttcgtggagcccaggctggtacaaggggaaggagacttcagagggagagggaaagtggacagagagcatcagtgagtctggggttccagaggaagatggcatcggcagagctgggatttaagggagacaggaacactggaggtcgcagtcagagtatggtacacgatgctttgattattaagggtttgagtttattgatggtgacagatgagtgcccgtgatgaccaggagaggatgaggattagaccatcagaagaagagagtcagcagaatccagtcagaacgctacaagggtggtgtgttcatactgaaacaccaagactggaaacagccatagctggaccacaggggagtgactgggtgaccccacagtgctttgcactgtcacagtgtcaacagcgacaacaataaaagggtaggatgatctgctgatgagtcagtgaggcatgggtgttcttgggataaggggcagagaaaggctcgcgtgtgacaagcaacagcaagggggtgccagtttcaaccccaggctcagtgcagtggagactgtcaaggcaactgtgtccttgggggacatctcttcagaaaaaggatagtggtattgcatgtcttagggacagcatgaaaggcagggggtccttactgaaggatgtattccagtgaattaatgggaaagtacaggagatggatatagggggtgggtggggggggattggagtgcttgggagcagtctgaccctctagtctgggttcagagtgtctagggggaccctgtgtcccctgatgatgacagagaagcctcattaacgtcagtgtgaggattcactgagctgaggcaggagaaacaggcagcatggtgctggctgtgtaatatacactcgggaccccatagcgaccccaggactccacccccagtgcctttcctccttcagacttctcacttgcttagtgggtgatagcatgctaagatttaacatacgtggctgagttcttcttaattataactggaatcaactgatggctggggagtgctgggtgagaaactgagcctggactccgattctcagaatgagaattggtttctttgtttctttctttgttggtttgagcagactgaagtaacaattctggaaatcactgctgcaagtgatgagaactgccaacatcgtagaggcctggagcttgcagtctacaggaaaccacaacaaggattcttgtctatggtttagctcttccagtgactctctgaatatagctgacaagtacctgtgttggaccaacttcagtagcttcactcagtgaagcccatggatgcatggtacagatagaggccagaagcttggagcagagtgggatggggcagagtgggatggctcacaactctgatgcaggaccctgggcaccagcacgtgctaggcagtggcgacaggcctctgtggatgctttagcttcccacctggattttgatttacttggttggcagctactgacattgagagggactctgtgaacttccagaagaagcagattatagcgcctgatggttttcttaacaggccctctgttggattcagaggcctgcctagggacaaagctgcatttcaagaaaacagttccagtactctttgggaaagccaggtatcacacccactaatgctgaaagcatatttaagcagccacgatgtgccaggcaccgggaattcatatttaaatataacatagcccttgcatgcaagttactggcaaccaaatgaagaccactaggtggttggaagtgccctgggacatatctgggcatcccactgacaagtagccatcagggttttcaaggggaagacagagtatgaactgagacctgcgggggtgtgtgtgggggaacagaaactcagagggctgaagcaggtgtgaggcatagaaggggtgaactttctagagaggaggccttacaaaggccctgttgggagagggccatccctgtgcaggctgggctagaagttggtgactctgacaaggcctgatcatgtgcacagattgtgtgtattactcagcacaccaagtttgctcatgtgtccgtactggggcccacacacttcacaaatctttacccagagcaagggtgctcctgggctctgtgctgtagagttggatgcatcttgctcagtccctgcaggccacacccctccacctgcccacactggacctcttccctgtctcagcagctctttgttgtacacacatgcacccacatgcacacacactcacacatacacacactcacataccactgtgcacacacggtcctctctagtcaccatatgtctctaccctatggcagaatgactgctccaagctgtgactaatgattgcaagttgagatagaaagatggatggatggtcttcacagagggtcctctcttcgcccagccttcgtccacctcgggttggcttaagcatgcttggtttgagttgccgtggtttgagtgtattgcccaaagctcccattttggcaacttaactgtcagcgaagcagtgttagaacctaacaagaagtaactgagtcagtagtgctctgccctggcaattggaccaaggccattattgggggtgtggatacactatgacatgagctaaaaaccacacttagaattttctattctcttttgaattgtctggatggaaatccatctcccaccatggaacaaagcaagaaaaggctgtctaccagatgcacacaacctgaacattggtctttcccaccttcacttaatttttctttgtaatccatccaatcggtaacattctattacaaagtataaaatagactaagagagacacaaaattaagaggtgtaattattccaaatgtccttacaattggttatcatttatcgaatgctggccatgagccaagtcttgggctgctttacatatttagctcatcaaattctcatgggaaacctagggtgtagatactgataacatctctgtttcctggatagggctctgaagtccagagacttgctgacagccatgactcagactcaggtatgcatatcccagtgcaggtaggtactcatttacagcaaccttagtgccctggcccccatcacctctctgacaggcaggaagaagcaacagtgttcagggtccttgaggaactggtatttgaggcagcggtgctgagactctaggcagggccttgtgttgacacacccaggggaggcaggatgaactgatgggtgattttatgtcatacttggcttagtgggatacacatacgtgttgggcagaggttgacatacatttcctaaaagaatgggatattttcgtttttcccaagatcctaagtctcctgtaaaactgccattgtatatgctccaaatccctgcatcccatcctgaggggtgggtggcagagtattccgtgacatccgccccactcagtctcctctccacacctttttcatctcatggctcaccttttctctgaagtgagtctcctgcccactcacatccttgtctgtgtggtgaaagatatgtcactggttgataaacagaaggctcccagagtccccttgtgatggcttagagggccttgtagctccttcctcaggcagagaaacagcctggcaggatatgacaacaatgcccatgccagctcagtccccaaggggtcgcacagtcacagctaggtggctttcaacaaacacatttttggggtctctttcctgttgtagcggaatcgcatgagatattcctagatgctgccaaactaaaagtggcgccactcctggttcctgccaaagcgtccacctattggcatagccaagtcacatccacccatggtgaattcactcagtcactcatcttgtcatcggagatgaaccaagcactagccgggacccctgagacatggggagtgggcaggggtgccttgtctccaagagactggtggttcaaagggaccgatgccaatggaagccctgtggtgggtcagaaggtgagctctcctacttgtgaaagtggagctcaattcctctacagtcagcttgtcactaactcctgggaaaacatttcctttcaaacaaacactattggtaagattcaaaaaccgggtaagaatttgctaatctaaaggcggagtgagtgacttccagcaacgtcctgttggaaagaggttttacccagtccagcgtgcgctcactgagctgccttgcactggagctatcaggagtgatggtggagttcttctccttgcccacagagacatcgtttcaccggtagattagtttatacgtgataagtgttaaatggtcactgagcctaggaccaccaagtactcactgcatgacagaggcagccataagccaggcaagtggctgctactctggtggaccttgcctttccctggggggaaggacagctgcccggagaggtcgctgcttcacacagttggtaaagcaggagctccctgaggaggtgactttgaatggagagtggagggaggggagggagacagctatgcaaatttgtgatgtgttccagactcggtctccagagaaagaagactgctaagcaaaaggagagtcggggcttggtgaggaggagctggagggcaatgactgggcaaagggagcaaaacggggagagctggggccaggggagcagcggagaacagatggtggatgtccaaacgtcgcttctgagagctgtcctccatttcctccagggggatgggaagtcattggaagacctcagagcagagcggacaccatctgattcaggctctgaaaagatcagtccggctgctgggatggagtgaattgcaaggtgcaagggcagaagcagaagagccaatcaggatgcagtttccatatcctagaggagagatgaaggtggccagaaccaggcaaacttggtcaaggtgttaaagggtctcgggctgtggacgtctttgctggatggagctgagagtttgctgatgggttgggcatgaagcataggaaacagaaaagtcaaggtgaagctgaggtttggggctgcagcacaggctgggctgagtgtcacttagcaaccccttccttctagtctcatgagaagaactcccctccccctttctcactgtggtcagtgagacagcatgggggtgggaatggcagccttggagttccaacctaggcctggggacatcaggcattctctgttgtcaccccctagcccccaagtgtctgattgttaccaagagaagaatgtgccctatgtctagaggcacaatagaaaggtacagacatctaggggacatgagaagagagatgggagccccctctacccccactctggagttcagttgaggtctttgccttagcagagcagaacctcagcataatcaacaactggggccttttcctctgtcttagccacaaacccactcttgcttctgtatatctcatcagagacccattttcagggaaattatatacttaatctctcctaggttactttactaaattataactctacccaatgcatttctgaagccacctcagccatttcttctgtcaaaaggtggaggggaggatttttagcaaccttttgagatgtactccaggagtccccagaagtgattatatggccaatgttaacactattcattgcttaatctttcccaaacttgggtagtcttgatttttgcctgtgctctcaggaagtgaacacctttgctgaggtgtggttttctttctgagggcctttctctcccgtagtggtcatgcttaaagcctgtattgaactatctttgataaagctgctaaccctgccttactgaactggctaatcctgaaactctttagtgttaaagcaacagaccccagtagaggctgagccaaggtctccccaaatccaagcagacctctcaggctgttgagggtggcagtgtggatctgtgtcttggttcctcaacactgtcacccactgctatccaccatgggcctagactctccaccctgacttgtaaacatgggataaatgtccattgcagaggactgagtcgggtcggatatgacaatagcggacagatagacagatgggttgattcggacatcattatcaaagatgagttctgcccatgtttgggtagttgaggaagtcaccctggatgaaataaaggtagaaagctgagtctagaagaacacattagtcatccttttttagaggtggagaaagccagttgagggcatggaggaaacagagagaggcatacaaacttgacacaggaatcttcatgtgaatctagatgagacagaaggctaatgtggagaagcaaacaggaattggatcacagagcagtcttattccccccgcaggtagcatggaagcagaaggagcaccaggtcatggtggtaaggatataggagaatgagtggaaacatttatgttctgaaaatcaaaggacaaacaatgagagctcagggcataacacagcggggacatcagacgggaagggatttcctaaccatgatatctgatatgagtacaaatgattttcttttctcacaaatgcatttttatgttagtaaatacatcagtggtataactagaaaaaatgtttttttggggtgtgttacagtttttaggccccgcctgtttggctttgggatgcctgtactgaacacctgtcccagtggagatggggacccgtctgctgctttcctagccgagccacagctgtttgcgccttgaatttgacaatcttgagacttatttatttttttctttcaggtgaattgaaagaaaattcaaggtcagagcaaacatggcctatgcatcatacaccaacggtatcttgtgaaaatggctcaggcaggcactaatttgaacttggcatcaccaggtaacagccttagagactgttaatgttgtgactcccctgattatagattcagagtaaggaatgtgtgtgaagagccattaggtgctgtatatgtataggagcacatttgaaaattgcttgtgattgccgggaacgctattgattaagaaggactaatagcgaagtggcaaagctgcgattagaaagcttgggaccctccgatgacaaaacagagagcaaaaatcaagttagccaaagcagggtttgtgactccctgaggaagggccatgctgtgtctcctgggcgtctgctccctctgttccacagtccttgccacttctaagcatcccacccttcttacaagttcccaaaagatacttctaggatgtctgccctgcatccttggagaaacccagtgtttgatgccctgggctcctgcagcattctctcctttgcatttaaataactctgcactagtgcttgcattctgttagacacgcttcaaatcaaacttatccctttgtatgttccagttcaggactgacactccacaggagctgtaaaacgtacagattgatttaacatatgcgatctggcttaagaatcctcttgtgggggctagagggatggttcaaaggtcaagagaactggctgttcttgcagaggacccggtttgatttccagcacccatatggcagatcacaactgtctgtgattccacaccacagtatgtgacttgatgcccaggcttcatgctagcaaaatattcattcacatgagagagagtgagagagagagagggagtgggggaggaaagagatgagagatgagaaagaggagagagagaaagggagggagggagagagagagggacacatttggtataatacttaaaatagagctgtctgttaaaagcaattaattatcctgagcatagacagatataaaaactttctaaaagttacacacacacacacacacacacacacacacagagccctgattggccagtttaccaaccacagattcatctacccagatgtcagaatctaaaaggccttattatgcctcaacaccctcactaatgtaggcctcttctcagaagccaaaccctctccgggcctacctatgatcagatcctgagcatactctatgtacacacatacactcatattgtgctcagggtgtacacacacagacacacacagacacactcactcctcaggtccctgagcacagtgtgtacacacagacacacacaaatgcacacgcacacacactcactcctcaggtccctgagcacagtgtttacacacacacacacacacacacacacacacacacacacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtatacacacacacaaatgcacacacacacactcactcctcaggtccctgagcacagtgtatacacacacacacacacacacacacacacacactcctcaggtccctaagcacagtgtgtccacacacacacacacacacacacttacacacacatacactcactcctcaggtgtctgagcacagtgtgtacacacacacacacaaatgcacacacacatacacacacacatacactcacttctcaggtccctgagcacagtgtgtacacacacatacacacacacacatgttcacacacacactcctcaggtccctgagcacgatgtgtacacacacacataaatacacacacacacactcactcctctgatccctgtgcactgtgtgttcatatacactcactcctcatgcttaccctctgttacccatctgtcaaactccttgggaagaagagcactctgggaagcctctgctcacaatgtatcgtcctgtgagcatctccatactctccagcctcttcccttgcttcccttcctttgatggagcccagatctcgtgctctctgcatcttcagtccctagtacaggacttggcacaaagtgggcaactaccctttgcaggtagatttttaactagtgtgtttgcttctctataaaataggaataatagtttctgcttacatttcagttaagacattggctatagtttgtccagcattcttggtcttttccacacagtttaaatagctgtgtgtgtgtgtcgttgttgctgttgttgtttatggtagtgttctacagaaatcagtaacagacaggcttgaagccttgggtgctactgagggattatgtcgtcaaagagcctggccttcagatcgagaagagtaagatgctgagcaatagaaggactcagccagggtcacatgatgttcttctcctgggacattgtctcccctgtctataccttacccttacgactgccctgaagcctcttttatggcactatcacttgtgacatgtgacatggcttgggagaatttgatcaagctgtttaattccccggagtaataagagcacagctgccatgtgaccacttggccaagcttgtagggcggcgcatgtggcatgtgcgagggaagagcagccccaacacggcttcaagtctgatttgcaaatgtgtctgcataggggagatactatttaaaggaatcagttctggctcctgatgtttgcagcctaatttgaatttcttttctattcttgcacattttctggagctcctttgcacgttgatggtaaagtatgctttaagcccacaaaacaccaagtttccaatgcgccgtgccaaagtgttgagtggacgttttggaaaatcaacttaaaacacaataatcacctgacaagagatgctattcccagaaaaatttagtctagcagtcttaagtgtgatgggaaagggaccacatggtgtgccaggaaagctttagggcggtcttaacaggcaagctctgaaccccgtcatgaaggaggttggtggtcataagctgatagcccaagaagggactgcaggctttcacatgtcaggttcaagcaagtgctttgagtaaaagggagagagaggtgaaagaaagggggaaggaggaaggaagaagggaagggagagagtaggcaacagagaggctcttcaaaccacttgttattagtaattagcacactttcccaggagtctgggaagcagctgaccactgttcatttcatactgtgtccgtgggggtggggtggaaagatcagggtgatgtggtacatggtcataccgcccagcatttggcagcctttttctgtttgtatctctataattcttagatcactgtccttttaggggagtataaatgtcgttagcttttatcagttttctacatcttccatcacttctctactatgacttgagctcatggccccacctcctaaccagtagcagtggggaggagagtgcagacagaggcactgcatctgcagtggggaggagagtgcagacagaggcactgcatctgcagtggggaagagcatgcagacagaggtactgcatctgcagtgaggaggagagtgcaaacagaggcactgcagctgcagtggggaggagagtgcagatggaggcactgcagctgcagtggggaggagagtgcagatggagacactgcagctgcagtggggaggagagtgcagatggaggcactgcagctgcagtggggaagagagtgcaggcagaggcactgcatttgcagtggggaggagagtgcagacagaggcactgcatctgcagtggagaggagagtgcagacagaggtactgcagctgcagtgaggaggagagtgcaggtggatgcactgcagctgcagtggggaggagagtgcagatggaggcacagtatctgcagtggggaggagagtgcaggcagaggtactgtatcaatactgtactcagaaaatggaaatgtgaactcccctttggccgggctttgaaaggaacctctgctaggattttgaggcatgcttattttagggtatactgtgtttgggtgaatgatctgtaccttaggcactaatcacacggtttgtaagtaaaatggataaaaaggaaaggcgtttagttcatcaatgtcaaagagatttctggctcactccatctgagtgacagagcttttgcttttcagtcaactacagttctctgattgcttgattggcatcaagtggactcttgttcccagggactgcagtggaatttaccgacttctcacaactcacagactacacaagaacatggcttcttagccggatggagtcccaaatccaaaaatcacaataaaactgaattaaacactgaaaaccaacctaaataaaatgtactgtttaaagcttgtctctgggaactccctactggagtaagctaggtggacaaatgcatgctcctctccctgccaccttcttgcactgagcctttctcaggtgtccctctttcagaggcttgagcctgcctcagtccctgccggaccgtcgcagacttgattttattgaaggtgatcgtgaagttcctagaaaccaatgtctaatgagtggcagcctaacaggaaggggtgagtggcaaagttatggcactcagagaaaaggacaggattgcacattgtttattcattccatcacaactgcataaagacaaacttacatgtagaaaattagcgccatcacaccatcaccgtccccaccatcaccactgccaccaccatcaccaccaccaccatcaccaccatcaacatcaccaccatcaccaccattagcatcaccaccatcatcaccatcgccccaccaccaacaggactatcagcagcaggagcagcagcaccattatcagcaccactgggtctctcaacttggtaattggtaaaaaacccaaattcctagcagtgaaattgtgaagggatggatgcaattcccccacctaagggggatactatactagggaaaatagcaccagaagcacttactgtccatataaaaggaagctcgattggactgaagactcacacacgactgttgggtctatgaaattatgaaggcaaggggagagcacgtaggactttagaggcagaggaaagatatcttttccaagaagactacaccttcaaactagtccaaaaccaagggtttacaaaagcttcgtagacacatttgacggagtttaggtctcagactgtgttaccctgagtagtcagagtcaggaaggtttctctcactcttgcccacctgtttatgttgagagctggttagaaaggaaatttctgactgaagtctcctgcctcagagccaagggaagagttgtggtggacagagaggctgaaggattctggacagaccttgctgggccgcctctcctcagccggatgctgacaggtcagtgttttctctccaggccacatgtctctacatgccacagagtctaaccatcaaaacagacggtcattccccagtacccatcatggtaagtccttgattgataagcagtggtctgccactaaaacgaaatctgtgacagtgcaatgccgggaactggggcagagaggggtgtccctgagaagacatgaaagaggaggtgggaaaggatggctgtctgacatccctcgtgggagggagttcccacgagcagacttgggcagcaaatgaaagccttcctcactgcatcagaggacaaggttcttaagcggatagcaagtgctcacatcctgcacaccgagatgctctgatgtgactgctccatgggagaagaacaaataggaacttatttttaaagactctcctgtccacaaaacattaaagactaaatttgccatgctttgtttttgttaatatggcctcttttcttttcttttcttttcttttcttttcttttcttttcttttcttttctcttcttttccggggatgtcatccatgatccttgtggtggacccaaatgatgcaccccattttcatccctgcagacagctgtcaggctgggagaaggtgctttcagggctgagacaggcaaggagctgtctgctgagcacagagatgaacaaagcaaaggcgtcagcagcagacactgtcctagacagtggatagaagacgagagtggggttcacccacggaaacatcgacctccccctccccgccccctgccccagtctgtgctctcacaaggatcgcaccatgtcaagggagggagtaagaaagccacagtcttatttcataatcccctgcatataatttacaaacacatgagtcactatgtttttctgtggtcttcataagctccacaacggcagaggtgacaatattttgatgattgcagactccagaactttgggaacgtagtagatacaagaaatgcttttctcaaatgaatgcgactgtagacgccctgactctgtgaatacccaggagcagggcttcgtggggaagagcagagagagaaaagggatgggaatagaggaagaggggcagcaagcacactgcacctctttgttatcggccatcagaataatttagattcttgcacttggggtaagagggaagtctagaaagaaagatatcaaaatatgtatcattatatggtaggattcattctgactctttgttccaactaccttttggtagcttaagaaaactctataatgaatagtgttttgttttcattatctccaagttcaaactagaaaatgactttctcacacttgggagagttaatggctttgggccaagtttctttgtactgcttctgtgatctgcccctctcaccttgaccattcttctgctcctaaatgccacacgcacatgcacaacacacacacatgcatatacatatacacaccacacacatgaacatatacacacataccaccatctcccaacagagtaagctgccccaccaagtcaaccctaacacaacttcactttagggtttggggtgctgtgctcattttcacgactcttggaagaatgcccatgtctcccaccagacaataccgtcatggctttatctctgccctgagcctgcagcttgcacaccacactctagcatcacatgccgaggtttcagagagttcggtagctcgaggtcatctgtgaggctgggtcctgcctcttccccacccagcacgtagacttttatatacaatgtaaacacgaatctactgctaataaaacacccatctccgtgctaatagtctgtgcagctaagatgatcaatctgatcaatttgcacagccttgtaaccttttcttctcagagagaagtgtgcatccatttgatttaatttgtggtacttctcactggctaatttccttgaacaaccctccccattttctttagatctctgatatttcagactgacagttacacttctgtgggaaatcattttttatgtggttggtgtgtgtgtgtgtgtgtgtgtgtggtatggtgtgtgtgtatggtgtgtgtgtgtgtgtgtggtatgtgtatatgtgtgtggtggtggtgtgtatgtatgtgtgttgaagacacttttcatggagatatttttcaaaaaatgatactgtgtgtgtttggtcaggcttgccctcttctgtctccnnnnnnnnnnnnnnnnnnnnatggagctcaaatatacagcctggatttttttttttttctcgttcctgtgaagatctgctaagggggtgggaagcgtagctagactccaggagaccctctaaaaagcagaggtgctgaaacgtaagctgtgttcatggaggggcaagctgtggtgctgatcccagaaaccagaagggagtctccatcagccgtgcccgttgtgttgaggctccctgtagatggtcttatgttcctacattctccatctcgtccgacccgccttgaccctgagaattcagcagggataaattccctcagttcgtttacttgagggcacatctgttgggcaactgatagatgtcaggattttctggagattacatggggcgtggggtataaagttcttacagactgatgatcatgaggtagacatctcagagtaagaggaactgtttagtcgaggaagtgagcacctactggacaaatatgaaaaggaacgtttgggggacgctgacaatcgcatggctagtaggagatgagacttaggtcattctgactacagaatgtttttactctctgcacctacgaaatgaaccatggctgtcctgtgccctccccacaccctcctgagtgtggtggcctgcctagttagtcctcctcaaatcaccgaacctgcattctctcctgtacactgacaaaccgagaagacaaacctagcacaaacctagaagagcggcagtttctaactttaggtgccacttgcgaacagttgtcattaaagacacgctgattggctgacttcctgtgacgtcacctcattagcgcatgctctttagaactgttctttgggctgctcagagagtaaaatggagaaagaccgtgaccaaaagcagagttatctttttcttgtttcccacaataagctagtcccctgatcttgctctcaaggacaggagcctagagcactcccccagagtggactgccaacagaaaagcactttcagtctatgctggcacagggggccacatctgcctgtgtttagggagggtcgcactcatcagcacactgatggaccgacccgagatcttactgtcctgtgctcaggctgtgccatcctcagatgttcttgcacagggctagcatgttgcatcggatccccaggggtattggggactagataaaagcaagtactttgagaacttttatttttttttttttttttttttgccagattctcttccacacataccccaaccgcaataaacaccttcctttttaacacctgcagccttcacagcttcaaaacatattttcccaatggaaagcgaagcagtctgctgtttcctgcatattaagcagacatctgtttatactaccagccagtctcaaggaaattctgttttcctagggtgttggcttatatgatttagaaatccagtgcgtctgagaaattgattcaaacgctggaggcttactcagctcttctcacaggctctggccaggctgggcctttacttcctgcctccttggctccacaagtcagatgtcctctgggttctcagcctcaggagaccaagatgcctccaccctcctccttctccttcttgtgccctctcagaagttttccagcagattccagacgatcagctcagcatctttaccttccccaaagggcttgccctgcaccacggcaggtggcaaatcggtccgatttatcattatttgcatttttaatttgaggtattttaggcccagggagtttttttttttttaaatgggtctctcgaaccgacagcacaaacatcgatacataattcatcatccgttccttcataatccgtgtggttaaggatctgccgatgcacagaaaggtcatagcactccagacaaagatgaaggtacggttggctctccttgcctcctcctctcccctcccaagcttcaggctgcagtgcacaggctgctcgcgagctggcactgtaccagaacggtgcaagcctcctcagtgccgggcgcctctgcccatcttcaggatagccaaacgctaagcagcagatacactgacagacttcttccttccctgacagaggcacatggatgcttcaaaatggtagcatagtgtggaggaacatatgacagattctggtgtcccaaaccacctcccttcagctccccattgctcctcaccccttcaggcaatactctctccaagtccaactttaagtaaagccaggaaaacacacatgttcacgcacacacacacacacacacacacacacacacacacacacacacactttgccttccacacaccacacagcatagcatgtaatcagtccccagttatttagcatatgggcttcattccttcactgccctggctggttagtttttatcagcatgacacaaatgggaaaagctgggaagacagaaacctcagctgaagagttgtgtccttcagcttgacatgtctggaggacattttctagactgatgattggtgtgggagggtccagcccactgtgagtggcagcatccatcctgggctgaataagaaaggcagctaagcaagccagggagaggaagccagaagcaacattcccctgtggtctctgctttagatactgactcgggttcctgcctggagttcctgtcttggcttcccctcagagatagactgtgaccagtcaggggacacaagcccttttgcctgaacccctttctcctcagattgctttgggtcatagtgtttatctcaggaacagaaagtaaactagaataaccaccaagctggcagccttctttagaattttcccaatttcccaaatgatgcacatgaaatgcctccattcaatacctgcacacgtgtgatgaggttaagccacacaccaagtcacactcgcctcggtagccgcaatggttttcctttggggaactccttcattcttttcatcaagtgtttcaaaaatgcccactgatttactaggttccatcggaagcaccaggaaggctctagtgatcacatcacattttaacaccttcctagacccaagacaatttgacctaagacagtccttgagtggctatataattacccaccaaaataatggcttgaatctgacttcagctacaacttaactgagaccttgacattggttatgcttcttattaatggctatacttaattttgctaataaattatgatgactccaaaaacaacagcccaggcaaactggcttcaggcttgttatggataatgcttcctgcccaggaatagttgctctagaatgtttgaaatgacacagagggcgacatctgacatatttccagagatcctttggtatctctgtaattgacagcatctggtcatactcataacgtggctacctagatggcaacatgtagtcccttgaaaacagaacagcctcatcgagcactttgtagaacatgtccacgtgttctttagcctcttgttgcaatctgacttcctgaaaagctgctctcagaaattcacaacactgggatgcccatgcagagatccttgaatgagtagtaatttctaagggattggttgggttggtttatagtgaaccgtttattcacatcctaaaattatctcagctccctaggaaggtgttaatagccaacaaatgtccttaagctagttctcactccgagtgaatcaattcttggtagaaaatatttctcaccacgtgtgtagtcttcttaattgtccacaattctcataatttacgtttgacctcgaatattctacttgctttccaaagatgctttccaaagcctcccagatttagagatggtggatactgaagtataacagaccttcagattttactaatggaaaccgatgtctcagaggggtttccaaatgtcaatctagcatcgttttatttaggctggctcactttcaggtgggagaaaatcggagaaccacacaaccatccggatgacctggcccaataacattttctctttttgcctgctcttcccccagcccctcccgctttggccagaccctgtgtctgattgaactgggttagccattcctgccacacagcacgtgcagatccacctgaactctgggcaacaagcaaaactccactgtcattggctgggacatccttggcctcaggagacgaggttactatactagacagaccaggaaagaagcaacagctgtttcctgggagctcctatggggctgttctgcacctccacctaaatgaagccgggaacaatacagggatcttggaagtagctcgggttcagtgggcggggctgagctggagcagacagactaaactaaacataatcacaggtctcctttctcacagcctgtggccttgcaccctcctattagccaagctcagctacccacccgccccaccccagcttgtggggcaagcttctcccgagagacaagcatctgtggtctcatattatataaccgaattacctctgtatctagacccagcttgcatcctcaaattcatcttactttcctgtcaaacaaatttccacatctccgtcattaccgtagtcccttaaccacatttttttttttttaagtgggccttcatttcctacaggataacgttcgaagtgctcagattggtgagcagagtcctctgggctctgctacccccgcctcccactcatccccacatcccaggaagctgtgttgtagtcacacagagctacttctctgtcccctccctaccttgggctgttgtgggtctccacttcacctgtctcatcgatcgaggcccaacccaaccctatctgagctccttctttgaatcctgcctgagcagcttggccaaaggcccccttgctgtgaggcaggactcaccattgaacccatgcagggacacgttctacacagaacattgtctggacaataaattattcacttgtaggtaacatctgatcaccagctctgtgtgagacaccatttcttattttcagggtatccagcacacagcagtttcttagcaagtgtcaggatgagaaatgcctgagtctagctgtggtttctcctctcccggccaaacccccggccacaccccggtcacacccccttcactccttagctggaaggattaaacaagggcaccaggaggcactggctgcttccttagttgtgtgctttcagctctgtgctatcatgcaaaatgggggtgttgtgtccttgacacatggttgttgagattaaataagatctcacaggtaagccaggtgagtaattggcaggcggcaagtacctaatcaatgtttgctcttcttactaaacatcctgtcaagagagattcattcttacacctgggcccggtcttctctttcagagcaaatgtcagttgacagagaaagcaaaagtactctccaggaatagcccttgggtggggtgggtgggtctccagactttggagctggcttggtaaatcaaggtattttcaggctgcctggattctggaacaaccctgagccttattcactggcatttgagttggcaaattcaaccctgtttaagaagagtttggtttggtcttttgtgagcctctgccacagccaactgacagaacaatagcaacaggtcactgggtctaagaaagactggccttgcctggtatgggacccctagtcctggaaagactcgggcaggagaattagaagtttgagtcaagcttggaatacatagcaagatcctatctcaaaaaaaaatttttttttgaaaagccaaacttcttttcgtggtcattctgaagtcgactgtacgaccagcaatccagaatgtgaatgtggtagtcagagccacccaatcaaacagtagcactaacctaagtcccagaccggaagtaacctcaggttgctgggttttggaactttcagtttctagggtccacagccaagtctctgatagctcttctctttctcttgcctcttccttcgctaaccttacgtagtttaaaacatcccagttctaggctgctttcccccaggtctacacacgacaaattatcgcgatccactcttcccctacggtgaaccccaaagacaagagccccaagtctctcactctgcctttgataggcgcacaacccattttgctctttggtacacgcggaagggcccctgggccacctgctcgcaggatggcgagtggagggttaccttaaattcagtctcaatgttggccagtcgggctaactcgttgcttagctccagcgcagtgaggacagggtcttcactggatagggacaggtaggcggcactggccagtcctttgtaggcattcatccgggagcgcgagtgactgaaggagtccttgcgctgcttctccgtgcactcattgcacttgcagaagtagtcatggggccgctcaatgcgcgcacccttgagcagcaagatatgcacaatctcatactcctggcagtgggccgccaggatgatgggtgtgatgtcgtgggagaagcgcgtgccatcctcgtcgtaggcatagaagtcatcatcccgcagctcctgctccagcgggctgagcgtcaggcgctggccctgcgcgaaggccggatggctgaggatggcctccacaatgcgcacatagcccttgctgatggccagcagcagcgcgtcgcccacccgcgccaagttctctttcttcagcaacagttcagtgacctccaagtgctcgttgcccacggccagctgcagcgcgttctgccccatgtagtccacgcagttgaaattgagggtcttggattcctccagcatttttctgaccactggtatgttgccatactcagccgagtccaggaagcgctcctcctcaggggtcaggctcgtgcccttctcgttgaacatgtaggcaggaccccggatggcctggcggcgccccttctccctcaaggtggtgtgccggcgctgcatgtttttgaaggtgttgctccccaacctgaaggacaatggcaaagatgatttgtaacttttctagggacctggggactgttcagaaggacaaagaaaatctgacatataagaatatcacgattgggatcctgccagacattgtcaagtctagctagaccatctgaaatactgtttttttgtttgtttgttttgctattattgttttgtgttttttgtttgtttgttttttgttttcaattgggagaatgctgacttactgtctgctgtccctgaggttagaggggtggagcagagcagaaaagcagcttgagttgccctgtaccagtggagggaatggggtagggctgcgggggaaacgggcaagtggggacgttttatttctttctgtgtcagactgagcaggtcccccaacctctctgcattcttgctttcttagccctataacgatgcacagagttttttgtttgtgtgtgtgtgtgttgtgtgtgtgtgtgttccacagtgtgggttcaaggggcaggtagaggctagagctactcaatgttagtttatctctcccttcctgtccaatgcctatgcccagtctccatggaggatacagtagaacctttggttcccacgtctccccctctactgagttctgacactctggtcccactgtactaggctataagcatggccacacagtactgatcctacagttggtgccattctgtatgtgggtcatgtcccctgggcctcaggcaaatccggcacctactcaaatcaagatgtggccaggaacaggactgcctcttacagagactcctaggggagtcatcttcatctccctatgactagatccagaaaacctgtattctgtcttctcggtagaagacatagcccagctcacatgctgtgcatacttctaacttgttacttttccccttgtggcacagagaagttactactgatcgactaacagcaacagttagcatttacgagaccctgcagtgtcccaggtgctatgctaagagctctgggttcgccagcttgtgcaggtcctctgtaaaaccaacagagaaggaattttatcctcacctgtgctgatagaagagcactggttaccagcccttgaaagccacatggctctggcagtcttgaggtttcttggctttgccaagtcacctaagggtttgccaaggatttgttgttgggggtggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgaattcccttttcctgtcttctctcacccatgctatctgaatgattcaggatggcacagtcttaacccagagagcacctgcttccccggtaagaaccgagaagctcattttaagtctttcccattgtcccagagaactgtcttgctgttcctgattgtgtttgtggcctaccaagtgcctggcacttctctcaaaccgattaaagaaataagctgcaccaataattcacactagagctttcacgtcgaccctggagtttgcgactgtgtagactttggaattctgaactggtgctttcatgctcacttaacctttgacctgacccagctcctcagggtccagcccctgctgtagatcattggaggtcagacctgggtactctaaatcctgcctggagctgagtcacacttcccttgggaaagccccgtatggcaaggtggagtggctccttcttctgcaaaaactaaatgcaggtgtcatgggaaccccctccaagccagctccaggtaataaatcctgacagtaagccctgccgatataaaccgccacctattctaaagcgcgccttgatagaagattgcaggggagagcttccagttcaagttcccaggcctctgagccctttctccccagagggttgtcatttcaccaagaggctgctccctcccacacaaggcagatcctagatggggatcccatggcaatggttccccagttgagggaggcccaaacagtgcaggttcattagtaggcacttctgaagggggtagaagccagccccctcattggtcttccccctccccctcattccggagcttgagtgaacctgctttccaggcctgtcatctgggcacacaaagacaccgaaattgtggaaattgaaaccacagaagaat

SEQ ID NO: 1574 - DNA, 1581 bp, Mus musculus
atggtggagatcatcgcggaccacccggccgaactggtccgcaccgacagtcccaacttcctgtgctccgtgctgccctcgcactggcggtgcaacaagaccctgcccgtggccttcaaggtaagagactggtcacccccagatcctggcccggccccatggaaccttcccgccgtggtctcggtgcccatgggtgtcctccaagactccagccttggtggctccactcaggggaccgaggtggctctgatctacataccccgcagcggccaccgcgagcagatcccccttctcacctgtgcgcccactaccatacgccccgaggcgcccactgtgagctgcaagcttcctcccgcctccttctcccggggtctcctcactccacacgggcatcccggcctctcctctccgggattctgtgcgctccttcccgctttcccctttgcagacgcaggcctctaccccgaactaggtgtccctttcccggattggttgccgtttggcactcccggctgctccccggcttggcccggttgcctgcagggtgccagcaccggagggcgcttgcgcctggggcgagatgaggtgccaatcgaggagcgtaggttgagagtgctcagtaaacttggggatggacgcgggagagcggggacagacgggacattcgcgccctcctcggccggcactggttcccgttacttggaggaaggcggggccgccggggtttcggcttctatcagggccaggcaggagcagggagttgcgggggttcggggctctgcgcccccgagtgcgggagtgatgagcgtcggggaaggggagcaaggcttaggctgcttccccccccccctcattttgcctgggaggaaaagggaatcctgtggagcaacttcagttgcggaatcgcatgagatattcctagatgctgccaaactaaaagtggcgccactcctggttcctgccaaagcgtccacctattggcatagccaagtcacatccacccatggtgaattcactcagtcactcatcttgtcatcggagatgaaccaagcactagccgggacccctgagacatggggagtgggcaggggtgccttgtctccaagagactggtggttcaaagggaccgatgccaatggaagccctgtggtgggtcagaaggtagcatggaagcagaaggagcaccaggtcatggtggccacatgtctctacatgccacagagtctaaccatcaaaacagacggtcattccccagtacccatcatgacagctgtcaggctgggagaaggtgctttcagggctgagacaggcaaggagctgtctgctgagcacagagatgaacaaagcaaaggcgtcagcagcagacactgtcctagacagtggatagaagacgagagtggggttcacccacggaaacatcgacctccccctccccgccccctgccccagtctgtgctctcacaaggatcgcaccatgtcaagggagggaggtttggggtgctgtgctcattttcacgactcttggaagaatgcccatgtctcccaccagacaataccgtcatggctttatctctgccctga

SEQ ID NO: 1575 - protein, 526 aa, Mus musculus
MVEIIADHPAELVRTDSPNFLCSVLPSHWRCNKTLPVAFKVRDWSPPDPGPAPWNLPAVVSVPMGVLQDSSLGGSTQGTEVALIYIPRSGHREQIPLLTCAPTTIRPEAPTVSCKLPPASFSRGLLTPHGHPGLSSPGFCALLPAFPFADAGLYPELGVPFPDWLPFGTPGCSPAWPGCLQGASTGGRLRLGRDEVPIEERRLRVLSKLGDGRGRAGTDGTFAPSSAGTGSRYLEEGGAAGVSASIRARQEQGVAGVRGSAPPSAGVMSVGEGEQGLGCFPPPLILPGRKRESCGATSVAESHEIFLDAAKLKVAPLLVPAKASTYWHSQVTSTHGEFTQSLILSSEMNQALAGTPETWGVGRGALSPRDWWFKGTDANGSPVVGQKVAWKQKEHQVMVATCLYMPQSLTIKTDGHSPVPIMTAVRLGEGAFRAETGKELSAEHRDEQSKGVSSRHCPRQWIEDESGVHPRKHRPPPPRPLPQSVLSQGSHHVKGGRFGVLCSFSRLLEECPCLPPDNTVMALSLP

SEQ ID NO: 1576 - DNA, 144723 bp, Homo sapiens
ggcaaagatgtgaattcagagaaaaataactgcattgacaaaggaaagaatactggccaaataacctttttttaaaaaaacagtttttttcctacttttttttttttactctggtaaaagtttaccttcatagtggcactggtgggaactgccccttttattgttatttatttacttatttctgagacggagtctcgctctgtcatccaggctgtagtgcagtggcacaatctcggcttaccgcaacctccgcctccaagattcaagtgattctcctgcctcagcctccctgagtagctgggactacaggtgtgtgccaccacactcggctgatttttgtattttattttaggtagaggcggggtttcaccatgttggccaggctggtttcaaactcctggcctcaagtgatcagcccaccttggcctcccaaagtgctgggattacaggcgtgagccactaggcctggcgggaactgcctcttttaaactcttgtaaagatttgataatggaatctattttatttactaaaggagaatctaattaatttaacatcaaagatacacttatgggaatgaaagaaaataagccccaagtgtaatgtgtttgcaatgtatttaaataaaatcaaagacaattctaaaacagacggaaacaacaaaacaggaatgtctacttctttaaaattacatagtaataagcagataatccatatttttgttgttaaagagtgataaccaggtaagcacaggacacacacacacaatcacccttacatagtgaaggtcaaaattctgttatatctgctatcaatacttcaagtagatacagaaagttaaaagatacattctttttttttttttttttttttttttttgagacagcctgttgcccaggctggagtgcagtggagtgatcttggctcactgcaacatttgcctcctgggttcaagtgattctcctgcctcagcctcctgagtagctgggattacaggtacacgctaccacacctggctaatttttgtatttttagtagagatgggttttcatcatgttggtcaggctggtcttgaacttctgaccttgtgatccgccagccttggcctcccaaagtactgggattacaggcatgagccaccagagcttggcctaaaagatacattcttttgtggaagaatatgcagtgattgcaatttgtacttatatttaataacatattaaaaaaataaagatgctcgtaatgaagcaaggaagcctgaaatcactcggtaagttctcaatacccacagacctagggctgggccaggatgagatgaaatgatggaggccctagctagccttaggggcaaaacttaagggagttccaaacaaaccctagtattcaagatatgattttaatggaatattctgaaaaatgaaattgaataccaataaatacatgataaacaaaatatcaaagtattaaataatgaggggatccactcccacacctgcataactcttctgcttcatcttaatgaggactcaagaggagtgaagagtcatgcccagagaaactttcattcaactctcctttttagatgaaggaaggtaatgggctgtaatagcgaggaaaagaccaagattgtggcttctagaagcaacatgaatattctccctcttgtaaatgtgcacaaaagtgggaatcatggtaccaaggccctctttggcttggctgcttgtagccaagccaacttcacttctccactatattacaatattcccttctagacagaacggtccctttaatgttccaacacatttttttcccactttgatttagctcagtattttctaaaaatacttcaaagacctttaaattcctttagaagcaataattaaataagtttgtaaatgctgtatttacaaacttgtaagtccgtctagtggagattcaaaatgcatgtagcatattaaaatctgggataaaattgacaatatgaagtctgtttatcttgtttaatacagcgttttcccaattttattttatcatagagtcacagcactacccagtctctgacttcaactgcaataaggcagcaatcgtctagccctgctccctttctttccttggtggtagtagcattttgcttttctgattctgtaaggtatctctccaccttcccagatcctggctttttttttttttttttttttttttttttatcagatctagtgataaggcagctctggaatttttgcccaggattttgtttatgtgtattttagtttcagtatggacataagatcatgggatttcatggaagatgtcaggacgactgtgggaagaaacactgaccaattttagcctgtgctttaaaatagccatatctatactctctgtctacatcttcttctctttaaaatatatgtcctctaattataggcttataattaggaagagataaatcatttaatagatgtgatatggtgttggaaatcctcatcttataattaccccagtggagtgatccaaaatggaaaccactatgaataggcatgtcttggggatcagaaaatggaaaccttagcatatcagtctaagtccaatgaggacagagaaaccatatagtaatttgaataagaaaagtttaatgtgaagaattattgactataacagaggattggagaaacaaggaattggctaggaagaactaaaaataactctaaagaatacaggaataacagcatccactaccctcagggctgaaatacagcaaccaagtaagagtcctcccctcttctcaaccaaggctgaatccagaccctgcacagccttggctccctgggtggcagagaagttgtgctagtagagcttgctgcagatctgctctctagggtgctggggaaggctgttcacacggagttgcctcaccagagccacactgctacaaacagcccaggaggggagggtgctgggggaaacttctggctaccggtgcttcaggagcctggcactggaaaagctagctttattgcagcagctgggctttggagaagatgtgggtatgtatgcacttcaggagccaggagctgggaaatctatatgtcctgcactgcagaaacctgctgtgtgagcacaagttaaccaggaagcaaaaccctttcctcctgcaatgtctttctaacgtccccaccgacaaaacatgattgccaactgataaagagaaatatttaatggatccggattcattttcacagagcaggtaaaaaaaggtgaatttggagctgcaagacaataaactgataactggcacacctagggaagaaaaatgatctggaagaaatattgtcactaataggaatatgagtcaggaaaagatcctgccaataacgaagataattcaggagaatcatctaatgtcagaaaagatgagtcattgcttttagaaattgattatgactagatgggaagaagaaattgttttctctgagaaaagtctagtttagaaaagcatggggaaaaacactgagagaacggtttctgagtatgaaatccagaatagcaaaaaacttagaatggtgacttataataactggcatcccctaggattgcagctaatagaaccaagttgaactcttactattctatttttttctgttctattttttcttactttgctagtttgtaattcaaatttctcacactgtgcaaatgttgatatttttagtactttactagatgaactgagagtattatgatttacatttttcactttgatggcagggtgtagggaggggacaaataattgaagtcactgccctaatgcctaaagtgaaactttggaaccttgggcagtgagattagaataggatagcaccttccttggtgacttaaaggcaatatgtgagcagctgggtaaagaatggctgaattactacaggaaatctttaattttagggtgttcttagaagtttcatcacagacctctgtaaacttttatatataacattccactgctgctcaaagatcactgctactgccataggacaattgccaacaccaaaataccagaaggctgatttgagaaaattagttttctctgactcctgggtaatgaattaggctctttttagaaattacattggtttcttaaggtaactagggtgtcgtttagtaagttggtattttagtcaaacaaaatatatacctctttagtcagtaccatgcctgaagagtaattacacagatgctccatgaatgtggttctgaaaggtcatatggcaagtgtcagcctttttatgacaacactgtactctcttgtaagtgcctgaatatggcccttgggaatgctaactaaaacaacaaggaaaggtttatgatgctaagtcctccactacaaacatttcatctcttgttacagccatgcaaattattataggtccattgacaatgggaaaaatttactgagcttaaaacaaatcagacagtatttaacggtataaaaagttaaaatggaaaaaatatgtcaaaaagctttgggatcacttaagttactaagctaactgtctgaaaactgtatataggtcttacgaatatattgtatactagaaaattattggtaagctcattgagtttcttgtgtaatcatgtgcaacacagttggaataaacctactaaaaccttacctattttttatgttcagactacatgagagtttcttcactcttcttcatctatgcagttaatgtgttcccactatattttaaggacaatggaaaatgctgacatatggagatgtgtaagaaaattgttcttaaggagcctgtgaaaatgtactcgctcctcattcttttctttctgttttggcacctccaaaattattaagtgaaaaatattaatctaattaacaatttatgcagaaaagaataagttaaatgttacgttgttcacttttagagaactaatctgaaccacatgcacacccattccagtatctttataaaatatctactcttttctgctatctcactcctccatggtcttgcatccctttcactttagggcaagggttggcaaacttttctgtaaaaagtcagtagatattttaggccttgtgactcgtacagtgtcacaactacccaattcttctgctttaggtgaaggcagctatagataatacacaaatgactgaccataggtatattccaataaagctttatttgtagacactgaaatttgcattgcatatcattttcatgtactatgaatattattcttttaatttttcaactatttaaaaatgcaaaaaacatctttgagaattgtacaaaaacaggcattaggccaaatttgtcccatgggccatagtatgacgactcctggtctagtggcaatgctgcttcttcaagggctgagtaaccttctgtcaatcagagtccaaacgaaaattctccaaagatcgttctgtttataaagttttcccatatgagacattcaaagctttagggatcatcaatgtgcccataattttccattggttttcccactttaatagctggtccattgaaaaatattttaagattttacagggacttattctacttttcatcataacaagtatatataaaataatgtatgggggttagaaaaggaaaccaggataaaaggcctatgggttctgttcccagtcagttctttgactggataaataacctgactgcttcacatctcattttctttgtctagaaagtcagaattgtcaggtgttgttactaaacagttatgttaaatgttaaaggacatggtagggagtggtgggtgggattatgtttgtatcttccagagttgccacattttcagaaaaaaagtgtatactttttagtgccatcacatacaactgaaaagatgaatatttctgaagagaaatagggtgggtgatttgtttcaaacattttgacgtagaaaatctaaacccaaagatgacatcaagcaaactatagcacaaaatacacatatgtaaaacctcatggttttcctatgtgcctacgattaacaggagaggtttggtttaggggtctgtaaaaatgttttctttctttaagcataatgctcagagccaagacatcatcagctccaggctcagtcagttccagtcgaaagtgtgaatgttcagcaaaaggatgtttttgaaaggagactgaaaacccactgtgccagatacctgaaacgttgttagggtattcagtggaaaatttcatttccacattataaataactgtaggatattttaagagatccaagactagtaacttccaagagctgcttatattagttccactgaaatgtgaaatggaggaaggatactgagaaaggccataaagctgagttactagatatgattaattaaaataaataatctcactattgattaaattgcccttaaaatccccaaccactgaggactgcatagtttgctatccaccaaataaaacaaaggacaaaacagcgatggagaaaaaaggaggaaaagtccccaaggtaacttcttaaattcaattctagaattttttatttggaaagcccctctggtggtccatatttgaaatattaattgtttcttattgtcttcaaagttccaggaattctctgttctatggacttcctgggaggaggacaatcccagagaaggtggcatatcacccaccatggtagttatggaattttggtgtcacttttaccatagaaataatcaattcccataactgcttcccccctttgcagcccccacagatttaaaaacaaaaaacgagccagggatctctgttagacagtggcacaacatgcccaaagtaaaactagccccctaaaaagaaaaaaaaaaggcaggaaaaaaaagccatgactctatgagtgtgtatgtatttatgtgtgtctgcgtgtggacttgcaagagtgtgtgtccgagtgcacatgagtggacgtgtaaggtaggacagcaatggatgcagtctctctctctcttttttgaggcgaaagcctggcttcccttcccggatcggccgcctgtgggactcgagagacctgtgcacgcaggggacgcggcggtgcccggggttagagctctcccctgtgaccgaaaagataattaaaaatcgcacgcgcaggagccagctcagctcctggctgcgcttccagttggtccggtctggctaaatgggttctcgcaccctggcggcgcccgggctgggaggccagtaggccgggcgcgaagagtaggttggggaccaggtgtcatagccggtggcgcagaatcgcttctcggagtcaccgagggtggcagtggcaggcggcggctgtggggcgggaggggcgcggcttggggctagtgtctgtggagggatttggggaagaggcaggaacgtggagagaaacgtgggaaagggaaagaccgacgagggaggcgtggagcagtgcatggaggaagggcaggtaaaaataaagccccaattaggaaggacagagtagtatcccctgaactccatccttacccctcgagagcgcacacctggctaccccgcacccccacctctgctcccgcggtctggcagaccctcagtcccccgcgcatctcttcagcggggcgatcccgagtcacgcaaccacagccccccaagctcatcttgtactcgaaagggctccagagtccgcgactggcaccaggcccccatcttccgtgcccctcatgctctcagagcccttccaggccccttctagggcgcagacccgggcgtgggctcagcgagtgggagcaaagctctaaaaccagacagggagggtcgtggcaggtcgctacgagggtgagggaggcgtttgcactgagcaataaaaacacccagtaatgggtatgtgaattgctttaaataagatgggagggcgtgagagatgacccaaccatctttcttccttgatgcttcgagggggaggcattctaattcttcatttattttataaaatcacttgttactgtgtcagctactccactaggaatctttgaaactttggcaactgatgatttttttcgcaaacacgttttcaagctttggaaggctttaaagagtttggtaataagcaagaaacgtagtagtacacaacgccgagggtaaaacggccctgtgcccccttcttggggtgtaatagcctcaagcggatttcccggcttctgcgggcgcagcacattgttttatttgttttgaaggctcagagtttgaggctggtcgtagacacccacgtgctctgactctcatcagcgtaatgatcgacttagccagagtcgtgtctatataaaccacaaaaacctaatcattagaaatcccagcctccaaaaaccacattttaggtaaaaagtgccgctttttttccgcgctccttcatcctctcgaccacaactttttgggggatccaaagtcgctttttaaacccacactaggaaataaatacataaataaacagccacggaagcattttgaattttttagttcgtatttttaatttttccccgtgagcgctggggaagacagacacgaaacttagtcttagatgtagaatagacttaataaaatatttaaattcatggaaaacggctggtgcttttccccagcaagggttttgcaacttattttaatcacaaagctgacagtttttcagtccttaaaacaaaaacaaacaaacaaacacctcattcttgttctctaggaatgacaagattgaatatataagaaaaaagaaatgtccagctatgcacttgagttcctaaaaactattttgactagatctccctccaccccccctcctcattttttttgtgtcacttaaaacaaaaaacacccaaaccctgcaaaatctttttcccttgggagtcgctcagacagaggtgggggtagaggtgggagggtgaagagtgctgagaagtcagcacagaggctcaagaattttctttcctcctctcctgaagttacaacgaaaaatagcgacagtcagatcagccgggggctctctggtgtctcggcttcaatctcttcctacaaagagggggttccttgtcctaggggtggggagagcaagaggacgcgacctggcgagattgcccctagtctggggccgcctctaggcttcggaaactgcacacggcgcgcggggggctccttctcgcggccggctggcggcggcagcggctgcgattcgcaggctcgagattcgttgccccgagatccgctgcccacgacttacctcttggcaccttgaagcgcgagagacaggggagctttgcaaattgcaggagggagtggatgcaaagaggtggctgtgagagggcgagaagaaaagaagggaaaggaaggagcctagccggggagccgggctggcagccgccgcgggaggaatctgagcgtgcagcccgcgcggggggagcggcggccgccgcggaggcggcggcgcgggagggcggaggcgcggccgcctgcagctgggtagcagcgcgcggcgcggcgcggcggtggcgggcagcgcgcggcaatgccggccccggggctggactgctgaacccacaccgcttcaccaccggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtaagaggctacaccgccccccgcccccggccgggagcggcggaacctgcccgccggtgtcttcctgcccacggggctgggccccggacgtcctccaagacctcctgccttggcggctctaaccccagaaacccccggccgggcctccctccggatgccctggcgggctcggggctcagtccctccgcgcaaatccctccctctcccacctgtgcccgctgccaccccgacttcagccctagtccccctgacccgttcagcactcctcatgcctcctgcctggccttgattctcactcactccttcgcgccgtctccctttcccccaggatccccaaagtacccactcttgcactgcgagcggacttgctccaccccgcccctttcccgggggcgaggatccccggcattgtcccctggggctcccgcgtccttccgggacatcccggcctggccgcattgcgggctgcccgcgcagcctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcagggggcctgggcgctgaaccctcgagtgctgggaggcgcgggccaggggacggggcgggagctcgggccgcttcttccagccgggaccgagctctgcgcctcgccccgccagggagggatgagggaaacctgtggaacaactttagttcgcccaacttgaaaacggaggtgaaattttgtatttttgctttattattatttttaaaggacttaaatctaaaaaagatccctcctgcttctgaaaggtggtgagaggctcctgctggtggcctgagcacggagtgagctcgaaggcttgagagcggcctctgcgcgccccgcagactcttgtgcctgcccggcccgttagtttgagggcgggtggcagccgcgggagtcgcaggcaggtgctccgcaggttgaggttttaggatctggagcctctcacagtagcccgatggctctccataacccgatccagatttcccggggtagccctctacaggggggagacgcggagcccccagggcccagcgcacactgggttgatggggaaacgggttcccaggctgtccacactcgcaggactgtccacactcgcaagacgccagggatgcaggggtggtaagccagacgtggagatgagactctcagaaaggtgctttgggcccttgctaacctctgaacttgagtaggtgggcctgggtcccctgggttctgaggtctgtggagagcagggcaagcaaggccttgggggaggttaaaaaaaaaagttgggggaggaatcatgccagtttctccgctggggaccctggggccaaactcccacgggccactgacagttcccagttgttgatcacccccaccccacgcaccaattcagattccgtgtgtgggtgggatggaaagaaagaggagtccaggtcaattagacctggttatctcgctaggacttatatcagaacagaaatcagaatgaattgttatggaaaggggatgttgcattctggggcaagtttcattttgcagttggctcaagaaatttttttttttaaccgtcacatttctccttttataaaccacccattttgtaggttaatgtttgcttccttgaaataggaaaagctcagaatacatgtgaattgtataaatttaaatttccatacaatatatatcttttacaatgtccatcgtccaagggcccagaatttttaaattagtcttatatgagaatggaaatttgtttccaccaacgccctccaatcccccaaaccaaaagcccccaaaaaccccaaacctggatgaaaacagcaaaaaatacaaataagtagataccttgtctgcacaatgccacaaatcagaatatgtgaaaatataagaacagatgcttacatttttaaagtgttccatataccattctgctaaacatatttaaggtctatcttgaactgttctcttgcatttatgcggctgaattgatttgaacatgagcattttggatggaaaggttgttttttgcactttagcttgagctagtctcagatattttggctgtcatctaagatttttcactaccaccctttaaaaattattttgaaaataaattttgctctttgttattaatcaacttgttaatcacacagagtacatttttgtatcttaagcagtaaacagaccgtaggtaacaagaccatattaaattgactattttaattcatatcaattgaataatgaattgagttaacctacaacctgactgtcaatgtctttctatcaacatacctgtgttaaacaattcaaaaagtgggtgatagctaagatctactcagtatagaaaatactctactgagaaaaaatgtatggatgtttggaacatccagattgtgacaacctctctttaccctacttttggaataaaagcctgagagcactagactttctatactcttacaatataatcaaatacatctgcaatgaagaaataatatgaagaagtctcccttttaaaagtggtgacagcaatttggccatgatatttagagctatgtaaaaaatagattatagtggttgtcaggtcaatagcagataggtaaatggatttaaacacacacatacacacacacacacacaacttatttgttgtgaagtctgatattcaaatcaatacaatatttattgagcccgtattttgtatctgtcacactgagcttgacaccgcagagaatcagaaatgaattcaatagactgttttgaaatgtcagtttaaactcgtgtttaaacacgatattgtcaatctatttcattaagaatgtattagcgttgttcatctactcttgtttcgagatgatataaaatttatttatttttacatgtaaaaatgcaaaaacaactggtatactttatataaagttgtttattaacattgtatttttaacaaagttctgcagttttgaaatgttcggtccccccaggtgtcaaggaaacggaaataaatatttttaacattttcaggtgtatctcactgaaaccttaaaatagttagggcatactattagaggatcccagaccctttctatcctagataattctagtgacaaagaagtaatttgcaaattcagctcattagctgatggtcaggtaacggtggagagagcgtgtcaaccatgcatccagtagcacccttttagttaggggtctgtcagcatttccactgtgaagcctggtgttcagggttcgtaacttagttgccttaaatagcttcaagctgaaacactatgcagaaattttaagtccagatgtatattttaaaactaaaagtagttcaagtctattctgctgttttaagttagagaacactggactacatatatttatcagtatcatatgtttttctggcagtgttaaagaaagaaaacacatttttagatatataagctagcactcatagttaattctgtatatttaataatacctttcagtgcttgtcaaaaggaggggtttcaaaatgacagagcaatttctgtttgaaaataaatttttggcatcactagccatttttctctcttcgaaaacaaatatacaactggtaaatacttgataccagtgagtagtatttttcttacatagttaatgatcagattttatgtttatattttttgaatctcattgtatctaaactagggaaaataggttgttaagcctgttaaatccttattaaccgtaatataaattattatgcaaaattatgtaaatcaatagatttcaagttgtgtgaagacagacacatttttgtgttatgcctttgaattcaagaaaacttatttaaagttaaatattttgggactgaatatataaaacttctaagtaaggaagttggaacaaagaatttcaggtggaaaataaatacttataaaattttttagaaaacttctattaaatatttgaaaataggtatggtagatatctttcattattttttcctctttggcattattgtttgtatcctttcaaaattccagaatatctattgttagatgatctaaaccaccatgatacatggcccacaaattgctgctttacattgaaataatttttatcaaaatttatctttgacatatatagttttaaaattatgaaatgacatattgtgttttttctctaaaattcaatgggcttttcctaagttctaggataaattcaaaatattaactgtagtatttgttgaaatgttttgatactgtatttgaagttatctttaagtaattgtgataggaataacatttttgctttttgcaattagtctcacttctctttttattgcaaagaaagatttgatcagattttatcttgaaaaataattatatttcaattataccgcaagtacaatatcctgaattattttggcctataagagtaattgattagttaagactagacttctgtccatggaaatgtcataggcaattttaatttccatataaaaagatgagaaactgttttaagggtttgagttaattctccattcctcttcttttagtgattcacagatttagtcataaggagtctcatacaaaatttcaatagcattactacagttaaatatccttctactttattttgtgcaagccacatatcatgtgatttaaatgctagttatggtgaggtgcgctaaataaaggaacgtctttctctattctgaaatgtcaggacagaaaattacttctccttttctcatggagtttcttgaatttgtagattttatattttaaaaacacctagaaatgtaattgttaagatcatcacaaattattctttgcagagcagtacttttgtattgggtaggatggaagcaaattttaatttgtgcttattcctaactagttaaagagcgagttttgactgcactttaccccttcaaatgtttttccattgcttggttttggtacagatgaaatgtgtaaaaatttcttgattcttttggttttcttttagataaacacagttgagaatctccaagggaaactttttagcttcagagatctacttaaagaaaaaacctctcaaacatataattatacttctgattgatataaagtcaaatacagtacttcccccaactcccaaccttttctccccctcagaaaaacatcgggcaatctgatttggtagagtgaatagcagaaaaaaaaccaatatatttagccattaaactagagttcagctttaacaggaaagattgtcactaccttgcattagcattttttttcaggtcttgctctcagcctcatagaaggctcacacatcttgtgattatttatttgttttgtaaaatgtgatacgtaaaacacactaatattgaatatggtcattattatactgcttaagcacagtaaaatggatgtatgtatttcactcttagggatcttttctttcatattttcccatattgaatcaattttccatttcttctaactaaaaaaaaattcattatgttaaaaatatgcagtaaaataataatgtcccagagctcttgaaaacctttatattggggcagattgctttttttttttttttttcggaaatgtagccagacttgagtgaaatccaccagcagtcatcctgtatctctcaacaacatcaaagaacatctcagaacatgaagtgaggaagtacgtactcagttgaaccctttaagaatgcttataagtaaaagcctatgtttaacagacagcagatttggaacagaacactgtgttaccctcctcatcttacaaaaagcacatcattataattacactctatacttatatagtatcttctacattttgcagactttccaattcatattggaaaactgtggttcctggagatgaagttattttgtgtgaggtcatagcagatatgtagcagaagtggggaaaaagtggagcctcttgattttggtatattcattctcttctaaacagtacaacttttctcctgcctttattaatatgcttactgggtccatatttactttgacatagaaagccacgcagcaggtgttaaaatacaatatgctgagtgtacaaaatgtcaaacattcagatgaatcctggcgaatgtagtcaattattgcagtattttcaaatgttcacatttttggcatggtgaatttgaaaaattgaaaagcacattgcctccatcaggagtacagcattacctgtattcagtagccgcttgagatatgagatgacgtgtacagagaggaagtcttattttcaagggattttacttttgatccaggagacttctcatattgagaataactatattctccagggaaagggaggcagcatggttccgtctcctctgagatgaaaacaatgtcagaaaacaagctgggggcaagggcacattgctgttagcaaggggtgctgactcaacattaactggccctctcagagttttagtgggtagccccacagacttctgtctctgcgaagtggggctctttatggagctctttcatttatttcaaaaatgtttacctggctgggctcggtggctcacgcctgtaatcccagcactttgggaggctgaggcgggcggatcacctgaggtcaggggttcaagaccagcctggccaacatggtgaaaccccttctctactaaaaatacaaaaattagccaggtgtggtggtgcacacctgtaatcccagctactcgggaggctgaggcaggagagtcacttgaacctgggaggtggaggttgcagtgagccgagatcgtgccactgcactctagcctgggtgatagactaagactccatctcaaaaaaaaaaaaaaattaataaaacacttaccatgtgctggacacttttgggagcagggttgataagtggtgaacaagacagatgagatgaaggcccttctctcgtgtagtttcctaactcatataatctggactcctaggagtgagtccctcagctttggcctggtatatttaaagtagtcatagaccattaatattaacatatgtacgttgaaatgaggatcacttgagtacattgggaggctggggaaagtggggcctgtaatttaaggaaggctttattgattttgaactgaataacacagtactaaatggaaggaatggaactgagaaacagcctaagagaaaagtaagggtgacaaaaatattgacaagttttttgtttgattgttttcctggctggaggagaggacatagtgaaggcgtgttgcagtagggttcatggatgggggaaattcagccctaaaatataggtatagtgtgtattatcacactgttaagaaatctactgtaatatgccaattgtattgggaacatggaattaaatgcttaggtttgtcttatggaaatcttgacaaaggagggagtagcactagaaggagaaaaagataagtgggaggttcaccagacaggcaagcacacaggggtattattgtcagacagctgtgggctacttgagctgcggtcattgctgagttaccatgagggcatctggaagctgaatgaggaagacatggaaataatctgaatatagagtcctggaagttcgttgagagaagggattgttaccaaggggcaggatcttggcaatggattaggaggagtgtttcatatatgacagtgaaggatctgcaccagcatctccttactgggctctgtgttaatcaaaggcacacatttgcatgttagctgactcaggttaaagtgttatctctagtcttagagcagagaaaatgtttgtttgttccaaagatggattaatctagatcttttcttgattgagttaatttgcttcagattaactgttgaagattaagcagtcaagtatgtcattccaggatggcagatgggacacaagacataatagaactgaggctaagggtatatattgtttttttcttatttatcatcaattattttcaccttcagtttcttgatgactttggatatcacactgggtcccaccgcagtgtggttttcagtaaatatactttattaaaagctgaagtgctagcccaaagtaaggagataaaacagactacacgatatctaggctctatgtagtgaggagccccagggtttcacttaaaaatcttctcccataaagttgaccagacttgatattttttagcctgtgatgggataagaccacacctcagggctctccctgagagaaagcctgcagacaggtggtgccttgatctgtatgatgcaatctgcagatggggcatccctcttccttctgtggcataattcctacggacagcttaacatggggatttaataaaaatgtacatattttctgtgaagaatccaacaacaaatgaaagaagtttttgcctgcctttgaaatgggtggaccctgaaacattggtctgtttgaagtggcatcacaacccatacacagatgcttcattcctgtcggccattactggactggactagaacactaagtcctgataagacacatcatttgcaatgagaatatattctgtttgtaagcctttctgatgtgccattattgctgctgtgtttcctgttttatgtaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggtaggtctctgacttttgatactgataatagaataagcacattaggctcctttgatgaaatgtagactagtctgtatacaaatcagcaccttctttttctgaatagaattactgaagatttgatttaaatacatccagatgaagttgagtgtttttctgagtactcaggcctttttcatttattttatgatattgaaaattcaaacaatgttttcagaaaaactagctcctaatttcactgggtgtgagcatataaggtagagaaaagaacagttggaggatcaacttctgaattatgaggagtcaaataactgagtaaattgagtggtaaaggggaaagaaaaatggatatgttggatcaatttcctggtaatatcaattttggtctaagttgtagcaaggacagctggcataatgctcttcacttatcacaggttacctctatatgatttaatttactctcatagtaagaatttattaaaaaccatggtttttttttaacataaggcttttcatttgaataagtgaataatgtattacttatgttagagtgactatgtaaggttgcctagacagatgaatgattagtactctaatattaatagttccatactatgtaaggattcccatcatctgagtccatattcaaaaattagagatccttaaatagaaaattatcccttttagggtttttgtaactgtttgataaatgaggttaatgttttttaaaaaagtctttaaggaggccaatattttggcttttatttacttattctacagaaagacttttactagttactcactattagaagcattatgcttatttatttacttaactgaatctaatatttccattttaagtattttgataagaagaaagaaaatagaccactttagaactgaggtgaaataaagccttatggaatcattgcaacccaggtttgaataggaaatgaggagcaccactttttaaaccatgtctaataattgctctttagtttggatcagatgtcaaattattaccattgtaaaaacttgataagggaaattcaagcaaggctgtttccgatgagtagtgttagtttactttctaggaacagggccaagaagttgtactttttaacttaaaaaaaatgattcatgctaatgagatactgtcactgacatgttgtttgaaataaaaagaggctcacagcctccggtagaatcaaaactaagggagttatctctgcatcaggtttagttaactttcataaaaagaagaaaaaaagacacatcctatatcactattgactgattaggtttggagtatgtgtgtgtgtgtattcattcttcctttttctcatttacttatgcaggtccactatgcaattaaagttttcctttttttctagttagaatcaagaaaaatgtgaacatgatgatttacctgtatgctctgaattgcatctttcttcttatgtaataatactttttttttttaactagagtaatgaattttagtttttaaaggattgggtgccatgcttaattttacattacagattcaaactagtgttttcatttatcttacttttgtattatatagatgctgcataacttttttctgatcaatttaagtagaaagtatggcaaagtgatagtgtactttgtaaaccctcaacatatttatttaagaaacttcaaagagaaacaaagggtgtgcactgttttactatattggctttctgagttttggctggtttcccaaatagcaatttttatatttaaaaaaaaagacagacttaactgcttgcagacttttcacgcatggaagatgaagaaagcttcttttgatgaagtgtaattatgtccaaacagagctgaccccctccccctatatttcttatgatcttaactgaagaaagtaggatttttcctttgaagcagccgggacttggtggaggatctgaaatgctacagtctgctgccagaggcaggatggagaaattggtccagacttgtcttcaagacttagatggggggtagggggagtgggtggagagagaaagaaaaattgatttatcactaataatatatttttatatcactgcattaacattgtatgaaaggaaacagtaatatcaagctgagatgaagaggaaaaaaggacagagaacactgataacagatcacactctgaaaaaaaaatgggtcagtttttcagtggcaggaaaccctttaacctgcctttgtaccctttgtacctgacctgctttataacagactcttccagcttcctctttgattttcacacttctacatttctcttaagctattaagtctggatcaacatgctgctaccattgtattttctttcccggctttaaatatttctattttcagtagtgttataaaaaaacaccaagttcctcaaatattgcacttttttttttctttccactggtagaaacataaactctcagaaactgaaaaacaatcttagattataaaggagtcatgtcactactgactttgactttatgggtcatcttatgaccacaacttttgaaagtgctagaataaaagtagagcatcagtggaacttgcattaagttaggagaggcttaaggtttttcatggtttttccttttttttatccttaatcttttaaagagaagtgtttaaaatgattttggtccttaaatttttttttggtatgctttctttttcctgatgaagccatggatgacacaattagttatctactgactgctagctccctatttgagagcctacattttaaaataacaggctgtattttatcacttatggaaagtgataaaaaggggatttttgagaaaaaattaatttaaggaaatcatgaatgcccacataaacatttgacttaagaggtgcattattattataggatgaagaaccaattactaaattggttggtaatttctgaaaatttcttcaacattgcatacatatttcttctgaaggggcaataagaagcagaaggagcctcattcacttttgctgtagttgttaattacatcttgatccttagggtctgattttggcagatcatagttatacttaactacttgtttcctcccccaaacccatctctttttaaaagcagttttttatagagaactcattctactctgaaaatttaaatgctttatacttgaagggtgaattttatttttggcttttgttcctacatgaggcgtcaccctgaatttaggggaagcatagatgacttttaatatcctaagtaagttgtaaaggtctcaagtagaactgttaccaaaactggtttaaataaatttatggacaatctattttatctttttttcttttttgagatggagtctcactctgccacccaggctggagtgcggtggcaccatctcggctcactataacctccgcctcctgagttcaagtgattcttgtgcctcagcctcttgagtagctgggattacaggcgtgcgtcaccacgcccagctaatttttatatttttagtagagacagggtttcaccaggttggccaggctagtcttgaactcctgacctcaggcgatctgccctcctccacctcccaaagtgttgggattacaggcgtgagccaccgcgcccagccgacaatctttctaccaggttatttagagacattaaggataactgagatctgtatatatccttgatttattaagatgagtgccatagatgaaaactgactctgaaacacagccatgggagccactgttagaaaggcaatcctgggcccatagaccactaatctgaccccaaaatggcactttaaaatgttttagtgtaaattaactttcaatctagagattcagctcttttactttttgcgatctttccattgttttgaggttctaacttggacccagtggcttcctattcaagtttctggtttctaattctgtaggcttttagttttctgtaactagtttagactcctggctggtttattcttctggttagtcttaacgtttataataaagcctctctttgctaaccaattataaattatttaaatccgtgtaatagccaatatagtggataaaatatatcaatgacactttaaaaatagatgctttcatcatcctgagatattgcattagtccatttatgtttactgtttcttgggcacatagagctgattgggacgcatctagaaataaattacttattaatttttttaaatggcaagtgatcaagccacttaaggaagtggccaagtgacagaatatttaaaaaaaaaagagcattaattttagggtctgaaaaatgaggttcagatcttcattttttcatttattagttgtatgaacttgggtaaattactaagtctcttgaggcttcagcctccttatttgtgcaatgggggtgagagatctaagcggggaggattaattgagataatgtgtatgaagtggcacttaatatgtttctaattgttattcacctttccctattcaaactgcacccaccccattcctgtcttttctttcctgtttttttccccttggctatagaaaagtatagccaaggagacttaaaactatttatactcagtaacaaatgatgtgcgtcttaaacagattttaggaacttacatggtctaggttgaaaagaaaacccattcactagacttgacagccaaagacctgttctccattaagccttgtatataacctgttccatattaagctttgaaaagactgcattaaactttgcattggtgcatattgtcaaagatttgtgttttggtttaatactctcagttttcagtaagggaaaaagaatctctgaccaaaaaacaaagcaaaacaaaatgagctttttaaaggtctgttacaggagcagactgaatgagtactctggcctgagattgctgaatgttttattgagtcactgtttcacgcccacctcttcctgtcttgtaacagtttgcagttttgactatctgacatgattaaccgttgcaaatctaactgattacaactgttagtaagtctgtgcaacagagaatggtatcttcttctggagaaaacagacatccaaatatgctaccaaacttttccctgtctcttttccccttcttattcgtcgcttttagctcattaatttgaagcatcagatgtaatatttcaatgaagcacaccttctgctaaaagcaaaatttgagtttatactgagagatgtcatgttcatttagcaaaaagtaagtcgctgtcagggggttatttcaagatttaacagcaaggatgtatgttaggggaggggtggacagggaggagaaaaactttgttccagtaatgatgaaatcatcataccacaggcacattacggccaggacaggagacactggctcctgttaaaatgattcccataagaactttcctcttttatcttcttattgtagtgcagctaagcaaatgaaatgctaaagctatgtgaagtaaataacataatcaacaatgatttactattgttctctcgtgaggtcatgacccaaccctaaataaagacttctaaaattgtctgtgcttggatgtgttcctgatgttggagaaaactgaaagaaaaagaaccttcctcaagtggaccagggttttgttttcattacaactgttgctactgaggagcttttttggaattggagtcttcctgtgtagcactacaatgaggacgatgatcttgactctaagcaaatttggaaatgtcctaaagtggtcatcggagggtttccaatttagaagaaggagtcctgcctcttgtctttgtttcattgcctccttagagatgcttaaatgcaatttggaaatctatgctgctgtgtaatcatcaacactgttttttaatattcactgtatattttccccttttatatctgcaggcaagagtttcaccttgaccataaccgtcttcacaaatcctccccaagtagctacctatcacagagcaattaaagttacagtagatggacctcgggaacccagaagtaagtactcccctttttattgaagaaagtaatagagtttccagagaccctatgaggaatttattccaaatgagttagtgtcactttcatgtccatagtgtctttgtggactttgctatctgcatatattttttttagtgagggagagttagtcaaacttcagagttagtagaaaataaaactacggttttaacctttgccacacaatcactaaggcctccgtagctttgggaaatgagtgaataattattcagtcactgttaactatttgctaagaaattttgctcatgtactgaacataatggggcagaatagacccatgagagctgaggaagaaaagagcaaacttaaaaatcttgagcttagtcaaaaagcactggcatgtgtttcccatggcctaagaatgtgttttagctttttaactcgcccactcaattccctttatgaagagcacactgcttaattacaaagaatttatttgcaaatgataacttgcttgattgttacaacactgttgtttggtcatgctctagtaattgttataggtagttttcttttaacagatagagtcaaaccacgtttaaatccatcttggtttatttgtctgtctggacatccagaaggtttcaccggcaatcagtttcaggtagcgcacataatctacttgggccaatatgtatgttccttctaaatctaaaatgaccgaggtttgcttcccccacccccaccaaaaaactgctttgaacaaactcagcatagcggtatttgaatatatttagagattaaagattatttgatatataaaccattaacaattgtgtgccaatggaaacatcatatagaactctgcctttgctgagtgaatacattggaatcctaaccactgcatttagggaggtcagtttggtttgtggtggaggcatagctggcagaagtacttgttctataacaatcaacctgcatagaccatgagagtggcatatcttttcttcccctaaaatgagagaaaaggtctcataaagttttgcctctacccaagcagcataccttcctagcagtgggagcatatggtgggtcccgtcccttttgctgctgtctcttttcacaaaggctgactgcttgcctgaactagggaggtttcctgcctcaaaagcaagtctttgaggtttttgttttcttctcctttcatgtgtgtggcattcttccaggttcataatgttgagtcagtgctggccctgtctgttcagtttgggaatgtcctgttaggtgattgctgtacacatgtgtgtaagcaccaagtctctagtcctaagggctagtggttatggagtgcaggtgaatagaacagagctttgcctggtttggggctttgcctgccttttctggatagccataagttggggatgatgccttatgatggaagatgtcttctaacttttggtcagactagccccggaattcctgaaaaggcaggacgtccattttagtaatgcacatagcaggatagttggtttttaaaatgtagcaccgctaatacttatctcttaaagatatttcctgctgatctcagctgcttttctcagttcttggaaaaaccatttgcgtgtgtttgtgtgcgtgtgtgtgtgtgtgtatgtgtgtgtgtatgtttgtgtgtgtatatgtgtacatacacacaagagttgatgctcaaaagttgatggctgggagaggaaagagggaaggataggtgctccctgttctgaacgatatgacaataagtgagaaggcagggtagctttggaaaagtcacttctgtttcaagtgtgcatagcagtaccttatttcagagaggtttttgtccaaattagtcaatagactaatttgtaaaggcagagaattgccttgtaaaggcagagaagtgctctgaaagcagtgagagttaggagtagaggggccaggtggtatacgtgggacctgagttcaagctttgtgtggtgcccagggtgggcggtggaagcagatacagatctgcaagtggtaggccacctgccctagataagcctgagtaacatttcttattaactgaaaatatcggtgaaaatgcggggtcattttcctgacatcatagggtgacttgacgaagtcagtgtctggagagaagcatgggtctgctttgagcgacagctgaatcctataacctggattctgtgctggattatttttttcctccctgttcttggccatcctgggcattgaatatttgtagcatagccctcttctcaatatggttctttaattttgacactcccaggtgtgggaaatgcacaatatttccaattttcttaaacagtgagtataataggagtttgattagttggtgcatataatgttaaatgggagatcctctagaacacagactggcacacgttttctacggagtgccagatagcaaatcctttagactctgtgggccgtatggtggtctctgtcacaaccactcaactctgccattgtagctcaaaagcagcataagcaaatacatacattcatggtcatggctatacaggttgagtatcccttatccaaaatgcttgggaccagaagtgtttcggatttcaattttttttttttaatttttggaatatttgcgtatataatgagataccttggggatgagacccaaatctaaacatgaaattcatgtatgtttcatatacaccttatgcacacagtttgaagataattttatacaatatgtaaataatttcgtggaagaaacaaagtttgtgttatgtacttatgtgtggaattttctacttgtggcatcatattggtgctcaaaactttcagattttggagcatttcggattttcagattaaggatactcgatctgtattccactaaaattttacttataaaaataattggtgggccaagttgtagtttgtcaacccttgcttattcaaagtggcttattttattgatccttaacagagaagggctttagtaaaaggctttcctggggcagtgttggggcagggggagtggaacaatttatatgcaattgtttagcctcctctcccccaaattataattccttaattagtggttattagtcataaaagtagtatacttctgtttatcacttatagtggcttgaagttgaggattttgtactatcggttcctgttgttggaatttcactccttcctctaaagatctgaatatatattgaaaagcctgcttctggtagctcagctgtttgaacaaggacaaattctgggttaactggttgggtctttatgtcggactgcttggatcgaaatcccaactccatcatttattaactgtatggaggcaggcaagttacctaacttctctttgccttggttttctcatcttttatgtgagaatgataataccttcctcatcagttgctgcaagaatgttaaatattgtaatgtatgtaaaatgggtagcacagtgactgtcatgtagtaagtgttcattaagtgtcagctattattacatcaattttctttagtgtcagacgttggctgtagagttttgcttatggtatgcctctaggaaacagataacatctatagattctgttctctagtatattacttttttccccctgcagatgactttactaatttttgctcattagtaaatgacactaataagtattataaattatgcctgagcagatattcatgctcctcagggaaagctgtgcagaactgatgataaatttaatttgtttgcagcaaagtccaagagcagatgctatggcactagtaccccactgtgaggccttgcctatcaacacatctgccaagacttgcttttcactcaaaaatccaaaaggtttcatccttctatgttttctgtctctggcagctgaaccagtgctgtcacatcacaaacaacttcttttcttaatatacacatctggcgttggcagttggactaacttcataagagcacatgatcatcactcattacaagattaaaaagtaccctatggcatcattgatgttttttaactttgatcttttgcagttgtgattcatctcggttataaaacttccctttaaaggaacatagccgatgacttattagaaccttcatcttaagtagcgtaaacatgaaaatggtacacatctttacaaaatgccatttattttctttgccagcttatcattttaagacatgacatcatacttaagatcccaaatttgtaagtcttgtgtttaggcaaggcattttgaccttctgttggcaagctagctctgaagaacaactgtcagccggagaagtggtgtagcagcagcagcaatagtaatgcatttagatacctagctctttgaaacatcggtttctattaggatcccttgttccatctgtggacttggttccacctccagtctgatttaaataatttctacaggaatgtgaaaacttggttagcaacatcatattctatagaagtggttcagagttagggaagaggactgatgggagaaggtattatttgttgtgcagaggatggaaaaagtaaataagcttacataggatactttaaattctcttgctgtattttttagttgtctattactaaataataaactaccctcgaatataacatccagtttattatttcttatgattctgtgggttgattggggttcatctggatggtttttctatttgtcaggcttggggtctatcatgtagctgcaatcagatagtggctggtgctggaacatcccacatgcttcatttatgtgtctgatgccttggtgggatggctgcatggttgggctcagctggaatgatgcaacagcaggccccactgcatctctttccatataatcctggatcctcttcctctccacgtggcctctccatgtggtctttcccgctgagtctgacttctcacatggcggcagctcagggctccctaaggtacaaaagtgagagttctcaggccttgctttttttttttttttttttttttttttgagatgaggtcttgccctgtcatccaggctggagtacagtgccatgatcatagctaactccaacctcaaactcctgggctcaagtgatccatcctctcacctcagcctcctgagtagctgggactacaagtaagtgccactatacctggctaatgtttacattttttgtagagatggggtctcactatgtttcctaggctggtcttgaactcctggcctcaagtgatcctcctgctttggcctcctgagcagctggaattataggtgtgagccactgcacccaaggatgttgggccttcttaaggattaggctcagaactggcatggaattgcttcctctagatttgattggttgaagcaagacacaggtgcagcctggatttaagggaaaaaaaccaccaatggtgtgaatgttgggggatgtggttcatgacaccaatgtcatcaacttacataagtgcttagctggcagttgtcattgtcacaacaggaaaaataattcttttcaaggtgccatcttctgaaaggactcttggctttttcaatctaggggacattcaaagaaaatactccaaatttactagtctaatcgtagtgtcattctgaattgaacagatttggtaaatatcagatgaattagtggtgggtattcccttgtggtgcttggtattagcagatcactactcaagtgagaagaacattagatgtttgaacaaaaagaagtatgagccttgcccagcaacatgacaagtctgtagcagaaatatcttatgaatcctcagatggttaagattagaggttttttttcaatttttaaaattttttttcgagatggagtggcatgatcttgatctaggctcactgcaacctccatcttccagattcaagcaattaccctgcctcagcctcccaaatagctaggattacaggtgtgtaccaccatgcctggctaatttttatatttttagtagagacgggattttgccatgttggccgactgatatcgacctcctgacctcaggtgatctgcccgcctcggcctcccaaagtgctgggattacaggcgtgagccactgcgcctggccaagattagaggttttatactttgtatcatccaactttgaaattcttgcttgctggcaccttggcaaacctactgcctgacacatgtgagtgggtttctaaaaatttttgtgtgtcgggtctcaggtaggtaaaccatatttactctcaaggagagaccaaagctgtgaattgtgtacttcctgccagggcactggcattcaccactgatcagccagccacctgtctcaacctggtgggaaaaaggagaagctctgcctttttccctccggtgatctagctcctttcttgcaagctcagagtacatggctgcaacatttctctgcttgtctttgtgtgtagcttcagtaagggtctggggcttaggttagtgagaggttatctggaagtatagggtactgttggtatttctaggcttgccttagtatcctgcttcactcagcttgttaggcttaggtcctgcagctaaactattttcttttcctgtttgcttattctcagttgtgcccaattcatcaacaaatctgtaattgttcagagaagttttatttctctgtatttttgaggcatgtccaattgcagaagttttaccttaacaaacttgagtgaacagacttaacgaaacaggtggtgtaggcaagacatcatctcatttttctcttacgctgttccacctagttctgggactgctttccagcctggtgaagggtggagagaatggaggggttgacatttttctcttcctcattccagctgatgtcagcggcagctcacttttatcctccattacttttcatcttagttgggtgaaggaatagactttttatgccaaaggctagcccatgacttttgcttatttaccaaaagaggatgcttattttattttattttatttcagatggagtcttgctctgtctcccaggctggagtgcagtggcgggatctcggctcactgcaacctccacctcctgggttcaagcgattctcctgcctcagcctcctgagtagctgggattacaagtgtgtgccaccacacctggctaattttttgtatttttagtggagacgggatttcaccatgttggccaggctggtctcaaactcctgacctggtgattcacccgcctcagcttcccaaaatgttgggattataggtgtgagccaccgcgcccggcccaggaagatgcttatttagagattggtcacatgtgaaataaggtgagggtacatgtaaaatatgttggatagagggacagcagatgtattttttaagattatttgattcttctggacacagttcttgcattcacattcttgcagtctgtgaggatgatttgaaaaaaccttgatagcctttgtgccatgccccagatgctgcaggcctgggttttagtccttagcacaaagcattagtagagaagcccttaacttcctgactttcagacttcccctgggttcttcactgtctccgaagtgcccaaggaatagaatttatgggtaaatgccatgttttgatatttacaagttggcaaatacaagcagcaatttgattgtcatagatattaatcacttggctaccagtatataaaacatcgttgaaaatctttaacttaagagaataataacagtaagaaaaccccactgttctctgtttccctttcttcaagaaggatgaggggggcggggggatgggtcagaagcgctggtggaggttatgtctggtggttggtggaatgtgctcttgagaagaccagttttaaatatctttcagtcctttttttttgttgactggctgtcaggagctgggaagatagccaagaaggaaatgacacatcgagaggcattttgtgttgtgcaacattctgtggaactgatgcaaggatatatggcctgtttacacattccttcgctcgcagactgcatggcagtaatttaattcagcagcacatggcatgctgcagcaaggagctatggcattaacatcctttcatggcaaattatcacagccgttaaaacatgctcgtgtccctcctttgcactcttccctggcttcccagctctgaatatgcgttttcattgtattggacttgtgttaacaaggtgctgtagctttcacagcaagagcacagtttccacatgcatatgttccagttgatatatttacttctaactaaatatagcatggcaagttttcaagtgatatgtgttctaaaaacacatacatgcttgatccaaatgtgtcagtagtttgtatcttagtgtaagtcagagatcattcattctgaaaatagtgttagggacttgacagggacttgagagaaagaggttcccctccccccctttttttgtctctcttttttttttttttaaataataatgacctttcgttctcaagaaagataattcctgatagatcactgaaatattctgttcacctctattttgtttgtgccatggcaatttcttcaaggaagactagaccagtgaataggacatacttaaaaatagcagggaaaaaaaagatttgttgtattgcttttcccattcatacctgtccatacctagcatttttataggatacatttatgatgtcaactaaagaacatctttggccttcacataaaatctctaaagtttttatttaagcaggtataaaaaataattaattgctcttgtttgttcaagtaattttggaaattaagaaaaggcataaaaaccatttaggtctaaaatattaattcaagatcatatgtaacagttaaaataaaagactgtgtttgtaagtagcaaaggaagggctccagttctcataatttctctgctactgcacactggtggtgaaaatctatttgttggaagaccaaaactcttcattaaaatttaggtttaaggcttaaacccaagcacccctggaaaaggtaactcagacttaaattcttattaagataaaaacaagtgacatagaatcattttttgggaagtaggttttggaagataggggaggagtggtcagtgaaatcctgggtactagaaagtaaacagtgagtggcagtgtgcagcaggcaggacctttgccggccttgaggccagtggttgccaacttcaggcatcacagttttgctgcaggtcaactgtagcaatgagcattcctgatgctttccagttctgatatactcttaagagtgcaagattttgttattgaaaggtgagagttttagggttctgtatttccatatctctctcttttgcaaatgttttcctttcagagtattccttttctgttgttctagatacatgctagctttcctactctattggtttgcaagttatcattgaatgtgtttcttttattttagtattatctttaccattttaatatgtatatttgtcttattaaaattaatcatgatctctgtccatacaagaactttagcattctttaaactgcagtctcaccccctctcttctaatgtcgttatctgatattttagtagatccttgttttatatttcctggattagtcattatcggtgtttaaaaaatgtttatacttgtatttatccattatgtttattgattcatttgcttatcattccttctttcaccttagttcttccttttaagttgagtttgcttttttcttgatgtagatccttcagtaattccttcaatgagaaactgttagtgtgaaactctcagagagtttttattcctgaaaatgttagcagttgtgtgtgttagctgctgccaacatgcggtgatgtgagaggcgttctgctgaaagcctgtctgctttgagtgcctgagatccacacttccagtcattcctttgtattgaaactttcaggtcattattatcaggttagctggagtagtatttaaggaaatggaacacaggacagataatattcatgaaagatggtggaagggaaatgtttctaagctcctgtcactctggagaactctggagaggtctagggtcagtgagtggggaggaggtcagagggaatgttcctgcagaggagaaagcaaacggggaggaaattaaatcccttattttacacttttgccatgggcaggcactgagttgctttggaactttttatccaaatttatgttaaagaactccaccattacacttgctctgcagaggtcatgtggctgttgctccctgagcaaccggagcaggaatccttagatattggtgtccacacgtttctgtcattttggtgagagtacaggactcagaaccacaagagctgtcttttgtagggtaaacgaatcaacgaattaagaagagggaagaaaataatgtgtggactagaggaacatggtttaaaagggccaggagaccacgatctggggtgagactagctctgggcaaggtggatggggtgactccagtgctggctcggtgtgtgtcttcctggggttgtgcagtagttggcaggtggggaagacatcagatgacactgaagcaagctggtgctttctgccttgccgtgaactctcagaatgcatatgcaccctccacaacatgcattctcatcttctcatttacctccttggagttaaattttatgagatacaatctgggtaaaaacgctagcatgtattttggttgcgggggatactcaggatgattaatctgggccttatgcctccttaggattggcccaggaaattattagtaggcaaagatgggcccttcaaggagatgatgaaggtaccaaatgcaggttgttctacaagaagtgaggagaaatatagatgtgtaaaaagaagggtgagtgtgaagtctgggttactaattctagagctttggtttctgtttcaccccctcactgtttactccagcctacaaaaacaagtgacaatgtgttttctaccatgaaggctatttcagagtagcttaacagggaattaatctgtaagggtagtttgtgtttaagaggtggattcccttatggctaaggggattggaggactcaggaattcttcttttgagacctcattgccatctttgtgaccttaagcaaaccactaaacttttctctacttctatttcttcatctttcaaatggaaatagacatgaaggcaacttcacaaagtagctgggagtaactcctaaggaatgatcataaagtacttggcacacatgaagggcagcttaaataccaattagtaattatgtagcgcctttctgccaaggagttccaaatgcttagacattacctcagtgattctctgtacatctctctgagggaggcgttatgcattttacacataggtaaactgaggcatggacacctgagaactcatttgtcctatgttactctgcaagtcagcagatgatttatagagacaggcaaggattccagatattttcctgtttatcctgttgccgtttgtcaagtctgtgtaagtgttgggcccaggggattcttggttgatgtgatgaagcagtgttacataagaagcatgcttaatgctgcagtagcatcgctgaatagtacagaagtcaaagttataaggcctggcacagagtgggcatgcagttcatggacataggcatgtttgttgaatgagtattgaattcattttaacagctgaaaacactgaattttgtgagatgaaaataatacattgtataacttaacctcaatagaatcttactttgaataccagtgaaatgaatttagtacttaaaaaaaattaactttaaaaaattgcacaagtgaaaaaattgcacactagaaaataaaaactaataataacaaagaagaagacagagatcactcataattgcatctcccaagattaccactactaacatcgtgatgtgtatctcccagatattctgtgatagataatgctggtactgttatgaaagataacagaagttggggaaataacatcaggaaaatgatggaatgctacagaatggcatgaccacattgaagctcaaaggagagcgaataactggaaatgaggataattgctgtaaggaaaaggagcatgacaatagaaccgacaattgtttccagttaatggctgcctctgtgatgtgaagggcctgtgctgcctgaatgatgtgggactagatggatctgagaaagatccgttcctcccccaaccctgtcccaccactgaaaataccatctccctttaaaatagctgacagagccttttttttggtgacaattagagatgtgttttaaaatgtaaatatttccggcatgggaacatttattcattcaaaaaattacttttgagtgcttactgttagccaggtgccaggcaggcgtgatcctccctttgaggagcctacattctgtagagaaaaaaggcaagaaacaagtaaacaaacatttctctataatcacatctaattgcaaattgtgataagtgctgtaaagggaactgatgtcatagtaaagagtaatggagtgggagggaacaggatggaacctattgaagagtggtccaaggaaggcctgtctggggagatgacatcggagcacagacctaaagggtgagaagaagccagtttgaggaagagttgggggaagagacatcaaggcaaaaggtacattgtgtgcaaaccttgaacacagtcagtatcagaatctaatatctaattttgcaaggtgagagggcattagcaatgcctacatggttgggaagaggttgcaaaaaaagtagactggactcacacacccaaaagtggctgtttataattgtacccaaggctggtgtggtgtaattagaggagcacaaaaggactcttcatgttcatccctcctggccccaaaccactctcttatcattctcaccaggtgcctgagattcttcttcgagttaaggcttcgaggacaggatgttcatagatgttatctacaaaggataacacattctaagccatttttggtgaacaacttggtttaaataagtgaatcaaatcagattagctagatacttattttatagcagaggaccacaagacccaaattggtagggaaagcaggttgagaaagaccttgaagagctctggtgagaaaaatcgagtgggaggaggtggagggggaatggcttgtctgtagctggggctccgtaagaattctgggtcccgaataacatgttttcttagatgaagagcaataggagtgggcttgtactaaaaataacccaaacaaagctgtaggctacctatataagtagattctcttaggactatgtatcatgcagtaaagccttggcttatgtggacaatgagaagcaatcccgaaggtgatctgggtttcaaaacataagagcaacatggaaaacttcagaatgtttagcgaagagcattgatgatgattaaaggcttgtaaaattgaacctatgaggataagttgaaagacttgggatcgtttagcttcaagaagaggagactgaaaaatgacttaataacagactcaaaattatgagagttattaagctatgtatggtgaccagctgttttgtttctggcaaggtcagagaaagaataggtttcaactgaattaggttagatttaaagaagaacttcttgactataagaattgttaaatagtacaggttgctgaaggatgagggcttgaatggagggcttttcaaataccttccattttagtgattctctgtgtgtttataaagtgcaacaaagtgccacctttctgctttcaaaatcaaaggcatgatttctgttttccattataattctgaagctcagactcgcagaggtttgtggacataaataatgagggtaatttgtcttgactctgtggccattagaatctttaattgagaaaaatatgaccaaaaagagaaacagatctgccatatgatcaaaaaattgttactgataatcagaataggtgcattattaattttggactgagggggataatgttttattgttagaaaaacccacgttcatttgatttgtatattccagatagaaaaggtagggggctttatgaaattgattcatttttgtctgttcctccctatggggagaaattaaaaacatttccaggtgacaccaaagttcgtataacctggagcttgagtgatgcaatccaaaaatcaacctcaaggaatttattgtcacagggaaggaaacagagaggaaataggcaggatttatttctgaaaacagaaaccttcatgcatttaaagactggcagagaagtgaagttgagcagagcaagtctgagaaaggctggctgaacacaccattcctttcagctttggagctggagctgcaggaaagaaagagccctgttttcagggttaacttttcttggagaagccaagcatcagagtttgtatttttaagtttattttttaattcattcttttgcttattaaatacctgtctgagcaacttttgtaataattaattagtacacctgcacatggtttgctttaagcactcactgatagctcattgatgaaacgatgagaaacaaagcatgtacacacacacacagacacacacatgcacacgagcacagtgttttagatgagttcttgttttgaactaagtgcatacaattttctctaagggaaaaaaataatcaagagaccaaagaaacagacttcgaaacaggtgacacaacaaggaagaaggctgagtgggtgtggtgccaggctaggggaaaggaaaaatactcagaaagcctatttttctttcctcccaaaataacttgggctccatggctcattaagaacatttagacccttagccactacactttacccttccaaagcaccatcactggtggagaaccacccacagttgaagatgggtcagaagtcacaacttgctttcttccactgccctcctttcttcattgtccatgacattttcttagtggtccttggcacttctgatgtccttcttatgatttttacatttgggtctcccccacctctccccccaagatgatttattttcaaacctcttctaaagatttgtaaaagctacagctgtctcttcatgggaaaagccaacctaaaggggattagtggccctccttttttgctgtgaggccacaggattgatagtgggaaggaaaatcagctggagagaggtttggtttcctcctgttgtttatctttataaaaaagaaccctcttctcaaacacgttgctataggaaaggtctcttcattacctatgtggggacagtggagggccagttccatattttctgcagtaactgaggctggctctgttttcctgaggaataagctgtgaaactgaggatatactaggttatctgaagcaacagaacacccactggtatacccacaaaaagtgtttgattatctgttctcccctgaggactttacttaagacttataaaccagtctccctttccttaagaggtactgtgatagagacagagtgagagctttcagtggtcagggctttctagaaggctggacacatggccatgataatgcctaaagcacaatcaagaaggatggaggcttttatgaaggtcttgagattcaaagggaacaaaagtggatggtttggagagtgtgtcagtgaaggtcctgtgctttgatcatgtctcaggagattccccacattgactctctttgggtatttatgaaagtctacattgttggcacagatctgatatagcaaggaaatttgctggggccagggatccaagagtttttggattgtataattaggaaagcattgatggtccaaaacgcaggatgaacattcattttattttttacagaacatatttttgtcccctttctgtatattatatattggttctatattttgtgagacctggtgcagcagttccttggtagagccaaatagcctgaatgaagagaaggagagatgcctcttcctttgctttcattctagattgtgttggagctatgctgaggatggtgaatagagaaactgattgtagttaatttgtcacctcgtagcccagtggtagcatttgaatggaagtaagttaatggaaaaggactttgcaagacataccagccccaaccactcattcttgctgagggtcaacccactgtcagatataggtggagaagcccttctgtggtatggaggcaccatttctttattctcttgttaggaaaactgaaatataaataaataaaaatttgcaactgaattggaaaaaatctgacactgaaggatgaaatgtagctttcgtagcatgagatttgtggcacaaactgaccagaggaaggaaatctgatgatctagatagatgcctttggttattaccacttttgctaaatgcctctctgctaagaactcaacaggatgagtcatctcttagctgtaaacaaaaacttttatggggaagggagaaatccttgtgtttgaaggaataggtggcatttccggctaatttataaatgtctcctttcattcctttctaaattgggacaaattgctccaaaaagtctatcagaagattatgtatgtatgtaggtatttatctatgtatgtgtgtgtgtatgtacttttgttacagcaatgaggtcctccagctgaaccatagctgagttctattcctacttctattcctggtgctatttggtcagttcttagaatggattttgatagttttcacttcaggaaaacacagtctcaggccgggcatgctggctcatgcctgtaatcccagtactttgggaggctgaggcaggtggatcacttgaggtcaggagttcgagaccagccttgccaacatagtgaaaccccgtctctactaaaaatataaaaatttgctgggcatggtggcaggcgactgtagtcccaactacttaggaggttgaggcaggagaatcgcttgaacctgggaggtggaggctgcagtgagccgagatcgtgccattgcactccagcctgggcgacagtgagactttgggaagaaaaaaaagaaaagaaaacatagtctcaccgttctcctccacataaatgtggccaggctgttggaaagctcgtggtttagaaattatttaaaacaactgcgttagaaaatattatttgtacaatagcatcttaaatcccaagacctctatacaacttacaaagtaactgtagaaattcagggaaattcttcttttttaagttttatttcatttttaattgacaaataattatattccagtaaaattctaatgttgatatttagatgcttttgttcttggtgagcttggtaattaaaagaaggtaattttaggaaagaaaatcagctttaataacgtatccatattgtttatttctacgttaattgagcaaacatttgcaccatggctgctctgtccagggcttttgagaatgctaagtgctgctgaaataactttgagagtctaacttgaaagggcctccagcagaattgagtataaacccgagattagcacccgtaaaggtccataaagggcttaatttgtagtccttttatttatctttagcacagtgtgaagtgtgatggactagggtggaaggtgaaggagcaaggtaaagagagactcccgtgacaatcagcaatacgcctttaagttcattgggctttgcttatctttactaagccatcttttcttcttagagaaactgcaattattattggtcacaagaaatgaatattctcatgtaccttacaggatttgtttatcctgttagtctttaatagcattgtagataaatgccctgccattgtagagaggtaatcatacttttagtttttgataatttagattatgtggaaaaaattctgttttggtgaaaatacgacattgttaggactagtaacaaaagcatatatatgatgctcagtgctgccaattatttctttttacatttgaaataacatttacttaatttaattagtatacaggaagatctgttgtaaacatttcagaaaattcagaaagcattgaaaaaaaggtaaaaagtcatttgaaactcaacaccaaagataatctcagttaatattttgacataattccttttactactttttcctaaatgtatttgtatgtatgaatatatattcacatatactttttattttatacatttttgcattttctaaactgattttattttttaattattcaaaggaattgactgacctataccctgagtcttaatcgcaaaatggtaaatcctgttcgattaaaaatgaacattttgaaaattgatttacaaaaattggtataaaatctattcctttaaaaacattacagcccactgcattattttctgatatggttgcctgcctcagaagacaactcatatgaagtgtacattcttctccttgcttttcttcttgtctcttttttccttttatctctgttctgttttataggtgctcacaagatgtttggtatgctaatcgaataagaatatgctatgttgggcactctaagcatgctttgagggtctcttgggtttcctcttcagacttcctcaaggctccatctctttatgtcatcttttggagtggcttatgtataccttagcaaaggatgctcagacctgccctatgggctgggttttcagaaaataatatattctgtatttgcatagcatacaaagtttgtaataacattgatgacttcacaacaactctgtaaagcagacagagaagatgccctttttcaagtgataaagaaggctggagaaattagagaacttgcccaggatcacacatctgtgttgaacatttcatatttgaaattggttagtatgattcaaatcaaattcaagttgaaaaaaggttcctgctgtgaatttgaagaaaaatgtgtaagatgtcactattttaccacatccaaaataatttcagattactctaactagaagctagccaatttttatatgcatttttttgggaggagggggcaaaagtaagtaggaatcagatacatgtgaagaaaaaaaaattcaaatcaattttgggggttacatagttgtagtttttgttctgaattgctctggtggaggatcaaagaaaagcagaattaatggagaaaaagagatatgtagaaaaaaagaaaacattgcctttttagtgtagcagcttgttcattactaaggatggaagggaaaggtaatgcttaacctttcccaacagaagaaggctgcaagtcagggcagggatggctgaatcagcaggtaaggtagttcttttttcctcctggaccatctccataggagatagggtgactggagaagggaaggtggaaggaagatcccatgtcagacaatgctttttcctatttttggaattctagaaacatgaaagatgagaggatgtagatttgaagactctaaaaatcctgaaaagtataacattttcagttcataagtatatctggaaaagaagaagcattcttcttggcacatgctttgccttaagctactaaaagtctacctgaaaatgcaatttgaattattattattttttattcaacgcttgtaaaaactaaagcagcctttctagtgtgacttttgacatcaaggaggctaagtgaagtagagaaaagtaggagactaggttggggaggctggcccatagaacaaagtagaagaaataagccagggcaatggcagcttggctgatgagagcctgggactgagtggaaaaacatagaggcccagtcagccattgtggttaaaagctttgtgaaaagtgtgcagaggtggctctaaaatgcatttgtctggttaatatgacaaggaagctcacaggcatatgaaggtttaacaggcaatgaaggctctctgacagtctatatgggatctaatcaaatgcaatgataaattctgggataggattttttttttttttttttttttgacagagtttcactcttgttgcctagcctggaggctggagtgcaatggcgcgatctcagctcactgcagcctccgcctcctgggttcaagagattctcctgcctcagcctcctgagtagctgggattacaggtgcctgccaccatgcctggctaatttttgtatttttagtagggacggggtttccccatgttggtcaggctggtctcaaactcccgacctcaggtgatccacccacctcagcctcccaaagtgctgggattacaggcatgagccaccgtgcccggcttggggtaggaaattaaaaacaaaaacagtgccaacttttaggcaatgaagagtatttgttaagcatcttacattcttgatgaaactacctagagtctgtgtttcacttttgtaacattgagaaatcagatagaaatattgggttactaaggaatcagctgtgacaattttgataaactatacatttattccgtgtcaccaatgtgttaactggcaaatacattatgatctccttcagtttctaatcctttttgccaagtaaataaattaaatcaacaataaaattttgattatttttcctctctggtataagacatttcagtaaaaatatatgaaaaataaactgcgaatggaatcttccagttagctgaatggacctttcaaggttcatatattcattctacataaaactcatatgtaataatctgtggcaggagggaaaaagtggctctaagtatgatctggaaacatacagaacctcttgactccttcaaattcctgaggtgctcttttgttaatgtctctggtttcagagggcaaatgttatggatgcaaaacctcaaggtccacaatctgtcctcttggaaaaaacttgccaacagaaatgcgtagctgtattctctgtttctaaaacctgacagtaacctgaagctttgagccacttgccttcttccttcccctctcctgattaatttccttttccctgtgtgtatgtgacattaagcagcccttatttctgtctggatttcttgacatcccatattctctctttagtctcaacccttactcttctttcagttgaatttactttagcttgggttcttgccataaagaaccccagagcttgacatgtttatagttatttgtacacattcttatggtcacatacatcatgatcttccattttcagtatcaaaaaccgtattcccacagagcagagatataacagttaattttctttgtaaaaatcatagaattacctaaaaataactgaatatacttgaattgctgaatatacttgaaattctgatcctgcttttctctacgttgctcacatcaaccaggcagccacagtatttactgagcacctgctgtgtgcctacaagtatgccagctacacacaagtttggaatataaggcacaaagttttactttggaagaattaaaatatggtcctggagatagtgctataattaataaacaattagatggcactgtgtattcaattcggctatcacatgttcattctttcaacaagtgtttattgagccctgccatatgacagacattcttctatgtgttaggaatatagcctttaacaaaatgtacaaaattgtttccctcttggaacttgtgttctattgaaagagggagacaataagcaaacaaatgaatatatataatatgcaaatatgcagatagtgataagtactttaaagaaaaaagaaccagggtaaggggacagagggagggaggtggatgatttttcatgtaggtcagtcaggccttgctgatggggcaacatttgagcggaggcttgaattaaatagggagcgagccatctatcaatatctaggtagcagaatgtcaagagcaaaggcattgaggcccagctctttggcatggttatgggatagcaagcaggccagtgtggctgcagcagagtgagtgaatgggaaagtggtatgacatgaggccacagagatagttgggggcagagaatggtgcgtggaaggcacagatcaagtaggagctagaccatgagttggccttcaggctctaggtcaaatctggtgtggtatttaaagtcataggactggaataaataattttagatagagaagagggccaaggacagatccctgggggtaattctcaacattggaaatagggattaggaagaggagccaatgtgggaccctgagtaggtacaaccagtgagataggaagagtcccaaagaatgtggtattcaggcagcaaaggactctgttcaagaagaatgtcaccaactgtgtcaaattttgctgaccaaggactgtcattgagtttggcggtgtggaaggcattgatgatcttggcaaaaaagatgtcagtgcaaggatagattcaaaagatcatttgttgaaaattaagagaaatggaggctaggaggtgagtacaatgaatttagaaagtgaacacactttcaggatgtttaaagggagcagggaaatggggcagtaaccggaaggggatatggcataatggagctcttgtgctgaactgttaagaacgagtgacccttgagctgggtttggtggcatgcacctgtagtcccatctacttgggaggctgaggcaggaggatcacttgaggccaggagttcgaggctgtcatgtgctatgattgcacttgttaatagccactgcactccagcctgggcagtatagcaagaccccaactcttaaaaaaaaaaagagtgagtgacccttgacaaaccactttgtctctcagagccttggcatcttcagcagaaaaatagaaatataataacacctacctataatggttattttagaggatagtgtatagtaaaattttgtcatttgtaaaatgcaacataaatgtaaaagtcatactatccttagcgtgtaatagaaattttgaaagaaagacaagatcacttggaggaaattaggtcctgaagaaaatggttatgatggattaggtggactgaaggcatgtgttacaggcacagggaagggaaagaccagggaatgtgaagaagtaagaacagctggtttggaacagaggatgaatgttggggagaagaggaaaatcacattgaataggtagaatcaggctaatgatgcagggctgtaaaagctattcagaaaagtctcagttaatggagcaggcagtagggtggcctcatgaactccccaacaagatagttgaagggagggctttggattgccacctgacagggaattacagggactggatccattctacctctgtccacagaagtgctccagtgttgtgaagcaacagagatattttgatttggtggggaaaacaagaggaaccaaatataaggaagacgtagaagggaagggatgtatagaggcaaagaagccagctggaaaagtactcgcacaaccccagtgtgatgagacccaggaaatatatatgccatttaaagtcagtatcaacatcatggagaaggaaagtgcaaaaggaaggaatgtcttaagatggggaaacactcatgaaatgagtctgaagtcaatcgacaagaatattaagcacctactatgtaccattgctgttcttggcactagtctgggcactcttctaagctctgttctaagcatggactacaaacatgcttaagggcaggaaatgtgtgggaggaagccaaatagtgatagaatgaggcttactattttttttttttgttttttgagggattaggtccattagattttgtatttcttcggtgcctactacataatttgctaagtgaattaatgatttttattaaatgaattatcgatattaattggttgctgcaacttttttttaaatgtgatttgacaatataaattactagctttaaaaatgttcccagggcagctgtggctagaacacatgaccagatttggcttgtccagctgctaaagaattctgtcaaatataagccccccagccattcgtgtgaccctcatacaaacaaataataaaaaagacattcagataaataaagcaaaatgtacagagaaaccctgattaaaaataaagagagaaaaaagaggttccattcctgacagtctgctttaaggaaattgccttaaatacatgaaaggatttagaatcaatgaggtgcactgcagttatttatatccatatgttaagcaacccatgtttctacttctaattcagtgaaagtgctgcttggatcctttccagggaaataagaagggggcggcattggtactccaccgtttactcaacattaagctgatggggtatgacagttctgctattgcttctcattgacatcgatagtcttataggtcttatgtgtatctgtgggagggatgtataagaagaccacagaacattgtacctggagatttaggtgagaataaacagatacatgaataaatgagctctcaaactggctgaaaacaaaccttaagcatgaaataatgtgcttactaatttctgaactgtagttttgaataattcgtcagggctaggactctggttttaatgatttgtgtggtgaaaatatgccactattcacaatagagtttttaaaacagtatatttgtaattgatgttgttaaaatgacggacttgggtttgggttttaaagcacatgttcagtggttaagattaatttctagcaatggttttggaggttgaaatcaaagtgtgtacaaaagtaaacagttccctttcagagcaaataatttgaacttgaatgaaacttaagcaagtgagcatcaattgcaagttaattttgacatggatgtctggaaggcatcatcaattaccacagtgagtcgtagtgtagtattgtccctctgtgctcatgtgagtaaaggaacaagttgcttgtctaaccccagagttctgctggctgggcagaacctgaggctgaagttgtccccatctggccctatgtgaaggatgcatacagtggcacaggcacctttacagaccagcagccacttgggtatctgacctgaaaggagcacatcgcaggcagtttctctttctaccaaatattgatcaatgacttttaaaaagaaggagtctttaccaaatggtttagttcctgggtcacttttctttttggtcttgtaagcacaggaaataaaatacatgctgatactttccaatggaaataaaatgcataccattactctccaacagaaataaaatctttccatacagaaacaagaggaaaagtctgtacaaggaggcatttatatcatcctcaggcatattaaaaacagaatgaattgactaagacatcaaatattaaagtaatgttataaggtggaccatatgctaaatagactgccattaaggcattttaggtgaccttattattccaaaacaaggagatattttctttctagctggggagaaaaattctttccaactttagtctttatttcatttggtgtatgctggtttttttccttttgtcttgccagtagaactaaaactgatggattttctcagtgtaagtatgataatgtaaagcaaagaaatctatacagcgatactcaaatttgtttaaatgcttttttaaaaaaaatgaattctccctccttttatttttgttccctttttctttcagtttacttttccctggaaagaatagggtatctcagtttattcattattctgggtcagctttgagacagtacagtgagggatttgcatccagatctttactttgtcttggaaatacacatattaatggaaatgtttctatcttcattaatttgtgagataagactaatttgacaatgagttggactcattgtggactgtgtttgaaattagaaaaatgttcacaacatcagccgggcacggtggctcacgcctgtaatcccagcacattgggaggctgaggcaggtgaatcacgaggtcaggagatcgagaccatcctggttaacacagtgaaaccccgtccctactaaaaatacaaaaaattagccaggcgtggtggcaggtgcctgtagtcccagctactcaggaggctgaggcaggagaatggcgtgaacccgggaggtggagcttgcagtgagccgagatcacgcccctgcattccagcctgggcgacagagcgagactccgtctaaaaaaaaaaaaaatgtttacaacatcagagacagtttggctcctaagtgatcatttattggttctctgtgtatcagggactgtgtcttttcacccttatgtgcaaggtcccagcccagtatctgtcaggtagtagttaacagtaaagttttcaaatgaataagtgaactgttaattgattgctaaacccaagacatttataccctaaatataaacttttttttttctttttagtgatgatgggctagaatgatgacatgagaataatgtaaagtgaaatacaaatcctttacttctttttgataagtgtcagcattctaaaactctatctacagtggcccttgggttgcatgagctgcttcaaaccagatttttctatctgttgctttactctctacagagctggaaaaaccagcttaggtcaatgtccgagcattatccaaaactcactttcttacagaaaacaaaggaatttcctctttcagaatctgtatatgattgagcagctaggtagcctgttcattcacttttctcattttaccctaatgaatattttcctatcagtcacatcagaagctgtcattttcataaccataggtatttaactgtgccttggtaggatttaagctttttaaagttgtctggacaaaccctctggtgggtgtgaatcacaatatctcttgatgcacagtgggattgtggcagctgcttaagtgtctggaacatttatctatcatatggccagttcactgctttcaaacacaaggaaactctgggagtggtgctgattcttgagtatatacaagatttgccatcttttgagccttataagaaaaaatgtttataagctggggaaatactttagaatttatatgtgactctttcttttgtctctgccatggttccttataaatcactcggtggctcagggagagcagtatgcttctgaaataaggttacctgctttttgatgtatttataagccttggccaatccatccatttcttgtaggcattccatagatactctgaaaactccaagttcctgttataatcccagaggatctttcagagacattgctcagcaagatcatctaagggcagtgaaatggaaatatgacaactcttatttcatccttctgaaatattaatccttcatggttaattatatgatattttgagggtgttctgcctggataataaatattattggtcaagagtcctattctcaaaggactctaattttagtactatgcataccttatataataaatattaatatttaattaatctgaacaagtataaacttttcagttaattaaaaagtggccttgtctagttgatatggtcatatggtcatatgatgttttagaaatttgccttctggtctgtatctgtaggaacttgatgaaaactacttaatttttctgtttttatttttatttttttctttttggttttttttttttagacaagatctcatttcaattgcccaggctggagttcagaagtacaattttggctcactgaagcctctaggctcaggtgattctcccacctcagcctcttgagtagctgggactacaggcacataccaccacgcctggctaatttttttttttttttgtatctttagtggagacagggtttcaccatgttgcccaggctggtttcgaactgctggacgcaagcaatacacccaccttggcctctcaaatttctgggattataggcgtgagcgactgtaccccgccctacttcttttttctatgccttagttccatgcctgctaaattgcagcagtagctctaatcttgagatgttaagaaaactaaaaataggccgagtgcagtggctcatgcctgtaatcccagcactttgggaagccgaggcgggcggatcacttgaggcggggagttcgagaccaacctggccaacatggtgaaatcctatctctactaaaaatacaaaaaaattagccgagtgtggtgggcgcctgtaatcctagctactcaggaggctgaggcaggagaatcgcttgaaccagggaggctgaggttgcagtgagccgagatcccgccattgcactccagcctgggcaacaagagtgaaactccgtcttaaaaaaaaaaagaaaactaaaaataataactaatattataaagtatttacgataaccctctgaggtactagtgtgatttcaatttaaatgtgaagaaaaaaatggggagaagttaggtagtgtgcccaagtcctcaaacccagtgacctgcagagtcaggattggaatccagcatcaacatccaagcctgagcccttgccaggctacaatacagctcccagtctggttgtgtgatgatctttcaggtctccaagaagggtggccaggatggcattgacatctcttcacaggtggccttggtgagagaccttccagtattctaatgctgtgtagtttttagtaggattccagtaggagtacgtaatttatcttttcccctctttctgtctcctggagagataaatcctatttccattaaacagatttttgttaggaatgcttcatttcttaaccagtgtaatttgtatgcctgagtagctcatcatagaaccttagagttgtaacaaaggctgctttgattcagttcatttattcgacagataagaaactgacaaacaattcctgcaatgctttaatatttatttggtcagattgtgctaaaacatccctttcctttcttactcttttgagatgatattttatttttcttgctcctaaccaccaaacttctggaaagagtcacttagacttgtcgccttcatttcctcattgcctactcacgctgagcctcctgcagtctggcttctgctcccacggcttgactgttgtcttgaaggttgcttagccatggtccatgccttactctggccgactttcagtcctcatgatccttggcctctttgcaggtataatcctgttggtgaccccttctgcctccatccttggtctcttccatatcatattctaattttctcctgcctgtatgactggtcctctttctcttttgctttatcttttatttatttatttatttacttttattttttgagacgaagtctccctctgtcgctcaggctggagtgcagtggcgtgatctcagctgactgcaacctctgcctcccgggttcaagcgattcacctacctcagcctcccaagtaactgggactacagacgcacaccaccacacctggctaatttgtgtatttttagtagaggtggggtttcactatgttggccaggctggtctcgaactcctgacctcaagtgatccacctgcttcggcctcccaaagtgttgggattataggcatgaaacactgcaccaggcctgctttatcttttagaaccgccacccccaccgcccccagccactcatctacctcctacaagtggacaaatggacattgccaaaagttctgacttggctttcctttcttcctgtttccttgcttgctcatcaaagacactatcatgtgagcagtcaccttgacttaatgaacaactcccaaatctttatctttcattctagccgtcttcaatgtcccatctcccttatgcctaaaactaatgccacaaaatccttttgatctttaaataatatatctctgtaaaaactaacctttccttaccttaatatagggaattgtagtgattaccaattattcttctagctaccagcctctttctccttaaagttcttttcatgcagtgctgtaactcagttttcctcgatctcagctttgatcatgtcaacctgaggccttcatgttgtgaaactctctgtggtgccccacatgctactcaaccaagtacaggcttctcaggctgtttccctatgcccagaataacttagcccagtcttatcattacaactgcagtcactttcttacacacattttagccccgtacttctcaaatgtattagggccaacacctcctttttgtaacgaatactcaataatctctctttactatcctcaatgaaatctgtagattttctaaatatatccacacaatttctgaaagatcactctgatgccattaccatagtataaaagaaaaataaaggaacctaatttaaaacaaaattatattcatatattttaatatctaaatacttagagaacatgctagaaaacacaatgaactagccagcttcttgaacatgtgtaaaaccaccttgaatatgacagctacaaatcaagattgatgcaggtgcatattagtaactcaaacactaagaatgatgttactgttagtgaagattttctgaaatgtagagcaactcttgttgaagctcctaatgaaacaaaatatgctttgtctttggtttctagatggttttattcctagaaaacccaatgtgttaaaactttagggaaaaaaatccctttatatttaagtagaactaggttctaggctcaggtaattataaccagattttttttcacctacttgaatgtctggtgtatgtcccaaaagtcatgaggaatgtggaaaaacttttcattctgtaggactgtcccattgcaggacaactggcatcattagcctatgcccaccagattacagctgcacacccccaatcatgtaacaatcaaaactgcctccacatatttcccaaactcccaaggagtttgtactacctgagctgagaaccactgctttagccaaactgctctcactgttggtgaacatgccttgccttttcccaattgcacatctcttttcatgtggcaccttttgatttgaatatatttctttcatttctgccttttgaaattttatctctttagcttgaatggcatacaccccattaaattttccttcagtctaaaattttgcagcatccagatgtggcacttagaattcttaaaacatactgcttcatgttagttatttgtgtacagctattacctaccagcttgtaaggtccttggggatatagaccctttatgttatttacatgttataagaggttatattccccagtgtttctattaatagcaaagtgtcttgcacatagtaggtgcccagtgaatgtttatcgggtaaatgaatggttaattttaaaagaatatttgtaaagaaaaaagaaaaggttggtttttattttaacatttaaaacttacttttgtttttataacatttacattttatcctcatgtcataaacttctaatagtacaaaataatatcagaaaagcacatagcctataggcctatggtttggtctgtacacatacttatgaatatgtgtccactggaattattattaaagataagatcattctctacacatagcaagaaccagcattcaaacactgtagagaaaatacggagaaagtgcttctttttcattcaattctgaaatgtacagatcaaatcaacttgtgaagtcaattgggatgcctgtacaatttccctgttttctccctttattcaaaaacctcaaaaccactatgggtaattccctcaagatctccttctaacacatagagtctaaagagtaagcgagatttccaagaactgaaagctttcaacttttttgagtatccctctccaatgacatgagctaggaaagcccagtgctcactccacccacctttcatctctaactagaggagcatcaagcatttgtgcagtctttcctgccatggcttcattttctgtcatcttaactccgtcacgaaccctcagcctcctaacaatatccatatgaaagaaatcagacccctttgacaatgaaaaacacatttaagctactgcacacactatcgccactggaaaagtagatattttttctgccaatccaactgcagtactctggcaatgtgtagttttcatggttgtgttttcatttattaaataattagtcgaaccataggtgctaatcaacaaaagttcgttactatttacaagaagaaacttaacagctctttgtttataattttttctgaagtaggaagtatttgtctttgaatgtagagaccatgtaaagtgatccaagaaaatgatatggccaaatgacatgattaattttcattactttctttccatctcttgcctcagatgcatttgagcctcgcccagagcccagcttgatagaaaaatgccagacttgggttgaatcagtcaattaaaaaccagctcttcttgtagtttgagagacacaatggagtataaagatgtactctgccttcaaggattttacgtagaactgggaagttaagcatctgccagaggagattacaaagaagtgtatgataaatgtcacatgagtgatacagacaagagtaccacagatttgggggatgagatcactgtggaccctgatactcagaaaaagcaacctggcctccatgtgagtccaagattgtcttttgatcagattgtcctttctttggtaccggaaatacttctcctggtctctatgaggttttcccttgggactcagaaactgtgcctttttgtagcaccatggttgggcattaaaatgtctcactaacaggcctgtttccccttgtaatatatttctctgaagacatgcctcaaactcttgtagctcttatacttgttagctcaagactctggcgagtcctgtggcttttgtgagggcaaaaaagtttccatagaaattaaactgattcattttaacccatttcctctaccactctgtcccagagaaattggcttagactttgtggattcaaggccccaaatttgagatttgacaaaagcttacataataatggcattgtgggaataataacggtatagcttttcagttttgctagttagagccaagatgatagaaagccaacccaggagccatcttgggacgtggacacttgggggttgggaatgggggtggaaaattactaccgcattttttcccattctttttagcaaaggtgcctcaacttttaaatttgataaagtgatttccactcattgatgtcaccagatttgttacattaaaaagtaggtccagaacaaataagttcctggttgtaaggagtgtgtatgacttcctaacaaagtgctagcgtttgggagatatttatggatataagtcagggaatcatcctctttctaagttcctgaaaagcagggtgttttgtgcatattttttcctgtgcatgtagaactcaagtggtacctacatccctcgccccagacattttctttctttctttttttttttttttgagatggagtctcgctgtgtcgcccaggctggagtgtggtggcgcgatctcggctcactgcaagctccgcctcccaggttcatgccattctcctgcctcagcctccccagcagctgggactacaggcgcccaccaccacgcccagctaattttttgtatttttaatagagatggggtttcaccttgttagccaggatggtcttgatctcctgacctcgtcctcctcggcctcccaaagtgctgggattacaggcgtgagccaccgctgcccggccaacattttcaaagctatttaaataggataatcatgaagacagtgtcctattattccatcaaaatcggaagttaggtattgtctattaatggttaatttctcagatttaccttccttttctctattaagcgctgagtttttcctttgaagggcatatagtagaggctggtcttttttctttgatagagccctgtttttgttttactgttttaaccagtatactattaaagttaaactttgatactgcttatgctttaagaaaataaatctgatgaatgaaggtaagtgggttcttggttcttcttttttttaatttaagaaaattaactgaagcttgtttgatagtaattctcatgcacgactaggccattttttaattgtttctgtttttaagaaatttcaagatttttagtttattttttatctaaatagtcccctggattgttaaaaacaaaatagccttagtgctgcctggtgcaaaaactagatgtaaaggtattactggaaaggaaagtgagcagagggctttctctacccaataagtaagcagacatcagaaacggatagcaaaagtgagaaacaaaatttaagtctgggtgtcaggaacaaaggcaaagtttcagtcagatgtatatgatgttggaattacattcccctctcccccagaaagaacatccttaggttttctcccattctgccaaatattccctcctaggctttcgatatgttctgcaggccacacacacaggagcggggctgtctgtcactgaacccagatgcccagctgtggaagatattctttcagcagcatccgtctgtttcttggcaggacttttaggcagtctaaagaaaacagtcccggagcagcctttgggcctgccttgtggttaatactgtgctggcttgtatctggttcctgctctgaccctgtggcctggacactgctttccttatagtctttgtctctgtctctctcttttaaagagtattcgtgattttggttcgatttagtgaaacacccgtggacatctagagaaactgtaattttttttgcttgtttctgtattgattcaaagagaggtgggtgggtattagaaagcaaagatcttatgggaggaaaagggtatctttctgcaatgggccaagtatgttggcaaaataaaagcctgttttcaccagttcattttcaagctcaataatctttagtcgtctgaaagggagaaccagttcatttcatacccagctagtgtaataaaattgagattcaggggcaacctggtgtgagttagcatatttgttcttaagggaatattcttaggcttaaagggtggtctttcttgaaagaacctatttatagtggtattccttggttttaatttttatttaatccgcctttgtgttgttcagcctttgcgctgaaaggattttattttcctattctcttgattattttaaggttagcagttgaatgttgctagaatttacacaagggagtggttccccacaccccccagctccaccctcccccattcctcccacctgccaattgtgtctgaagtaatttcccagcagtgctgttgactttgggagatgtagtatttccagttcgtgtgtatgtgcgcgtgtatgtgtgtttgtgtgtatgtttgccttaatatctaactgataataagttgttacttaacttggaagatggacacatctctctccttttctttgacccactctgagaattaacatgtggtactcaaaggtgggggagcggtggcggcggtgttgccttatgcttgacgacaggtgctaatcttcaaggaaatttaccttacattccacccattaagggtatggtacataaaaatggcttaatgtctctttgaaggtgtcagcaggcatgtgtggaccacacagaatgggtttcactgaaagtaatagagtgaaattgtctgcataattattttcgttggattgagaatcagcagccctctttgggttcaggaaataaacctctgttaaaaccatatggcactattctcagaagagatgttattacagggccacttccctctgaaattttgagtcaggagttcttgaaaggagtcacatatgtgggaatgaatgtcaagttttcttcctcggtcatagttgtgaaagttagatgttttctttccgttttcacaaatgccaccatggtcaccaggtcctggaaagaagcaggctcagctgccgcagcaccgccacttcaggtgtaaatgtctgaattattatctgcgccaaatgattttgtctttaaaagaaaagaaaaattgcccttaatccagtgaaatatgatttgtcaaccctgaaaacacatcttaaggtcaggttaattgcattctgtctgtccaaacccttagtgcagatttagttggcttttctgttttctttttttttttttccctttgcccagcatcaggggctataaaactttctctgaactaatttgtcacagtgctattgtgccctagagataggtatagtagagtaaaaggtaaagtgaataaaagtttagtttgtataatggctagggaatatttgggaataaactaagttaggaaaagatattaaacaatggccaccatatttttatgttttatatatgtgtgtgtgtgtgtgtgtatttcagtagacaatacaatgtgtgcattgtgagaaatcattgtggattttatctttttttttgagaggagtgggcagtcttcctggttagtctttgctgtagaagaaatataaacaaaccatcgatgtttgttcacatctgttaataagcctgggatcttatcagagtctgtagagtttagtctggctgttggtaatgctggggagttgaaatgtccctttgagcatcagactctcggggagtacttaatagatgttgagtccagcttttcatttcttatcctagaggaagaaggcaaaataatccatgactgtgaatggttgagatggctttttctattgccttatttgtttttgtagtgagagctgcttttattaagtagaatggttgctagcacatagaacctttggtcactgaatcacactctgaattcaataatttatttattcaacaaacacttactgggtacctaccataggcactttaagaaagggctgtgggaattcagagatgatgactgagttctgacccatctctggcccatcacatgggctagaaagaagcttaatctccgggtgtggtggcacgtgcctgtaatcccagctactgaggaggctgaggcaggagagtcgcttgaacctgggaggtggaggctgcaatgagccaagattgcaccactgcactccagcctgggcgacagagtaagactccatcttaaaaaaaaaaaaaaaaaagaagcttaatctgttttaggagataagacatgggtattaataactatgattatgtgacagaaagtgatagaacatgagaaagggcataagaaagtggcaactggagtgacatggaagttcagaaacatttttacttctatttgagggtggaggggaggttttattgaagtcaaggcgtttgagctgaatcttgaagattagaaattagacttattggcagaaattcttggttataaaattctaggtagatagatgatgacttttaggagactaacactatatgtctttcactgtcttgtccctggctccatgtgcaggtatactgatggaaggtatggcatggagatataatatcacatgccttagtgctttagcttaggtggttccttccacctcagtggtgatctgctctattaatctagggcctattcaacattcagagctaattttaaatgccactttctctagtactttaacaattctgtcattttttagttctgtatttattgatctcccctactagagctgtaccactacaatatgataacgttttgcacattctagatattcaactgatatgattcagttgaacaaagtagatcaggtatctgaattagtcttttaaatacatattgaagtttgttttcagattagtgttaaggaataacaatttatacggtgaactggtacataaaattatagccctagggcctgatcttgaaatactagaaaataagcccattacaaaacgatgataatcatgttttttcaagggacattctaaattgttctagattttagcaacctctggtgttctgttttttatagggaaaagtaagaggtccaaaaatcttcaggccaacttggtggctcagactttctttctcaagcccttttatatgtgtttattagttaagtttgcagctctataaatgatatcatttgtactagttgcattggatccctgccatttctccatccataacagatggattctgttcttccattccactatacgttgctcagggtttgttactttctgatagacaacagaaatgagaatgcagaaatgggatggaaaagagggagtgagtctgttttattttgtttccatatttctcctaagcttactggagtggcaaatggtaggataagtggtcagctatactgccccatgagatttaaggagcctttggggaggaaggaaccttgctcagaagataggctggggaggatggttaattttggagattttgttgttgcttcatgttttcttttgatttccctcatctttgatgctgactctgatgttggctttccctatataatatttggacgagaacaaattttgcctactctctggcctgtgcaagtgacacgtacagagccattgtctgacttgtgacttggcccagaaagggctgattgtcatgcagttgggagggcttttagactgggtaaaaaattctcccatttgtttaaaataacatgactaagattgaactcagaagacactgtgcatgcatttcttttcaaattagtgttaagaaataaaagtttatactgcgacctggtatataaaattatagaccagtctagggctccattttgaaatattagaaaataatacatctttgtataagaatacctctaatagtatttagacatttttcccttctaaatctatctttccctttaaataatgaatatcattagaggtattcttatgcaaggatgtacaggaagcatttagaaatatgaatctgaagcttggtagaaactggaaatgcattttccatagtcataggaacttgaagccattgggattgatgaggctgcatgaggaatgggtatggaatgaatgaaggagagttatcctttttaccattgtgacctaactttgtgtcccttgcctggacacagacaaaggttctcttgctaagctcccctgggtccctgaagcagcagaagagcagattcagaaccgtttcagtggccactgcatgggttgtctccgccactggctcctcatctttctctttcctagatcactttttgtgttcctcttccttgcctagccaccctaggtgtgtttgcttctcagggttcccttttagacacttttctccactcgttctgtacccattccctgagtgtcctcattgacactattaacttcgtgttcccatgaccactgaaaatgcatcttcagtctcttctgaacttcagactggtatttctaggttgcttcctgggtgtctgcacctgaatatgtcccatgggtacttcaaactcatggccaacacagcgttagggattccccacctctacttcaaccaaacttctctgcccaaacatgaacctcctccagttttaccagttttgagtgccctacagttcacccaggtgaccaaaccagaaacctgagactcaccttctctgccttacttctgacatctaattattccactgtactgttgtctgtacctctattctatgtctcacattcactccctcaaatcttttagtgctgatttagcttagtatactctctcagtgtttatcttctgacttataacgtaaaaacaatttcctaactggttttatgtctctaactgcactcccttctaaatctatcttcccctgtaagtaaagcaatcttcctaaactgtaaaccaatgcatggcacacccttgcttaaaatacttcagtgtctccctgttatttgcaggatgaagttcagacttggtggcacactgacaaggcccttcagcatctgctctgcccaactgccttccacccacacacctgtggctgagctccagcgatgccaaattgcttcactctatactttctcatctcggtgtctttgcacctgctgttccttctggttggaatgttatcttcttctgcatttgcttgactaaattctactcattctttaagtctactcaaacgctgtctcctctgggagcccttcctgactgctcttgaaagtcaagtatttaatctttggctcctctttggtttccttttcatactttaattatattatttatcacactgctgtaattatttgtttttatgatgcctccagtataccgtgagcaccctagtttagcatagttcatgaaacataataatgcttaggatattttaattgataagtgaagattacatttgcatagtggttttacctgtgtaggacattttcacctcttattacattttgtcctgacgacatccctgtgttgtagatactttgtttttttctgacagatgaggaagttgagtcataggaggaaattgaatcatagagatgatagatatttgcctacagcctcacaactaacttagtagcagagctaggaatagactcccaagttttcctgctccttgtatagtcaggcccagaattagaaatgagattctcctttttaatcagacactgccttggtcttttaactattccattaagttcactaattgtgtgtaaatgtgtgtgtgtgtgtgtgtgtgtgtatttgtggaactcatagtgacaggtgaggaatccatagctttattgattcttaggattgcaaattaggtcacctgttattttacagatgagaaaattctgtacctgagaagttcacacttgctattagtagcagaacccatgtctcctttcagtcacatgttctctttcatactgcattttgggcagtcatcaattccataggacagactttttttttcttttcttttcttttctttttattttaagatggagtctctctgtcgcccaggctggagtgcagtggcaccatctcggctcactgcaacctccacctcctgggttcaagctgttctcctgcctcagcctccagagtagctgagattaaggtgcacgcaataggacagactttctgtgttgaattgcaagggttgttagtaggatttgttgagacattaggcaagttaaatcttgagaagagcccatcctctgagcagaaagaatgccattcctgagaacattctcaatgaaaggtccatgaaagagataggacccagaagagaaagaattaaatgataatattctttcagggattatcccattcttccagattgcattacttcttttccagtgagcttcataggttcttcggtatgtatcattttgaactaaaatgaaggcatctaattaggctgaaggatgagaacttcctattgcaaagaaaggtacgtttctattgcaaagaaaggtatgcttgtgatcagaagtgtttgtgatgtcatggggcagagtataaagcatgtggggccttgagaggacggtatccctaattacctggatagagacatggaactaatgttagtagtaacgctgttcctctggctggattattcctctctgtacacataggtatgcatataatagagataatataaatttataaccacatatatgtacgtatatgtggaaaagggaatatatttcatatggaccaaagaaaaacattttgccaaactgtcattattgattaaataattcagcatgaagccagcaggcagatatccacaaaacttaacactacacttgcttttgaaaaacaaaaaaaggttttaaatgtaatcgctcgaaggatgttttttaatattaacccacaccaacctgcttcctttggcttgagaataatacactttaaaaaaatctgttgtgccttgaaaagaagagtaaaacttgctatcttctaactccatttaacactacatttgattcctttttatataacgataacttgatcctactcaaaatacttggcacctttagtgacagagtggcatgtaagaacactttaacagatttgaatgtgagtaaactccagtagttctgaaatgaagaggtagagttttcagttccttattcagagttcacagaagataagaatactgggattaacacaatagactccccttcattacacctggctgaataaagcaattatctgtctatcaagactagcaacttgtgcaacagcattaagaaagagtggatggataggtggataaacgctattccattggaaagcggtgctgatatatgaggtaatcctttgagtttaacttgtaaaaacagttttattttggagtttatatcatgttactcttgcagcttagagagaaatgatttttcaaaatattgttgactgcatttttcagttctttacccatctgaattttattaggggggttatttcaaagacgtctcttgtttaatcatgtttaaacaatctgtttaagacctgttgtgtagatataaacacaatagtcctttaatgtcgtaaaacagacttctgacagacatagcacgtaacagacatgcatccattattgcttaagctgctgttccttccatgcctgacctgagagggtaaccacagagctcagctgaaagcgttcactggttagaagacactgacatgtgcctatgcactgtattaatgtctagcaagcagagaattgcagagcagcatacaattgaaaaggtcttagactagattaaaactaagtaccttaaatctgttttaatggctgtgtttacatctccttcttcttcattcctttaaaaaaagtaatcaggttttgcaggcgttaagaaaaccacctcttcttgccagctggactaggtccagtttaagcaagaaattctccgcctccttttttctgtctttttcttttttcttcctctgtgatcttctctgccattcagcacagcaagaccaggctgtgggagttggctgactttttctttggttattactttttaacattttcttcctgttacagaaatgagaaaattgagaatgatgttctgctgctgcagcagtgaatgtcaagagaggagccctttgcctttttaattacatctgtgtagtgtttctttttgcttaaaacactctgtctctctgtttctctgtctctgtctctgtctcactctctgtctcacataaaatatgcacaaaaccttaataatgaaagagaaatagaaaggatcgcatgctaaggaaattgagccaggatccaggaattgcgtgacagtctgtttgtaggctagttgtcactgcactctttgaagaataatgccatccatgtttagctggattggcaaataaacagtgatgctttttgttcaactacgaaaactgctatttccattgctaaaaatgttaccgctaaaaaaatctttgcatctctcagtggggtctctataagtgctcgaaacacaaagaactgtggtatgtgtgaacatgttacagaaaaagaaggcaaagaaaatgtttttggaactaaaacactcaagttttactaagttttggaagtaaagtgtagacatagagaaagagtttttttgttcatttcccataaagtcaagggagagataaagattcacatggtccaggatggtgtgaatgttcagttgtaattagtaggagaacaagtgataaaacggagtcagagagactgggcataatgtaataacatctttgaagtaagcttctgcactttttcttaatgtctccttctggtctctttgctccacgttttcttctttccctcagtggcagcctggtataggaaaaaggaggctcaggcagtttaggggactgcctcccagtgtcactgcctagttccatgactttaaagctagtctcagtatttttctgggcattaattatttctctaaaatgaagaacccagtctgatgaaatctatattctcttacaactctgaaaaatcctaattcatataattttactttgaattggagtaaggagggatggaagcatcccttggaaacaacaggcagacaaatttgagtagtaggtctgaaatgagaaaataccagtagagttgtaataaagaagcatagtaggttagaggtgtattaggacatgggagaggagctacggcgaagttagccggattcccggttagctctttttttcctgcctgcaaaaagtattacttctcatcttgtatatttccatgatgctttcatccaatctttttaaaaaattttttaatccttttttgcttcctacctcctatgaagtttctttttcttcagacgtctcaagtttttttagtccattatctgaagaaaagggattatactgtaagcacgtgtttattataatttatttcctgaagtttgactgatattggcgtagcctgataactgtcctttctcccagacactgtatgctttgattgttgtgattcgccacagcctaaaacctaaaagttataaaggaacttgcatttatagacattcaaattaacattgtacaattcttttatttatttatgaatttattcaaagatctcgaattcttcaatccttagaagcctaaattttgaaaggagcaggccttcacttctctctcacacacatctaattgtatttaaatatgactacatatgagattgagatagtgaactttatgtcactggtctaaatgggtgccttttagtattaaaagaaatcaaactcagcttttaacattttttctatgaaatggagtccctagaatatttctatggagtctatggtttaaccatgtaattatgtctcttgagtagattatatttttcttcccataattatgtttcacccaagagactggaaaggctttagacctgtcttgggtgaaattgttcttcctctcttctctcttgataaacgccgaatcttacgtgcctgactctgtttaagagctgaaaggggactcttgaagatatgtggtagtgattatgatttttttcctttagaaattggtttatgtattaagaagggcccttagagagaagctctgttagctcatttttgaaatgccatcagagaagaatcttctggaagcagatttgtttatgatctgtggtcctgtgtctgaagccacacactaacattgttctagggctgtctctactcacgagctatcctgtatcatattgcatggctattaatttccagcggctcaaagggctagaggccttaaacatgaagacagtttcttagcccatttcattattctagtccagaaatagtttctgacctgaatcagacagtgcactcttagggaaaaagatgacgcagcagcctttcccagcaaagattatagactcatcaattttactgtgggaaatgtttcccaataaccagcttttttttttctgtcttctttgtctttactggacaaaagtacagataattttaaatttatccatgttcttattttttaattcagcaatcatttgttgtgtgacttctctgtacctaggctccaagtttgtgctagacataaaatgtgacacccatccttaaggggctctcagtcaagtctaggaaaatctaaaatattagggtttgaaattttgtataaatattttatgtcaattcatagtaagtgaatgcttactggatgcctactgcacataagcataaccacatgtagtagacaaaacatagttgtcgctgctgtcagcttgctgggatataaatcagagggatcatcaaggctctcgagacaggaaacaccagaacaatgtgatgaccaagttgagcttggaagggattttgccaaacggagttgatgcggagagggtgttccaagtggaggggacagcttgagcaaaggcacagggtgtatttggactgtcgatagaccagtgtgagtagagcacaagctgggagcagtacagttgtagccattggaaatgagagtgacaacgcatattgcgaccatattttccaggtccttatttgctgggctcagggggctctatttaattcaatagacaatggaagacaattgaaaggttttgagcaggtaagtgacatgaatgttaggatttgggggcagaaagaatttcagaaattatggaaactaactcttcattttttggtagatgaggaagctaagaccaacagggttccattttggtgcccttccaaatatgccaggctgctactctgttgtattagccacaggccagaggttaggagggttctagtggaggcccattcctgaagaaactgtagaaatgggctggagtggatgatgggggtctaggaaaggaggtgacaaagatatgcctaagctggattttgagtctgagagactagaaaatgatgatgatgaaaataaggaaatcagaagagaagctggttgggatggtttgaggaggaagggaggggcaaagggcttaattaaacattacaagagtataggtctttgattcctagacattcacaaaccaccagtgaaatgtagtcatctgaacgtaaacagaggagcagactttcacttttctccgtagtatcttcatttttacatgtatgtaggaatgcagaaaatcaaagtttttaaatttagagcctcaatagttataataaagtatgtggatgagaactttgcgtggctttcctaagaatgtacttgagtctgggtaatcttccttgtgctattgcttttgctggaaaccatcgactgaactccctaagatacagtaaggctcatccttagaagtagaaatgcaacaattacatgtggaatgcaatcgtgactttaaaattagtcaacctgttccctaacgcttccctacaaacacactccttcatgtagcacttttaggatagattagaagtgaaggatctcattatttttttccaaaactgctgtggaatagcagctctgtggacatataaccaattttctctgagaaatagtaattctgatgcaagtcctctcctctcttcctttttactccagggatcattgtcacaacattctgaaactgttacatcctgtggcttgagccctagagtattggaccagactttattcaatcacatacttggtgacagcaaaattagctcatgtctccccagttacccctctcttccagtgaagtctgaatgcatggtggatgaggctcatggactgccaaagtatggttttattcattaagagagctgtctttttcctttcttttctttctttctttttttttttttttcttttttgagacggagttttgcacttgttgcccagtttctcacttgttgcagtggcttgatctcagctcaccgcaacctctgcctcctgtgttcaagcgattctcctgcctcagcctcccgagtagctgggattacaggcatgtgccatcacgcctggctaatttcatatttttagtagaaacggggtttctcaatgttggtcaggctggtctcgaactcccgacctcaggtgatctgctcgcctcggcctcccaaagtgttgggattacaggtgtgagccactgtgcctggctgagagctgtctttaaagggcagattcccataggtactgcatagcttagaagaattaatgtatagtagtaagactagagttataaagtggtttgaagaatggtgtgcgtctgtttagattgatatcacacacatatatagataagcgtatatatatgtgtgcatggatatgtatgtgtgtgtgtgtgtgtgtgtgtgtatatatatatatatatatacacatatttagcatcatcttatctcacaagatatttattatcaggttttcatcatttttcttccagctaactttccttgtttcttctctgcttatcaaaatcctagtcaaccttcaaggacaggcatcatgattttgtcagtgaggtttcctctttccccttagtcaaaatcaattgctcccctgcacttcctataatacttcaatactttttaaattttttattatgaaaaatttcaaacataaaaataaagattatattgaatacaatactatctacccatcaccttttatttattttttggcatatttcctcacctactattttgcccaaatattgtaaagcaaatactggttgccatgatatttaacccctaactatatgttagcccttctgaataagaaggacatttttctacataatcacagaaagtaccacttccttaatatttaaaaacagttcatattcagattttctcaattgatccgcaatcatggcattttagtgattgccctcaccacagcctctcttcagttatatttaattgctttcttccccactagactgtgaactccttgagggcaaggatattatcttatatatttttctatcctctcctcctcacaatacctagtgaggcttgcatgtagtagataaccagtacacattagctgcactaactgacccaaatatggacatggtactgcttccttattgatgctctattacagatcttcttttaaactttattttatttaaaaattatgttttcatgatacttaggatacaggtaaatacctagggaatttttaaaatcaagttaaaatactactccaaaaagatgagctgccaaacatcatgccctagtgatcagcaaaatgattctgctgtgccatattagggtagactgggcatcacatggcacactcttcatgaaaagtgccttgttttttgtaagtgcattttgacattcttcagggtgcgctgactggtgcagtgcatcaggttgtggatataatacagagaatgtaagtttctggctggggagccacgtagctctccgaagttgttaaatgtttctcaatcaactttcataaaaatgggcaaaatgggtcacatcacacagagtcaagtttactttcatagttcacagaccacattttcagagtcttcgtgtgccagtttcagatgtgtgatttttgaaagcagaagttataatggtagtattactaactttcattgtgggtagggcacaatggggtgattcgctagactatggcttagggacttaactgtttctcatttgtctttgctctaaggatgtgtgaatgctgtgaccttttgattatgctttcttcttgtgcccctgaatttattgcaacaaaagtcgtattcagctaaacacactcaactttttgaaagaaatcttttctggaaaccacttttttgtttttaattttaaattgatttttgatcatgatttcccctgaatgactgctgctgaactattatgagctgaaataagctggttggcaatgggagagaaaacagccccaggccagcaatcaggaaaactgagtctggtcctgccactaactatatgactttaggtaaggcatgtcccctctcagggactcagggtcctcatccataaaagaagcatgttactctaaactttagagtctaaatgatttctattgccctttcatctctctgattcccagtgactttcaacaatgcttaagaattacagtgaaagtgaatagggttttccagaaagaaagcaaatttttacttaaatgaatgtccttcagtaaaattttgtaggaagcaccagtaagggcttatctctagagaaaggttttgcccactagattcactagattgtcaaacaagaagaacttttttggggaaagaatatgatatatataatatgatgtcctggaccagaaaattttctttcactcaaggaatttatctaaaagaggagaatattcattcattcacttattgcataaatatttactgagcacccactctgtagcaggcactgaactaggttgtgagattatagctgtaaacaagacagagggctcattctcatgagacttacagtcttacaggagagacaaaaataaatacacaagataattatagattgtggtgactgccataaagaaaataaagagagggtgtgttcaagagggtgggaacctattttggttatgggaggcagacaaggcctctcataggaggtggtgttcattctgaggtctaaggggtaagaaagagtgggccctacaaggaatcaggggagagcacttcaggaatatggaaagctcttgagatgggaaactgaaaaggagacagattttcagctgcccagagagaaatgctagagtcttaggccaaggttatatcagtagaaatggagagaactgaatcgatttgagatatagcattcagaaagaaatggcaggactcggtaatggattgaatgtggagagtgagagataaggagaaatcaaggaaaatgtctaggcttttggcttaggaaactgagtggctagtgtcatttactgagatgggggactattagagagaaataggatttttttggaggggagaataaaaaattctgttttgaatatactgcatttaagatgcctttgggacatcccagggtagatgtcaagtaggcagtagaacacacaaacctggaactcaagacagaggtcagggctcaaccagaaaagggggagtcattgctataaataggtagtatttagtgcatgagactgagatcaccttgggcagtggttctcaatcctggctgcagattggatcatgtggtgaaatcttgaataaaagagaccttttccccaggtcccactatcagaaattctgatttaattgatctgatatggggcctggacatccatgtttcaaagctccctagggaattttcttattcagcaatgatggaaggattcagggagaaagttcagctagagaagggatccaggactgagcatttttacatagagtctcaagtataatacaggaattttccattcttcataccctcctcctgtttggaacatctactctttggcccgttggatgaggtttagtcctcactgcactatgacagagtaccctatccttgacttagtcagtgtgtccttggtcttccatgttcttaatttctgaaggaattgcttgggtgctggggatttaagtacaccttctttcagcccatcattcgagtgttaccctgatgtggtttagtggtaacaggtatttgtcatagttgaaatgtgaagaacttgtttggcttttgctcttcaatgtactttgttcttcaatgtacttcatacattatgaagagtgcattttgttgtggttgcagtggtgtctgtgaaggggcagatatctacaaagaaaaatgcgtatgtttttgtatgtgtgcatctgcagataaatgtttcctgaattattctagggtgcctgtagatacttggaagcgttctttgaagataatttccaaaagatcatgaagggttttaaaatttcacctgctttaaaatttttcacacttaccagtcctagcctaagtcctttatttttgcctgcaaactcttattactcctgaaaacgctgggctaagagaaagtaaaaatgtactcacacatgtacagtctgagctcacatctcatacagcctctaggaaaacctaatgaaaaggctatagaaagcagaggcaaagcttattaaattttcttgtgacccatggcccacgtaaagtcctagtgtataaaggaaccatgcaagatcatgtagccctcccctcagccctcagggaacctgccattccaaaaatatggcctattaagaaaaataacttccagggacaattccgtaagctttcttgttaatgtttacagctgtatcaacaccacaccaatactatgtgtgtgcatgtgtgtgtctgtgtgtgagtgtgaggaacagactccatggatctgtgacaagtactatataattccctaattgtgaaactagttagacccagcaagatgtattgatggaagtttggtgagttaggctacagccatttgtttagggtaatgggtgaattattaactttgtaattgaatccttgttgctacttctgcttatgttgaaagccagccttggcacctcactgggcttagttcttaggtgtttcactctatatgatctggatattttcagtcctccatagcagctggaagaggaagggaagagaaagctagaataccagcactgatggtgccacgtgatgaatggaaagctcagtcaacttggacgagggctatatcctcgtgaaggctcagctagtcggcagccgaggaccataagctagttgttctacctctgcaggcctcagtcacttcataggtgaacaccttacttgccagggtctaggagttgttttgggtcatctctaaaagtcctctagggatctaaaatctatttgtaatctggatacaaaacagtaatggtggggaaaacaaccattaacaatgaatttctctaatttttcctgttcatttttctcctaggtctagtccttctgttatagcagatgcccaaaaacttgcactggcaggaaatagggtggtgggtgcatttcagttaatgggcctagttggaacacgtttggccgtggagacagctacactcatattaccaagccttggcttcctatctgttttctttgggctgggaaggcaatgaaaaaggagacaggaaaatacattttggggcaaataaaataaggaatttgtcttacgaagacagcttatagttgggaaattctaatgttcaatttaaccctatcctgatacattcctcttgttctgtattaagtggaagctaaggcgtttgcgctacccatagagtagtgaaaaactcccaggcttgaaggcttttcataaaccttcttcaaggtttctttcttttatggataatattctaattcccttagtttctcttcaaggggcaaactcttaatcccatcatcatcttggtggttcttcctcgaatcagcttcagttacttaatagtcatactaaaatgttagggcagcaccctagggcctcactggcacagaatctggaggaaggaatccccagtccatttctgtttctctattagcattgcatttgtccccaatagcaccaccctatagatttactctactgtggtacacccagattcagatgcttttctgttatacttgcaccaagacactagtatgtcttttgttaagaatgatttgatgatttttaagaagtcttagtatcttggtttgttttaatttgtgcatttctctaatacccagaatttctttagcttttagacttgaataaactagaagagagatagaaaggctcccctcctccgccaaataatggattgtcacagtcacatgtttacttaaagagtgtatttcagcttcttttccaaaaccacagtagtggatttaaaataaaaaagcattctctctgatttaacagagtttattatacacattccagctttggcatatcacaaaatatccagattcctcttgagaatttgagtttccctgcttacatttctgtttttttatttcttaaaggggtttaggtttgagttttaattttccagaaaagagtcttagtaaagagtagttgtaacgttaaagaaaagtcactatggtcatcgtggaaatttccctttgacaaatgtgtttgtccgtgtctctgctccagctttgtgacattgtggctaacatgcacggactctctgaactttcagaggggatttcctccatcatgaaacaagcaaacacccccaatacacatctctcctgtttgttttttttttttttttttttttttactgagagggccagagaaggtgtctagtatcctgcctctctattgatgcttgacttcaagttgtcctctgagacctcagctctccatttataaaacagagctaggaatgctggccaccagataccgcttataaagcaatttgaaatggaaggcattatgtagacaagtcattataaatattaatattgataattccttggcttaaactcccagtttgtatgttcacatatctatttagcatggtcaattgttcagctaattaatatgcttttattttatgatttgctatttccagggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacaggtaagacagactcataggtttcacttgcatagacgctggcaggctgggggtgaggggctaccagaggagatgtgttcacttcaaaactcctggagctgtgaagcggcttattattaaagaatcaagacttgaagacactgatttcttcttttttattaaaaaaaataacattcaataacttggggataacattttgggggatatttctactaatgctctactctgcagcaatctcagtctacaccctggtggaacggtaataatgcactttgggagaatgtttattatacgtttctatattgtatccaggtggtgcaggggataacatcacacccttactattagaaaattagtgttaccctctcagatttgggcttacatttcttacatgtataactatttcattaagtctgcttgaaaattgcccagggcgaacaggaagccttgattggtagttataaggcaaggtcaatgtgtggctcatcgggcacacagaattcacttctgatttacatttagctctggttctccattagacatttctctttataaattctagtcagctacttactttacctttcttctgagaaattaacatcggcattacattacagactaatcattcacatttggtgcattaagacccccaactcttttctttttgtcccacttgtgcaaaaacagatttatttaaagactcgtttgaatgcttttaggtcatgatgacaagagagtgtattaattattataaatctttaatttgcagataaaagtattgagagctgaaaggaagtttacatgtcatctaattgctatcattggtagaggtggactagaatagagggaaagtaagtcaaaacaaaatgtgtaataagccctcaacatggatcttttttatggttagatttttgtttatagtagttaggctcgaatgttcttaatggtctcaaaacataattgtttataagcagaatgacctatctcttcttctctcctgcccatattatgtaaatgtattcttggatagttacttagagtaggtttcagtttctgtgagtgtatatattttagtcggaatgtatgagtttgcatgagtgtatattttaaaaaataatatagaattataaaaatcaaacatctaaacactaaagataaccagatatctgcattaaggaagaacattattgctctttgaagaatggccatgttttagactatataaaactttaatcattcatatgtggggttgaaaggtcaatgtgttcactagacatatgtccttgataaaaatacaagagtaaaattcacactaacttgtgaatttgaagcttgtagctatgggtgctgctgcatttaaagtagtggacttagagactacaaaagatgggagagtgggggggcggtggtgagggttgaaaaatgacccttgagtacaatgattgctgtttgggttatgggtgcactaaaagcccagacttcacctctatgcactatatgcatataagaaatccatacttataccccctaaatatatgtaaaaaaaaaagtagtagactttagattattcattaaggcataaaatagctttccttttgtctttatagtaatccttagactgtgtgtgtgtgtgtgtgtgtgtgtgtgtttgtagaagcaaatgtatatatatacacacatatatatgtgtttatatatgatttgtaatggatttatgatgactaataaaatatatataaatatatgttccatgatttggcaaccactggctttttaaatgtttgatttctgtattctgatcattatttgtttgctatttatgctgttaatgactaatgctttagaaatggcctttggagactgcgtgttgccagattcacttaagaagatgcttctctcaaggctttgtccttaaatctaaagatgagatcataaagtagatccagaggacattttagaacctaaaggtaccttagatattgtgaaaccaatggctggaaaaattgtgaagaggatctgtgttttagtagcatccccgcctagcagatacacgtgcagagagtgaggctcagaggaggtgtggggctcacctgtgccacaaatgcatctgagcagatcgagagtgtggccacctccacaggcctggccctcctccagttgtcagcttctcttcaccctcttccctgttagggggctcaggaagttaagcttcttgtctgcagttgcacagcaagttactggcagggcagggaacacattcactggatatatttctgaaaatgaaaatataaaacaagttaatttctaggtactgatagcttcttggaatttttatgagtattagtgctcttcattttgggattatagtagtaatagaattgatttatagactagtgttctttttttttcaacatccactaggtattggacccaacaacttttctcaaactttccaaatttccagatgtccacatacatacttgtcaccccaaccactcttggccatgtgagctttctttaaatgttcccatattgtgagtgagagaatgcctgtatctgtccataaccaaggagatgcagtgttctactgtgacccaatttttaaaggaaagcccaggaacatctggagcagcagcaatgcgaaaatgaattgaataggttcaattttttaatctctggattgacttctttgtttattcaataagtatgatttggggcctatcacatgtagcaaactgggtgttaggtaatatggagagagaagaaaagcgctgttcttagttgtagttgaagagatagttatcctccccagccctggcataccacatcctgtgccccaactgtaataccattcctgagtacacgtgcttctctctgtacccctttactcagccagcccatctacagtagtctctgtctgctgacaagattccacccatcctccaaggccactgtgttatcttcttcaggaaaaagttctggaaccttcatccaaaggcagttcatccaccctctaagctttagttaagattgccttcttttaaggatactgtgtattcatcttttctaccctgctacattgtacattctttgagggatttattacagggatttattttcttttgtgactagcccagtggcagtgtctcattaaatatgaattattgaaagttcaggtgagaagcaatcggtgcaataagggttgagaggatatcatatctgtcttagtagcattaactcttctttctaatttcctgtcccaggatgtcattgttccctagtgatgggcagcagcttaaatcacatttcaataaaacatttacttagttaaactgttcggttttattcaagtttagggtcaatgtaattgcatgactaaatttaaattcttgcctgtaatggattttgtaacttctttgcaatatgccatatctgcattttagttcatgtaatcctttggacaagacgtttgtaacaggaagggcccagtttcctctctgcaattggcttgctactcttgatatctcaagcttttaccccaaaactgtagataatgatcatggttatatagtcccctctagttctcccacttgccaacataaaaggcagaagacgtctttaaactcccagaagagtgaagtgaaattagcaatcataaattgaggaagtcataagcatttagtgtttcatagttagccttttccagtgtctcttgcagttcctaggaccaaaacttctagccatgtggtagctagaacctaattaaagtggtttccacataacttcagtctgattctgtattccctccctggtatctttgcagtgcttgtctgatggtgatattttgtggaagtctttaatggctgatgttcagctgaaggcccagggcctccccacagcttcctggggaagttgcttcctctagacctcttatcattcagacatctgctgcttgtctctaggtgccaggaaacacctagtctgtcacaaatgttcacttcttttgattcagaaagcggcgatagcaatagagtaaggatatgatgttgggagatatcgcttaagatatctttaaactcattatcctctagatgggtccgctacacctaaaaaataatgctgattcaggcccttgggtttggtggattgggacattcatctcgcttttagggtgggggatgtactgctattctgtttttcactcattcaaaaaatacttaatgagtgcgtattatctgctaggcattgatgcaagtgagtgagagagacacagcttctgctcacaaggagcttatattttagtgtcagacacagtcaataaataggtaaataagcatacatataagataatgtctgataataatgaatgctatgagaaaatgaaataggataattgctaggtaacaactcggagagggaaggagctaattttgattggaaagttgagaaaaggtcctttgaaaagctttgaagatctgtgaggaatgacatttcaggcagtaggaaactcatgcaaagcctagattatggggagtcttgggggccacaatagtggcttgggtttagttctgattgtagtgggctaccagtgtagtgggggatgtgaagcaagggaatgacattatgtcatttacatgcataataaaacctgtttggatgctgtttgaggggaccataaggggctaaacaaagaagcagaattatgttcaggaagctgctacagtagctcgagagagtaaatggtggtagcagtggaggtggaaggacactgaaggattctgaatactctcttttttttaatagagagttcacaactctcgctgatggtgaagggaaaacaggacttcagagttttgacctgggcaattggaggatggtggtgccattcactgatgtggggaagactcagggaggataaggtggagtggggctggggagctcagagaagcagttgggtggagaaaagaagatactaagaaagaagagactcgacattctcactcctacagtagcttgtaaaactgcctttgcagacacccaaggggcttcccttctcatgattcttcctaggttgcagcgttccctttcatgatttcctttctcttttaaaagcagctcttggttcttttgagtcttggttgtttttctaagcagtcaatgaaagttgattttccctgcatgtaaatgctggaaggaagtgcacaggatatttttttccttggttcagacccctatttgcccttcactcaggagtagattctggacacttctgcataggctgctagatagtccatcatgttatttattgtgactttttctccttttgtaatgtacaagcaattcatttgaagtttcacttatttttttattttaaattaatatgttattgtatttcatgcttttttctctgcctagacactcttccttgtcttgtttttccaaacacatttttattgtttcttcaaaactcagatcaaatgctgccacctctgtcaagcctcttccaacctatccaagcagagtcgaatcaggctcccgtgccaccttgtacaacccttgattatatcttgttccatgtgctgatgattactgttcacatgtctgtctcctccatcagactttggacttttcaaagtctagggccatgttttcttcatctttgtgtcccccattgtcttacacggtacctgcttactacgtgacttttggttcggtgatcagtgaataaatggggtcactgacctcttcaggaggcgggacccactattatcctagccttaatatttttctagtgtctgtttgattgaattactattagttaccatttattaaatgcttgtcatgtgtcaggcattgttctaattagtttaactcatacgttcctcacaatagctctatgagataggaggcattcttatggaaactgatggtagacaggtggaataactcacccaaggtcccacttactactagtaagtggtaaatacaggaagtaaaggcagctctccatagctccatggccctgtgtacttaccaccaagtactcttgggaagctgaaaggtacttttatcatggctcagcttcctcccatttctgtacctcactttcatttattcagttctttaccatttacaaaccaaaggcctaaaacaattctaaaggtacatatttcacagatggaagaaattgattcttggagaaatgacttgctgaaggctacttcagctattgcagttgactgtgagttcctgattcttagcaagcactcaccttcatccctatcaagataggttgggcttgttgccaacaatctaagtgacatgtgtcctgcaggactaatttctttttcttctgtccattatacattatttaggatacttagagagaatattttcatgaacgggagttagcattaggaatatctgaattatactttaaaattcaatataatcatttaaatgattaaattccagttatataaggcatgtatttaaggtaaaaactgcttgccagacatcctgtctaataataatcttatcagcagttactgtgactgaagtggtttccacctaacttcagtctgattctgtattccctcagcaaacagaactcctttaaaaattaaggggacctcagccaattaggccagctggaattaggctgtgtatatgtttggctgtcctaggattctagtgcttgtcccgaaacatttactagtgtaatcctttcagaaatcagaaagcacagctgagttgcatgtgtcttaagttactgttctgttcaagtgctgagtgaccacatgattctttaatgtgaaacaagttgggagatgaagtgggcctggggtgatgttggctgtgagtgtgagggtggatggacccataagaggctcagatactgttggtgagcaggaagaatgacagtagggtaccatcagtgtgggtatggaggagagtgggagtcaagtgaattctcagacttcacagtcactgtggtcctgctcacttgtaggcaacttgtgtcaaggaactgaagtcactgcattgaaagacagattgttggaagtggttcttttttactttggtggtgcagtgttgtaatttctgaagttcctgggaagttttgccctgtcttcttcctttgagatgtttcaggtggggcagctgggcaaatttgctgctgccttgcacatgtgtgagcagggaatctgtacaggaggttgctagtcacaatccttatttttagaaagggctcaaatcctgtgtgtaaacactatttcatactgattctgctctggtggccacattatgaggaagagtagactttaggtgcagcctgtgctggctttaaagaatgaagcttcctaggactctgtgaagggctggtggtcaacccgttatgttgttgcttagcctgttagcagtatccacagatgagcttcttaaaggtgctctgtttggatttctgtctgttggcattcccttattaactgaagatggtctgactttagtacgctttcagaaaagtagagagggtgatgttcccagaaaaattatttttttgtttcaaaaaattgtctttgtaattttctcctatctgggaatataagatgcatagttaacacttagttgtgataagaagggttcatctcctatataatgcctcattttatccttcttcccccaaaacagttccatttctagcctgtctttaactctccatgcagaggaagtcttgattttgttctcctattcttttccaacacatcatctttctcttttagttttatatttagttttagttttatatacatatgtatatgtacgtatatatgtacacccacgtgtatgcatacctgtcccctttattagttgcttagggtccttttttgccctgttttaccttttgtgatggactgtgggcaaaaggatcagaataggagattaatgttgaaggaaatattaacttatggggtaacccagcagaggggcaagttaggcctgcgctttgtgcaaagatgccctggtggtatattttcacactaaataatggatatgcttcacatatccattatttatgtgatatgcttccacatatctcagggcttcacacagagagttggtgtacattgactgtgcagtattaatagcaacaataatatattatagatatgatcagtctaaaaagtgttttcattttaatgtatgcgaaagtattccaggaatataactgtatggcactactcccagttagaggcatcagattctctttagggctttgtttattgtaataaagacttgctttttaatggcttaaaacaattggttttaatagactttaaaagacaagatttaacggaagaatcagattgtgatccatatagagaatatgaaaactgaggtgctaggagatttctgaaatcctcagagctgaaattggaaatctgtgtcttaggaaggtgaaacctgacagatagttttaggtggggagtgggtgaaggtgtagggggaaagatttagaatgaaaaatgtttggcgctgttgccagggtgaatggtgggaatggaaaatgactttggatgagcatctttgaggacccagctgaaggtagaggtcatgggaagagccaattggcatgattatgtgattctctcccacagtggttacagtttgtgactaggagtgggctaggctgtcgtggaccgtctgtctgctaggactaggtaggattcagtacaacacaggggaacaaggaagatgttgagccagtttcccatgtgggggaatgtcctgcaggttggtagatggaagaacttccaaagaggacttgacccatctggactgggaaaatgagcagcagctgagtggaagggttaagagggaaatttaacggggaaatccgtgtgttcgttcaggtgggaaggggaaggagtgtcatctggagaggttgaaggtagatgggcgctcttagccattcttcagctattcctcatgtgaccgatagaggtcccacaccttgtcctgtcttctccagtgctctagcctgatgctgcctcttgagaacacaatccgctagctatgcctgaccaggtcagtaggggtctactaatattctgttaatatatcccaagtttgtgttaactttttgttatcccatcacactgtggctgtcagtccatgaaaaactctgctcttggagcaggctcccccatcctgtcttgtagttgacaaaatgcagcactgtacttttgctcttatttcatttcatcatgttgctttcacctcctctttccatcctgtagggttattttgtagttctgattcttcttctgttgtgttgggttattcctcacaactttgtctcatcttgaagcttggaaaggtcccttctaatccttcaagactttggtgaagatgctggacagaaataagactattgtgccctggattatgccaccatataactctgtctaaactgaccacaatctatatattaatgaccactttctggcaggctttttaactagctataaatcacttagagataaggcatatatcttgctgaggtccagatatgcaatagacagatgagctgccttctaatctattgctttagtaattctaggagacagttttttagtgagcccattctgctttctgatagtcactgtgggatgaagtgtgagaagttctttgcacactggctattgaaagtgtttttagtgggctgcaagcaagtcaacaccaacagtggctccaaaacaacttagtttcagcaacttagattttaccaatagcaatgctgttttcagaataagataaatggaataagggaatgtaaaacctagtgtattttgtgtcgtaaactttaaaggcattatcttcaagtaatttaacagctgtcatgtggagtagtaatcccagagagcaaaactaagattagtagtgattggagttatagggaggcatattttacttaatctaaggaaaaactttttagaccctgctccatcaagaagcagccccttgagtactagttacctacatttttgccatgttgtgggatgtcatttatcttggagcagagacttgaattcatctaaagcagcacactgctctcccttatctcctcacttctcttgggccttaatttcctcttatgcacgtttgttctgctctttctatgtaagatcatcctttttgatagggaagattaaatcaaaatagggttcggtaattttcctttctaactttcattaataaaaattatgcctattgttcttgaactttggcacataatcacatcacctggggagcttgttaaacatacagatgcccaggttctaccgctgaattagaaggtgtgaggtggagccggcccaaatcactcccagctgtaggcccaaggcaggcctattactcaaggctcaccttacccatccagaactcatcctgatccagcctgaggccatctcaggagcctcgcccccgtgatcagctgatgtgtggaggcagctaagagcccgaagcctgagtgcagcccctggactccacccctgtgtccattccagctgttgttttctctccacaccctttcctgcacgcctggtcctagactggacttctgccctgtttcttttaggatgctgccagagggagattttaaaaatgcatgtctgattatgtcactctatacctaaacatcttctaaggtgacctattgcatttaggataaagattaaaatgtctagcatggcccagcagggtcagcacagcctggctcctccctgcctgctctccattctcatctcacaatattttgaaactttttcacaatgttctaaacacaggccttctatcaagtacataaaaaaatgatattgccttcttcccaggaactggacacgggcctaaagccctcttaacctcccttactcatcttctagacttatgcttgtcattcaggtcttggcttgatctttactaccttagagaagctttccctgatgctcaatgtggttggagttcccattttatggtaccatgaacatctctttttcagcatttaccatagttatatgattatttgattaatgcctgtctctcctacccaactgtaaaactccatgggaccagggattaggtcataaaactccatagcaccagggattaggtctatttttattcaacattaatattccaagtgcctacacaataccagagtagatacctgatacatatttttttgaatgaatgaatgagagacaattactagaacgatggatataatcatccatgtgacatcaggtatcaccatgcctggggaccttctgtaataccccgactgcccatatctgatttcctggatgttgacatcagcctgatttgaacctgaatttaccacacccagttcaatactatgattcgaactaagggccactctcccttgccagcatcacatctcagtggcatttcaagttcttgtcccacccttttgtatctcatttctctccctcttctagctttgccgttgagattcaggatatgccaaggctgagaggccaggacaggtatgacatgtggtatagcctctttcttcttctattagatttttttaaaacaagaaatgcctgtccttttctgtaagacagttatgatccctatctagcaaaagttggtgatacataagagtgcttctcatcaccttgtcttaacaatgcaacttccttctggtttttcttttaacattttattacaggatatgatatcttaggccatacatatcgtttttcattctcttctctgcttattgtcttctaagtttactaattctctcttctcccattgtttgtgttgtaatataacctatggtcatgcctggtgtaccctacatagcctccagttttaaccagtttgctgcttttttttctcagatttcatttttagactctgtcactcgggtctgtctcctgctggatgattctggtagccaccagatcagttggagaaggcccttggtggggacaaggggggtccgcaccttgctcttggggcttctcagcagacatgagccagatgctctgtgatgggaggcgctgcattgtcagctacctttcatagccaccccaagtcagctctgcatggcttcagtcatttctgatgcagttacagtctccagaaaggactgagggttgggagctcactcttctgagtggttagcatcatagcattttgtatctggaaaacatcttagagataacccacccattcccatgttacaggtgaaaacagtgagactcagaggccataaattattcgtccaagcctgcacagttagtgccagagcctccagtctagggctcttcctatgcttggaggaggccatttgtttgtaaacagtttcctgttagtcaagagaaccagaaatgagtgaagaaagctcattctaaaattccagtcttgctgacagggttattagaaaagacatagaatttaacatttcatatttagtgtagattgttttgaaatgggaatctctgtatgtatgaatgtgtatatgtataagtgtgagtatgtctgtattatgaatgacagtaatatgacagaaatagtttaagataggaaatggcaaatctgctcctctgtgttaggatgattgaccctggtagcaattaagaggcatagttctaagccagtagactctgtatatcatttttgacaccccagttttctcaagaaatatttgaggtttacacagcctgatttgagtactgtttagggggaaaatgggtggagaataaggggtgggattgtggggatctttgattataccttgttgccccaatacggcaggtactccctgcagacagctttggcagaatcactggctgccatggtgtcctgttacacagaagcctgctggccgcaggaacaggaaatagccttttgtatgcgggttcaggctttgctcccattgacttgtttcctcccgtctgcatcaagttcagcaccctgtccctggtgtgccttgttgtgagcaattcctaggaaagcagatcctccttcacacccacacatgtttaaccaaagtgtttacaaaaggagccttgctaatagcagctgccttgtttccagcatacctttgggctttcagaaagctctctgcctgctctgctgcccccactcaaacttactcattcagaagagaattggatatgttttcccggagtcagttcattttcctgggatgccttttttttttttttttcttttctgccttcctcccttctcaatataactccaagtgtttagggttcaattatgcagatgcgaaatttggctttttagtcatttgaaagtatggagactcctagagctcatgactcttctatatcactgtaggaagtgcatagccaccccctttttgttccccataccagtgattgtacttcagaagctgtggtcctgctcaaaaaagactgtttgctttcctcatctccacaggtttacataaagggttgtctccatttttgcctgatgaaaggcaacttgagacagaggaaccacccctctcccaactagcatttttgagcaccccctgggtacggttttgccttctgtgcttttatgttttgtggtttataggatggaaagcagatgcaaccactctccaagaagtctaagctgaaggaacaccaccctagaaggagaacttataaaatcgattctgacattggtgctccatggttcctttccatctttagagcgtttttaaaaacacaattccatgcttgtgacagactttgcctcggttgaaacacatgctgaagggattccttatgacagatgactggttcctttttacggctttcagtggcttctaccttagacagaaaaagagaaattaacctgaactcttaatagctagatttggtctactctcacggaggaaaccatgattgcttctgaaaatgtgttgttgcagatctgaggggtccaataaatagccttccctttattcctggtggtggttcttagtgtgctttctcggccctggggacccctttcttcctgggttcatcctcagggcccgcaggagcagccctggtcctctgctttgttctcttctctcgcatgtagtcattttgatcaatcacatcctgtctgtgagtacagcagacccatcagataggaaagacctgattttctctctcaagtttatgttacaggtcagatttgattaccacttccctctaagaccccctattttaggtggcaggagagaagttggtggagaaataagagtggagtcatctttagtgatacgtagtgcctcagatttcccaagcactcaagagtgagtgcataaaaacccaacaccagagggttgttcatatatcatatccatataaaaacatgtcaatttgttgaatttctctaatatagtaattaaaataatattgatactgtttctgaagattgccatataaaaagaatgaattatagtttttaaaaaaacataaaaatatttaaagttcaacaacagttttgttgttgttgttgttgagacaaagtctcgctctgtcgcccaggctggagtacagtggcgtgactcagtgcctcccaggctcaaatgatcctccctcctcagcctctagagtagctgggaccacaggcatgtttcactgcacccggataatttttgtatttttttgtagaggtggggtttcaccgtctctacaaaagcctgttacccaggctggtctccaactcctgggctcaagtgatccacccaacttggccttccaaagtactgagattccaggcctgagccaccgtgcctggcaacagttttctttcctttttttttttttggaaactttctgtgacatagcattgatttagcccccgaaaacttgtaggtagttcatggctttgaggtgacactctggctgacctataactgcagtcagccagggtgtcaccttaaggccatgattaaaagtcaaggatatttgtgtttatgctggagtgttaggacatggttcttccctccatgtttctgtagatttgaaaagacacaccatccaatataactctgggtgaggcagggtgacggatggattatccttgctctgtgggacctgaggctgagataaagacagtttcttgtttgtcgttaattagtaggtttgtctcagagctaggccttgtatctttcctattagtaactttaggattgactgatgatgcctgaaaaacatctatcacctgttctgactcatccaatttgagagtaaatctcagaagtctcaggtttcttcaggaagttgagttcagaaattgtttatgagatcaggttaaggtgactttcctctactataagcactaataattgtccataaaaagcaaatatgttgtaatcatgtatttatgacaggattatattttcttggtgattgcgcatttaggaagtgaagacattttacagccatttttttccccactaaaagattgaaaaggttaaagtgtacagtatttgaaaatacacttaaaaaattaggatttctctgggaagaaaccaaaacttaagaaagaacatgattaaggttaagccattgtaaaaggatatcaacgtgactaacacggacatatatgctccaaattgtgaactacacggtacaggaagctctcctaaaaattgtactctgccagaaaaagaggtcaagggctagaaacaaatataaaatgaaggttcagtaagatagagtctttaactgtgggaaacatttatcaggttctttccatatgctaaactctatattatattatctcatttaatcatcagacaactttatgaaggagatattcttatttactcccattttatagatgaggaaactttaatcttagatacgtaatttgtccaatcacacagtctggaaatggtggagcttggattggtaatcactcattcacaaggtattagagaaggcatgggggtgtttggagaccatggcttttgtttaaaaggttgctatcctctttaaaattgttttttatgctagatctagtgaaccccataaccccatatggcagttcttatatttcctttttttttttttttttttttttttgagatgcagttttgctcttgttgcccgggctggagtgcaatggcgtgatctcggctcaccgcaacctccgcctcttgggttcaagagattctcctgcctcagcctcctgagtagctgggattacaggcatgtgccaccacgcccagctaattttgtgtttttagtagagacaggctttctccatgttggtcaggctggtcttgagctcccagcctcaggtgatctgcctgccttggccttccaaagtggtgggattacaggtgtgagccactgctcccggcctattttatttttctttagtaactctttctttaagtcattctcatagactcttaggacagtgaccttgaaagagactggcttgactctagcctatcctctgagagacaaaaagacaaagatagatcttctgacttgtttagggatcttgagaacttacttttcctaatcttggatatttggaaaggcctccactaaaagcaaaactatcctttaacagacttttctagtatatattctggcagtcaggatgtaaaacctaaaacctcacgatataaacctctttggtagcttaaagagaaattagagaattactaattatgacttaattttaatattttattattcactcaagccaccctgaaaggttcattcaatagttgtttattgagtactatgtgcaaggcattatacttagttatgctgaatctgatcttggaagtctttaagaataacaacatgagacaaacccagctaccctagatagcatagagtcatattttaatatttatttttaataatgatgattttccatttaccatatattatttaatcttcagtctgaggattcaactctttgagatagtattatcatctccattttgcagatgaggaaattaaagctcagtaacattgagaaacacagcccaggtcacaaggctcaggcagggccttcaccatgtgagctcctaaagagagtcaaaatagtttttctgtagtactttatagttatcaaaatgcttttacttgcattatctcattttccaaaaatgagagtatttattattgtattcattatatagatagctcttgtatttattatatacttaatatgtgctaagagtgccaggtaccatattagacatggcctagttcatgtaatcctcacaaaaaccctaataagtatcattattcccattttatagatgagccaccaaggcctaaaagtttaagtgatatgctcagcacagcagggaggtttaactgaagcctaggtttgtctgcacagccaggatgtgtgaccactttactatattcacttttctgtattatgctgcctcattttccagatgaggaaactgagattcagagttagctaacccagatgaggtcatacagcttatcaatagcggagctggcacgccaactcagatcctctcactagaaagcccacttgtttcccactgtactgagccgcctttctgcacaaggagaactgtatcttacatccaggttgagtaccctaattccttttcgtcattttttacatttctttgtatttgttcttgtttttaggcagggggccctagacggatgacttgttgcaggagaggaatggtataggttaaactgcttgctcaggaagtcatctggggaagttagatgagaactcaaatccaaatttgagtcctgtgtacccaacttatttagctatgtggttctcaacctctttgtcttttgaaaatgttgcttgagagaaggacttgcccttgcgagactgctttcctgtgctgtaaggaatgaatctttttccatctgaagatcatttaccgtttctctgaatactgaattacattaatggtgtaaggcaaggaagtatgtcaatatcagatatataacaaggaccagtcactcagatttgaaatgttgccaatctctacaatctcggccttgagaattttaaggcacagaagcccgttactttaatgatcaattatcctttagatttctgaaggaaaagtttgttaaccacttatagtactgcttttttattcaaattgcaaactcaggtaaatgttctttaaaattgaattggatgacatttttctgtatatgtcaatgtcagtaaacatccgataaatatccaggtgtgtttaattattttgactcaaggaagtatgtcctatttaaacaatctttaaataaattgtttctgaattgaacaaataaacaagaaatagctgaactaaactgctgtgactgtatagaaaaactgagaggttttaacggaggaatgatctaaaaatccgcatcttattatactcatttttacttttagagataaacctgaattaactgttcaagtatattaatagtttttattttcaaagaataataggtgatgtgtagggataatttgaaacctattccaagtgtattaactccagttcagatatgtttgaaacatggaacttaccctatgtcacccagagttttttttttaatatatatatgtatataaaataattaatgcctattaagtctattttgtgctagttttctcttaatcgttttctcctgtaattttcatatccttatgattcaggtattattgctgcccctccttcctcaccttttacagatgaggaaactgaggctcagagtgactgagtaattaagccaaggttacacagaaagaagaagtctcagaacttggacctaattctgaacattccaaagtccgtgcatattctaagataccaagctatcttgtgaacagcctggtctattagaattttaaaaattaacataatttaaaaattagcataaaaacgtgttaagagaaatttggttatgattttgtttgattagccctcaagtaagagcaaaagagtttgaaatacatactttttttgctttggaaacatacagcacatttacctttttttctgtatataagcagaaggtcttttaataaatctatgtggccttgagtttgtacctccaagaaactcctagagatacatcaaaaaatattgttaatgttcagcaattaaacctaaacagctgactgcccattagttttattattacaatgactgtaggtaacactaggccaaattccagacatgtgacttcttctaaacagattccagtaggattaaaaacatttccccgttctcctgttttggggcattttcttactgtcagaaactatggtgcttaacattgaaactggctggtgatgaaacttttcagttcttaatggtagttgactttgaaattaaatttttgtctttttcttccgggttattttctgttttagctttagcatgagagtaacgtaactggcttccctccttcctgttcatcttacgtgctgcccctccattctcattcctgcccttattcccttcaccccatgctagaaagggccattccattgacctgcctgaaaagaaagtgccctgagatgaaatcatggaatcatgcactttaaaaccaaaaagcatgtctgaaagatagtaagtagctggatatgcagcagcgaaaggcacagtctacatagtctttaaccaagttaattgttcagaaaatattctaacttagaaaaagttatccatgttcactggaggaattttagagatacagaaaataaatataattccactttgtaaagataaccaaagcagattgttttctaaatgactattagactttcgaaattgaaatatttggaagagagagacaaatagtctttatgcatcatccattttgttgctttcattgagactcaaagtctagaacgctttgtgctatttaaggcctgaaaggatggggttataagagataaatagccattccttatatattatatatatataagccatttttttttctctccctgtttttctgctttttcctttctgagttttgggttgcatgtttctaaggctgcaatggttgctatactaaagatttttctttttctttttcccagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtaaagaccgtgctttaactaaaaatccatccctgcacaggggtcggggggagtgggatgggctgagcctgtctcatccatgctcacagtgactctctattagaggcatgtgggcaagggaatgacaactggcaaattaaatcttctgaattatggggttatcaaacactggaacattttaagtcaagagactgaaaatccgctagagatggcatacttttaacatggtatttaatgccgcccagttagtgtcctgctgaattgtatcccatttggtgggcactgtctcataactagggccttttcctgagggtattatgccaggatttcctctgcttgtgttcctttcttttcgtaacatctgcctataaacaagattgatggcacagccctccattcctaaaggcttataagtcccaggagtccaagctagtcagttccaagagagagcacctgcaaacttaggatctttgtcagaaactagtcatttgaagtgctgtgaggcctggaagaatcttaaaagacaatgcgtggcctctgagtggctaactcaagaaggaggcagactttctgtgaaacataatgcatgctgctgtcacttgcagcccggcagcccagtgctcacaattcctctgttccaaaggcaccacagaaatgtgtggcccatggggagagtgtgtgtgacagatgacctggctgcccctctatcctggagaattcatcacagagagccagaaagtgttcacaaaaactccaaactgacaagtagagaaaagttaaaggcccttagctgactatatgagtcccatgaataagaaaagaaacctcttggtccaccctgacatatgaactgcaaacattgtccccactcaatgacgtacgtccacagaggcacacaccccattggatcccacgtttgccagatactcttctcagcgttcgggcccctgcacctgtttgactcctggccaggttaatgcctttctttctttctctttgtgtttctgtctctgtttctctccctctctcattttctgcaaagctcgaagccgttactcactccgctgagttgcatcactgacaagctgaagctccaccagcaggcttgcgggttttgattagttcagactcctttatttctttcaacttgggaggagggaaggctttgtttctcaagcaaatagcaggaaagggctctctggtcctagtgcctcacattttctgcagcagatggactcccatgggggtgagtagggaaagaagaggggtggagggagaattgcaaggttttttggaaaaccatgttaccacttttcattatgactcctgttatcatttttacgaatcacatagtatgtattggggaattgtatagagtatagaattttagttatcatttcccttgcctgggatcaccgtcgccttcaggcaaacattaattaaaggtacgggaaaggatgagtaaggcacagtggggataacgaaggctgatgcgggattaaaagcataatgttgatggtgttgagttagttctggttattccttctgcatttcatactgagaggctgttttgttttacatagggccgaaaggacactttgacagaatagacttatgcaaacttgcttctgtttggggtcccctggggcttccatctgcccaacccactgtggctgaagcagattttgctgtttttttctctagcagtacctacaagaaaaaaacctcagggagtgatggtagcattagagacacttaactacagcagtttcctactgaggtatattcctgtgagttcaccaggaaagccattgaaaataacattggaaaaatgctgcataaatgagtagtcgtcattgtttatcatgtacatgtgtaacggaaaacagccagattatttcaagttactttactgagggttacttaaaacatttccacaaaacagtacctttcccatttcacaggtagggaggcaggagcagaaactggttaattttccagccatgtatctatcttaggccacaggtaggagtgagcctctggtttaaactggtttatactgagtttagtccagttttttcctccaacccttaacatttctggagttgtcactggtaaagtaacatggtgccagggtgggaggttctgtataaacagtaaagagaacagaaaatccctcttgtcagcatgtaggtagggaaacaggaagaaacaactagacatggactgtcagggaactggaggagccgtgactcacctgaccttgccctgggctgcggggctgtgcctgcacacccaagcactgcctggtggactcaaggaccatgtcatcggagtgtgcaccatttctaattccctggggactagtcctgggagccttcttgggggagcctgtctcataggttcccaggtaccaagttagacaatttatatcttatgattcctctcaacatctaaacccaatgtctaagtccatgacctagaggctcctacatgtgagacttaagcatgaggggttttttaatttgggttttttttttttttgtttgtgtgctttagtaaataaagtcctttggattgagtccattcctgtgcctttagtcttcataatgctctgtgccaaataatgctgtttccacataacgcggacagctaaaaatactaacctctatccctgtttacaggcagtcctgtggtctctttttgaaatgctttccagaacagtttatgtttttgtgtgcattgatcaattttcatctccatatctaaagggatacacaaaatattctcatatgattttgggtgagaaagaataaaattcttcacttcacagtaggattggatgttcggacccaggtttttatcccagctcatacatatatcaggcaacttcttacttctctgaaacttagttttattatttgtaaaataggcatacaatattcatcttcagggttggtgtgaggattaagtgagatacttcatataaagtgtttagaactggcctggcacatgatatgtgccaaatagattgtagctgatattatgaagctaaaattgttttgtaaaaattctatatccatatgtaatttacaggcaagtcttgttaagtgagtcaaattagattagataaaaatctaaacttttaaaggggacttttccttcagaaaatagatcaccgcagggcatatttaaaacaaagcccttagattatctaaataagttaatacccacatggcattcataaagcacttaatgcagtacctagcacatagaactcctcaaatgtttcccattattattattattcgtagatttaaaatgaatatttacagagcaaaaagcaattgggaaccattcacaaaaaagtcaataaagcattaagagaaaataacgattcaattatgtcagacaatagaaagtgctgagttacacttaaattaactaggcatgctaatgctgtgttccaagggatcataggaatagaaacaaccagaaagatccaccagaaagaactgttccaaaagaaattccattttctcctaaaagaccattccaaagaaagaccatgatttaatctacctaaagaccttcagagaatccaatatttcacctttctttattagtatcctttcttctgagtaattttcaagcatggcaacaattctagaagttaataaatgacaataatcacagtgatattatattagatagtcttgtagttttcctcagaccatttttggaaggaaggtataaacaaaataagataaaatgataaaggtatgttacctacaatccttactttactgcagagaaagatataatactagacgtcttcaagttcagaggtacaatacaatgattcaggaaatatttccttaacattgggtagccttaaatattgtaatggaacaacaagagcacatataagtttgtaattgaatgagaagttattgccatgtaattgactaacaggtgtatgttatggtaatgagtttgaatcatattcagttgaattataaaagtcagcactagtctcagaaaccagtctagtgatgttacagtgcagaagacacctcctttcctaccatacttacattgatacatatggcctcatcatataataatctgtatttaagtagcactcctatccccaggtgattttatacattatctcacttcatcctacatgtttctaaaagattattcagtacacagaggtggccaaagttatttctcattgattctagtcaagggtaaggtgtgacaaggcaagccttatatgacccgaaccactgcatgtctttataattgcaatcgtatcacccatggcagttttgatcttcaaagcacttgtgaggcttgacacaaagattataattacatttctggaagtcattacaaaatactatgtaaataaataattgctgactttcaaaatgtattttatacaattatcctactatggaaagaagcacaactctttattgaggctgattgtttgggtcagagtatgagtctcctagagagcttacacaggttttttttttcactgcaaataactcctccactatcccactcatttgagtgaagtagcttagattaacctaagtctgtaccactctttggcataatgaagtagaagggatttatacctttctgatgctttctggaggtttcttagagacttaggatatgttagttaaagatgcacaggtaagatgcatcttattcatagatgttggctgcctcagttactctgaaagaggtcactatagatttttttttttaagagacagggtcttgctctattgctcaggatgggatgcagaggcgtgatcatagctcactgcagccttgaattcctgagcttaaacaattcccccatctcagcctcctgagtagctgggactaaaggcctgcaccaccttgccaggccaatatttttcatagggacaggatctcactatgttgcctgggctggtctcgaactcctggtctcaagtgatcctcttgccttggcctcccaaagtgctgggattacagacatgagccacctctccctgcttgccactatagattgtatggaagattcttctctgcatttatggggtttttgtttgttgttgttgttaacataggacagagttaatctttctgtaaggttatttttttcttctgcttaggaaagtagtcttgaatctcttatttcaaaatatgtaaatattaacacttttcacttactcaactgcacaggactattgaagatgtctccagttttatgactttcggtggctaaactataatattccaaggtcaggagaataagcattagtttaataatacaattattaaaaattattttatcactactacaaaatctagaaattgccagtggaaaaaccccaccccatttgagtactcaaggtctgtcaggaggattcaaacccagtagagtttgaggttgttcattctaaaatgtcccttataacccagtctctatcaagtccaccgagtcaagttcttgaaaccagcagcttcgtaatgtgccaattatatgtgaacatttattttagcagagcagctcttaactcacaggagggaggaatgccttaagaaaggttaaaaggaaaacttcagcaattaatactaataaaccagaaagttaaagcaaccataataaaacactagagcatctactttttactacagaaccattcctttcttaagagccacctgtttggtagacatactctgccacagcagccacaggcaaataattaagtttaataggagtaactcttattttgaagaagttctccgtttaaagccacagagtggggaagttattaaattttatggaccctaaacaaaggcaagccctgtgtcaaaaattgaatgttccgtattcttcattatatcgccactgattggatggattacttttgcattccataagttgaaattcatcttgctttccctaaaaatagcctatcttttgacatagcagatggtgttctaatcttacctggacctccgtttactctaatttttgatttactgctgctgaggcccaaagaagtggttttcattcctactagatcagttggagataatagttggtccagctcacaaagtttactaagcttggttgtatgattaattactgttatttgtagctacactgagatactaaagctcagaatgaaacctgtgtacatggtttgactctgattttatacatggtttttctcagttgtttttgtggggatttatttctgacacatgtacaaccacccacacatagggaaaagatttagtaatgaaaggaatcatgcttttgcagggatgacaaacacatggttatatattttattgaggatttgctgaaatctcctttccatcaaagaaaacttgagtgtatgaacctcatttcacccaaagtattaattttctaacgatagatacagtggcttctgcagtgcactggggtctgagaagagggggcgcagtttaacttaggacacctgagttttcatttcattgtcactaaagagtctttgtatcattctcagatacagttaatttattgtgcctcagtggtcctatgttaatgaattactagaaatcgctgaatcatatatctcagaggctctgcaaggagtaaggtgctatctgtttagggatttgatgttcttaggacttttagtaaagtttgccttaccagataaatgctagtggaaaaaggaggtcgcataattatcttctaaagagtagaaatgcatgcgacattattacttttatgtatatgtcttaaaattaatactttattcttttgagagattttaagtttacagaaaaatggagcagaatgtatagtttcttatattctcctcctaccatctcccactttctcctgttatttacatcttgcatttgtgtgatgtttgatgtaattgatgaaccaatattgatacattgttatgaaataacgtccatagtttacacagggctcactctttgtgttgtgcagttctatgggttttatcataatgccatgtgtccaccattacagaatcataaggagtagtttcattaccctaaaaatcccctgtacaccacctgttcatctctctttcccttctcttttcctgagcccctggcaaccacagattctttttttttaactgtctctatagttttgccttttccagtgttatatagttggaatcatacaataagtaagtagcttttgcagactggcttctttcacttggtaatatgcatttaagttcctccatgtcttttcatggcttattaatgcatttcattctaccccgaattgcattccattggaaggatgctattatatatatatatatatgtgtgtgtgtgtgtgtgtgtgtgtgtgtgtgtgtgtgtgtgtgtgtatatatttgagatggagttcgctcttgttgcccctgctggagtgcaatggcatgatctcggctcatggcaacctctgcctcccagattcaagcaattctcttgcctcaccctcccgattacagactgggattacaggcacccaccaccacatctggctatttttttgtatttttagtagtgatggggttccaccatgttggccagagtggtctcgaactcctgacctcaggtgatccacctgccttggcctcccaaagtgctgggattacaggtgtgagccactgcacccgaccggatgctattatatttttaaaatcatcaaaggtgctctacctgaacctgaggatactatcttatcttccattttccttttgttgctgactttgtcagtggtcgttcctattagaaagcatttcacacatttcttcctggagaagcatgttttctatcatagcaattgtcaccaaatggttttctgtatcttgggtgcatttttaaattaaatatttttttcctaatcttgcccatagataaattcctgaacatctactgtttggtggtcatgcataccaattcaaatacggaacataccaagttaaaataacaatacagttatgtgactgcttagttgtctcccaaaatatttgactctcctaggtaaaggggggccttttctcttaaaaatgcctggcattccttaagtgtgctgtgctatttcccacttccatgtcagcccatttctttgcactggggggcagggccctgttgttccctcttgggcatgcctttcccaaacaccactttcttcaaagtgaatcgctgtctcatctacacccatttgtatgtcatttctgtactttggacacacctctaatgtgtacatatctttcttttttttttgagacagagtctcactctgttgcccaggctggagtgcagtggtgtgatctcggctcactacagcctctgcctcccaggttcaaaagattctcttgccttaccctcccgagtagctgggattgcaggcatgagccaccacacccagctaatttttgtagtgttagtagagacggatttctctatgttggccaggctgcgaactcctgacctcagttgatccacccgcctcggcctcccaaagtgctgggattacaggtgtgaggcctcatgcccagcccatatcgtcctttagcataaaaatttaattgcatgccattctccttttataagcttcttaaggacagtggctatgttttgcatattcttgaatccttataacctagcacagtttttggcacatggtaggtgcttaagaatgtttaatgaaacaagtattagtgggaaagaagattttaaaaaaaagaggaagatagatatgtaggagaaaaaaaggaagaaaaaagattttgttcacctggaacaacaaagaaagggcaaaacaagagaaactttcattgctgataaggacaggaaatagcacagtaagagtgtgcataagcagtatatatttttatctccaagtctttttgcaatatgtttcatatttagaacacatatcaagactgtatctgtttccagaacttgctgctaacagttagtaacaatgccaaaacatattttaggtccagcttgaaaccaaatgatcaaatagaatttttgatttccactttagagtctgacattaattatagccatcatgtaataaagtgtcaaagctcttttctgagaaaatgatagaaattatgttaactaatctgtaaactgaagcacagctattcctctacaacaaagcaaaagatagggttttgacagctatcatttctcatagtcttatctttttcaggctgaatttttcctgtatgccccacctctgcctgttttttttgacgctttctgtatagtatggttgcaggtcatcctactggtctggtcagtggtctctgacacagttcattagtgtccatcttaacgcctcgtacccagaaccaaactattcctctcttctcaggctctggtagtgcaggctttagtggcctttgttcttttggtgaccatattacactgttttctcttatttgccacttctgtcaatctgcatttctccaattatttacttttagagctgtttttttgtagatccaaatatgatactttacagttatccctgttaggttttaccttatttaattcaggtaataatttctgcctgtctagaacattttagattttaataatgtcatctaatacattagtagtccctggcattccttcctgtttggaatgcttttctttcattcatttcagtcatttcaagtcagctcaacaaatatttggcatgtacttaaaatgtgcttatgcaggtgagaagtaaaaaaagaaatagaagatatagtctctgccttcaagaagctttcagtctcatttaggatacaacataaagcaaatgtgatggttacattatagtactagcccatgtagatgccaaaaacatgcaaagaatgctcaggattttaggaaaggagatctcttttgttcctttgctctattataataattcacatccgtaaccaacttaaagccatctgcattaggaaattaaaaaaaaacaacaatcccattcagctcagattatactttcactccgaattgcttcaacaattacgttttcaacttttaaaaattacgtatgtttgatgtgtgtggcttcatgtttcttaagatgtgacaaggatatggaggatcttgtcttttcccagctagactgaaagctcccctaagtcaggggcctagtcttctaatcctttgctatctctccagagctcctgctagattgaagactcccattggcccagggcctggccttctaatccctttctatctctaactcctactccgatgctcagcatgcataatgtcgtgggaagtactagcattcagtagaaaagtctacccaggaatcagtgctgcatgcttcagggttcttatgctgtgactattattagaaattggctaatagatctagaagtaagattctataggagactaagacaatttctgtttacctttatttcatatttcgtaaatgcatgtatggtctcactatgcaatatgttacggaatatgccagcaactctgacaaaatcaaacaacgttgttgctctgcttcagcatatacatccccatatgcatgaatccacctactcattatattgataatgaatatacatataaatagtcttgacaggtctattatttgtgatattaataaatattagccaagttcatacttttttcaggaaaaataggatcactgacatccctatgtcttaatattatttgattacttcattaagcattgatttctcaggaaacattaactgatcactgttgatagaaaggggacagaggaactgcatgattattattattattttattaattttttgagacagagttttctcttattgcccaggctggagtgtagtggcatgatctcagctcactgcaacctccccctcccaggttcaagcgattcccctaactcagcctttctaggtagctgggattataggcacctgccacgatgcctggctaactaatacaaaaattattagtagagacggggtttcaccatgttggccaggctggtctcaaactcctgacctcaggtgatctacccgcctcggcctcccaaagtgctgggattacaggcatgagccactgcgcccggcctgcatgattattttaaattagctcttaggtttgttaacatgcagaaatagttataaggggaaatcttagaaaatagataactaggctggtgcggtggctcacgcctgtaatcccaggactttgggaggcagaggtggatggatcacgaggtcaggagatagagaccatcctggccaacatggtaaaaccccatctctactaaaaatacaaaattagccaggcgtggtggcacatgtctgtaatcccagctactcaggaagttgatgcaggagaatcacttgaacccgggaggcggaggttgcagtgagctgagatcatgccactgcactctagcctagcaacagagcgagactgcatctcaaaaaaaaaccaaaaacgaaaacaaaaaaaaagagataactaaacaagtaaaaagcttttttctaattaaaatatcttatatgataaaatgcaaatgacagaactttaatttgaattgttcaaagtcatttgtggacaacactttgtttcaaatagttcagtcattttcagacttcttttttgttttcctgaaatgcaaacaggaaggcgtattttctggaactgggtcagaatttaagtaacttggtctgaggcaaatctaggaccccatttgactatactgcctaaatttttttatatgactcaataaattaatgaatttcaaatccatgaaagtaatgtaaataaaaataaaatgctgcacaggcaacattgttcctaaatatctcagaggatttttttttaagtagaaacatgtcatgtattttccagagagactgtgaccttaagtgatcaacccataactatgcagcgaagcatgggagactaggaggagccctgtgcttttgtatctaaagcttatcgccatctcgcgctgtacccaaaacggtcaccgttccagctctctgtggtaattagtaacaatgctatagttgatggaataaaaataacacatataatgatggttacaaacacaccctgacctgtgccaaggagagcagtgattcatgaaaaatcaataaataaacccattgatgtggtcacaataaatccgtacataattaagaagaaccttttctaaataaaaactacaaaggaaataaaaacaggtttggaaaagaggaaaaagtctgataatagcgttatggtactcatcattaaagaaaacaaacttgtaagctcccaaactacaccttaggaaaacagtacattctcagtgtggcttaaagatatggtagaggctgggcgcggtggctcatgcttgtaattccagcactttgagaggccgaggtgggtggatcacaaggtcaagagattgagaccattctggccaaaatggtgaaacctcgtatctactataaatacaacaattagctgggtgtggtggcgcacgcctgtagtcccagctacttgggaggctgaggcaggagaattgcttgaacccgggaggtggaggttgcagtgagccaagattgcgtaattgcactccagcctgggtgacagagtgagactcagtctcaaaagatatagtagagaactgacctaaaagattccaaaaaggaaagagtttggccctcagagcagttaacaaagaaagttaaagttgttctctaaccttagaaattggcaggtgccacagatactctttgaagggttaataaaacctcacataacctctttaatccagtaggtggttgaaacttttgaattgggtcttgcctcccaaagaagaattgagttcaacactgataaaacagcagttgctcaataaaattgtgctgaattgatttggtttatcaggaaaacatttcttccatgactcaagcatgtagagtggtaattaaacattcatagcatcgttgacagtgtattggaaataggagttggctgggaattgaggagcctctcttttgaatttcagatgtgcctctgagttcttgagcaggtcactaacttctgtaggtcttagtttctttaagcgtgaactgagttaattgggctagtttttccccaaggtatatcataaagtttttgatgtctgtgattctaaattaaggcctgaaagggcaggttttcttacaggagagatttagtaatcatcacatcagaaaactaaattccggctgggtgcggtggctcacatttgtaatcctagcactttgggaggctgaggcgggcagtttgcttgagcccagcagttggagaccagcctcagcaacatggcgaaaccccgtctctacagaaaatacaaaaattagctgggggtggtgcgtgcctgtagtcccagctacttgggagactgaggtgggaggattgcttgagccagggaggctgaggctgcagttaactgagactgtgccactgcaccccagcctgggtgacagagactctgtctccaaaaaaaaaaaagaaaactaaataccaccatcaataataacactaaaggctaatatagcatttaatcgaagaactaaattaacaggagcaactatgatagatgtcaggaaaggttttgttttgtatttcagttaagagattctgatgagaagcaacctaagatcaggttatttaataccaaaaaactgtacatttagatcttgatacctgaccacagctgaacctgtctttaaggtgaagccttatatatgtgcatgtgtgtcagaatccatagacaatttttgaaatcccagatttaatgtaaaattaaggaattttattgacatctctcatacccttgcatggttttatgtaatttatttgttaaccctctttacatgagaatggtacatttgtaagtgataatttatcttactggagaaatgagaaccttataagctaagagttattaaaacagacgaattctgttaataacagaataaatgtgatcacaggaccaggctttctatattaaagaaattagatctatttaaagaaaatatgatttgaatcataacgagatttctcttaatgaaacattactgtcatagtgttttatgactgcatgataaaaatatttaacacaagttattgccaacattaaagttactcatttattgagcaccgttctgcccactggagatactctgatgatcaagacagaaaggctcttggaactttttctattggcatatggcataataattaaacagtctttagagccaggtctaaattcaggcttctttactcactagctttgtgcctgtggggaggtaacttagcttgtttgtacctcaatttccgcatcagttaaatgaccatataatctaataataataatacctgctttaataggttgttatggggactaaaggatagttaatatatgtaaagcccttagaataatgcctgatgctcaataaatgttagctattactaccaaagggtgggcaattgaaaataataaaatattatctagggatatgtactatgaaagaagtaaaatagagtgatgtgatgaggagtcaatattgaagctgagatctaattaacaaaaaagagttagccctgtcaagatcaggaggaagggagggcattctaggcagtgggaaaatcgagtgcaagggcccagaggtgggaagactgtggggtgtttgagaagaatgctcagtggctggagtgtgtagatgacatgaagttagagagataggctgggtccaagttatgcagggccactacaggtcaagatcagaggtttagatttgctgttatgtgcagtgttaagccatttggcagattttaagcagggtcttgatatacactgatttatatttttcaaagctcactctggcggttgggtggagaattgtaacaggggtagggaggaggttaggaggcttggcagtcaccctagtgagaggacagtggcttgggcttccctggaaatggtggggatagagacactggagtagagagagaattttgctggtatcatcaaaatgctttagtaatgttttctcccaattgttagtttactttaaaaggaataatattgcatcttttacaagtttaattaatgtttagacactattatacaccctaagtgaagtggtaattcaggagttacttgatttattaaacaaatacagaactattaacctggaaatttcaggccagaaatccattttgagatctgaaatgttttgtttgactgaaaatttttaggtttttgtaatcacattttgttaatcttctgatttccaatagctttccttccttggcaccatgcaaacccagattttagtacaatgatgtacaatgatgagatgaattttggggactgaaagaacattatatgtttgtattagtctgttctcatgctgctaataaagacatacccaagaactgagtaatttataaagaaagatgggtttaatggactcacagttccacatggttggggaagcctcaatcatggcaaaacgcgaaagaggagaaaggcacatcttacatggtggcaggcaagagaatgtgtacagggggcaggggaactcctctttttaaaaccatcagatctcatgagacttattcactatcacgagaacagtatggaagagacccacccccatgattcagttacctcccaccaggtccctcccatggcacatggggattatgaaagctataatgcaagatgaaatttggatggggacacagccaaaccatatcaacattcttctcattctcaaaatgtatcttctgtatctttcatacacaccagttccttctactgcttctaaaatgcactttaggtcaggcgcggtggctcaagcctgtaatcccagcactttgggagacctaggcaggtggatcatttgaggtcaggagttcaagattagcctggccaacacagtgaaacaccgtctctactaaaaatacaaaaattagtcgggtgtggtggcacgcaattgtaatcccagctactggggaggctgaggcaggagaattgtgtgaatccaggaggcagaggttgcagtgagcctagcttgtgccactgcactccagcctgggtgacagagggagactctgtctcaaaaaaaaaaaagatgcacttcaatggaaagcatcatgcatgcaggtgtgaccaggctggctttgcaggcaatcattagatgatcacactgggcagtgcgtggcaacagctctgaagtgaagaaacacttaggcaaggggctatcagttccttcaggctggcgagctaatatccagcagtcaagaaaagtcagtccaggtgagaaaccagcacttgtcctccctgtggagtcagtacccaaacagcttcttcagaggactgagaaattggggcttatcttaaatagcaaggaacttgaattgataagggatgaggaacatgttctaagcagaatctcataaccacaagccaagcttataggagaaagctttaaacaggtaaccctgttggcatcacagttgtagtaagctatcactccattctcagatccttcaaccatgccctaaaaggagattcctcctcatgaaactctaaatttggggctctggaagttagcttcaagatcttatgcagatatgaacactttttcttatatttcctgtttaaaatgtaatgaagttccatttctccatggacacagctttctgttctttctggaatcctgaagttcagaggtgtgtgtactgaaaactattacagccatttgttagtttgttttaaaggaaaggagagtagtaaaatcaggacctggagagcacatttcccagtgaccaaacctactcaaaatgtatttgatggatttattttgagttttggaagctcaaggactccatagaagatacagttcaaagggtgtcagcatggggaatccagaataattctcagagctccaaaaacttcatagattggagcttcggatgatgggttggctgtttctttggctgtcaaacctagtttttaacctttctccctggttaaaaactaggtttgacagcccattgagggaaacgggaagaacaaagagattggtacaagtacaatctgtgagttaggcttattgcattccctttcatttagaagggtatagtaaaagagaatggaggtgaaaaaatgtaatgtgaattttctcactagagtcagaagcagcagataacagataacagcccctggaaaaaaacagtcactttaaaaaggaataaaattggtagggtagtttattgaaaagaggcgtgctttctccccatgagccaagaggtctgaatcctgacaatacacatgtgtgtaatgaattcccctcctcttcagatgagtggctggacttgcttatactaatgccctccccctccagtcttaaggcattggtactgatctttttcactccaacaacaccgtggtataatagtgaaaatcaccgcacaggtgggttaggagataggtaactaggagatagattaaaactagggaactggagatgtggttatctttcagcccatttgcagactttgcaagctagtatttgaggtgtcagctttggacttgcaaagccacagcttctgcagatggctaagttgccttcctcctgcactttaccacattccctggtacctaagagagaaaaactatttctccaaagtgaacccctcccaggggtcttcctaccaccattttaataaaaaggttaaatctcaaactgcaaattatagaatgtctagttagaagtttgaaaacaatctttgtaaaagttcattaaaatcaaataagcagtaccactttaggttatatagaaggcgatttggaggtaaatcccttcagttatctaaaaatgtggcaagtaagttccaacaagtgtaacaagcaggttaacactgagggaaacgggaagaacaaagagattggtacaagtacaatctgtgagttaggcttattgcattcccccacagtatcctattgcatatgaagaggtccatggtccagtgcagttagatgacagtggactctggcagcttatcaagctgctgtctccagaggatgctgctggtcatccaagagaagtggaaactcgggcatgtgcaacagaatatgtacagacaaactgaggactcccccaggaaggaggaggcatcttaggagggcaccttgaactcttctgctctgcttcaggaactccagagagtgagggaattaaaaaggagcaggactattgggtcctctgtaacagctcttttctgatggcggaaagtacttaaagctcacagataaagaacatcatgttagaacctcagacaaattaagtgcaggggaagatgggaagaattttagcaactaactccaaaggtgagagtaaaaataaatgcatagcaagacttaatattaataatacttagatagtgctttacatctatagaaagcactttcatagacattatttcatttaatcattacaacgcattgaagtatcaatactactatactcagtagtttgccagcaggaaatgagggctcagagacatttagagatttgttcagggtcatcaagtgaaagggatagagagtgaaaactcaattccaggtcttttagctccacataatatgcttttccctactctgcgttgctgtaggagtctccatatcagaatcggactttgctacaaaggcctgttggctatcatcctaagaggaatatttgttatcactgatctttccagcccaaacctggataacaccattaatccttactaagtagccaaaattcatggtttgatgcagatcagagaacccaaaataaagtaaaatggaccaaatccctaacaagaaataatagtggaaaaatctacctcccaattttgtaaacataaattttattctagaaattaaaaatgtacacattaatgaaatcttaaaacctcaaaataggccaggcacggtggctcacacctgtaatcccagcactttgggaggccgaggtgggcagatcacaaggtcaagagatcgagaccatcctggccaacatggtgaaaccgcatctctactaaaaatacaaaaattagccaggcgtggtggtgcgcacctgtagtcccagctacttgggaggctgaggccggagaatcgcttgaacccaggagacagaggctgtggtgagccgagatggcgccactgcactccagtctggcaacagggtgagattctgtctaaaaaaaaaacaaaactcaaaatatatggttttatatgtggggcgaggaaatttaaagctacttaaattttgcacgatatattctaccttgcaagagctggaaaggttgatacaaaaaatcatttatttaactttggataattcagatcaaacaatttgcttaaataatctagaacagaaaagaaagagaaatagctcacgtggtatctcccatcgaatatgggagcctgaagtgttagttttaacctcctttactgctaaatttaaggatgaaagactttcttaaaaagttagtagtgttcccattttcttttggcctgtgttgggaactgttgttaacaattacatttttttagtttttagaaaagatcctaaatttttgaattgacattttgtacatagaaaacctagatttttttttttttttttttttttttgcacattgaatgtatagctttattacctcattttgaaaactagtactgctttttaatgaatggggaccattctttgcaggaacagtatttctagtagaatttttgaaggtatttttggaattctcagacttgtccaatatgtagcaggatcagaattttagagcagggaaacccacagagatgatttcatccccgcccctctttttactgacaaggaatgtgtgggtcagggagggaaagggactccaccgtgatcaccctgtgaggcagggacagcactgtggccagaacccacatctccagttgctagtccaacactctagaattattttatcctgctactcttctcataggctactgacattgtattaaaattgctatccatggccattgtgacctgaagaagaagaaaaaaaatgaaccaccaatgacctcttcctcctctgcacctttcctcttttcacccgaaaattaagtccttatgaaaagattaaatagatgtggccctgcatctgtggcagcactgtctctcctgaccagtcactgactgttttggtccacatctggagtggactcagtggacatgattctcaggctgagaaaaataggacttggattttgtccttggcaggcagagaacttccactgtttgaggagctactactggactactgtgtgtttgtcccacgtcccacagctagctaagcagaccgggctcttttttttttttttttttttcacggtcatcaaaacaagtagctcctctcagacaccttaatacataattaggtgtgtctgtttacacttgggagacagagggcttcatgtcccagagaaatacaagacgtctgggaacagccacaaacagatgttgaaaatgtccatttgtggcgagtttattactatagcaccaggaataaacattgaagatgaaacccctctgaaggggtgtgtgtgtgtgtgtgtgtgtgttgagaggggaatgttatcgaacagagtagaaagtgaaaggaggttctattttttaaaaaatttgctctagtatttgtttatctcctgcaacaaggaaaatttcgctatttggctttggctgtttgaaggcttttgccaaatgcttaacaatctgtagggtttgatttctttcagaaagaccactttgagaacaaggctctatgtaactaagatgtgtttgtttttgtttaaatcactcagaagagaaatcatctcttgtccattgttaaaaagagagttttcaatcaaaggaaaattctacatattctaaaatatacaaacagctctttgaaactgatgccaaatcaaactctaaaagggacgtttttcttgcagaagttttgagttaattctgtgtgcagggcttgagtggaaaaacgctgagactgtcagaggaacgagttactacaacactacatttggattcggaagttacataaggagcattgtctcaggatagcaggaagactcttgtacatggttttaggctaaatcctaacaacaaagagaaagaaattctttgcaaagtcagtttttcagttaaataaaaggtagtagtttggttcctgatgtcactggatataaacatccagtgcgagaaggcataccagtcatcactttaaaaatatcaattgaaatgtgccctgtgccctgtttttaaagaaataccgtcctttcccctgttgagactttttttttttttttttttttttggagacagagtctcgctctgtcatccaggctggagtgcagtggctcgatctcggctcactgcaacctccgcctcctgggttcaagtgattctcatgcctcagcctcccgagtagctgggactacaggtgcccgccatcacgcctggctaatttttgtatttttagtagagatggggtttcaccatattggtcaggctggtctcaaactcctggcctcaagtgatctgcctgcctgggcctcccaaagtgctgggattacagacctgagccaccacgcccagacctcccgttgagacttctgtttggatggaaagtagtagatgctaatgaggcacctctattgggggaaaaaaggacacaaattggaaacccaacgcgttcacttcagctctgcactaatgagctgtgtcctcgagatggtgccttctttctctgatgaagcttccttatcaatgggtgcctatcctgactacctctcaggctctttgtgaaggtaaaaccaaatgtatgtaaaagcagtgaaaacttaaaaagcaaaatctgagatgttaccttattatttcatgatgatttttgagaggtaggttgatgtgggacctgatggtttgctgggactgaaaaaaatcagaaacagtttttgttcataggataaagagggcaagccagggaactgaggagagcaagagacgcaccacagaactaactggtagtcagggcagagctgtggctccgcaactaacctgaaccctctcaggtaaacacaggtagagtaagtaggaaaggcagttagttgaagatgtacagacagaaggcagatgacacacacaaatttcagtgaaagacaaggatttaggtcaaatctgctattgccatcatttttcccttagacacacatgtaaatactttttgtatgtaactgtgagaggggccatggtgtgtttaaagataaataggacagcattcccatttttaagcagtttaaagtctagttgaacacagccataaaaaagaaagatcatgtcctttgcagtaagatggatggagctggagaccattatccttagcaaactaatgcatgaacagaaaaccaaataccgctgcatgttcttatacgtgggagcctgaatgatgagaacacatggacacatagaggggaacggtgcacactggggcctattggacggtggaggctgggaggagggagaggatcaggataaataactaatgggtgctaggcttaatacctggacgatgaaataatctgtataacaaacctccgagtcacaagtttatctatgtaacaaacctgcacatgtacccttgaacttaaaagttaaattaaaaaaaaaggctatagaggtgattgcgcgattgttgcttccccagcacacttataagaaagatacaaatgggccgggggcagtggctcatgcctgtaatcccagcactttgggaggccgaggcgggcagatcacgaggtcaggagatcgagaccatcctggctaacacggtgaaaccccatctctactaaaaatacaaagaattagctgggcgtggtggcgggtgcctgtagtcccagctactggggaggctgaggcagaagaatggcgtgaacccgggaggcagagcttgcagtgagccgagattgcgccactgcactctagcctgggcaacagagtgagactctgtctcaaaaaaaaaaaaagaaagaaaaagaaagatacaaatgaagaactaattgcctgcagagaggaaggggaggttactgtgggctaaagcaggaatatatgaagaagcttcacagcagagggggactgtgaggtcgattttaaaggctgcttagaattttaaggagctgagatagggtagggggctagtgggatactaagggcggaggggccaatgtaaacccaggcaggaaggtgggaaaaggtagggtagcacagaagatggaaaagggtctggtatgactggattatagagttcatggaagtaaaatgagagacaagactggaaaggtaagttgggacaagattgttgctcttgcaaatgtttgtgtgcccttaacacagagtctagaaacacacacacacctgagcgaaaaagcctgacgtgaagtcacagaacaggtaggcaaacatgaacaaggaaatcccgaggaaccagaaagtcaaacaagataaagattgaggaagccagataaaccacccaagcagaagatgcaacacagaaagtgaaccttgaatataaagccagcttctgtcacaacccggaagccccttatgtatttcctcctggggcaggaacccctcccagggcatggtcagcccaggcctccagtggggcacaggtaagtggctgcatctgactgtagagggagaaagggcaaaaataagcataggtcctcacaggatacagtttgaggctgaagcctgtggctttgatcctagattaacatggattgcgttaggcctggggtagctgtatcttttggagctgaattatagagactgaacagcacttggtaatctggttcaagtcctaggtctaggggcatcaggcaattcgagccacgtgctttaaggcccaggatggcctcagggctgttggaccacacctggggaccaagccttttgagatctattttgggaaattgtatttgaaaaaaatagtgcccccagcttgtcaggttttgtgtgattcggccttgaaaacagccgctgcctgcagcggactcttccttttccccggcatctctcctggaccagtgctagtctcagttacaggtgtagtcttagattgggttggttttagatttaaaggagcagcttgagtcctactttaagaagcagagtccaaccagaactcttcaaactctatctgaaaacattgggctttgtggtgattattcatttcatagtcttttcctacctcaaccagcatctctcttctcagttatggtttttttacagaagagtttggctggacctgcagctgggtgtgtggggttaatcacgaatttcaagattttgattctcaatttatgtattttctagcttggagacccaatcttttcggtttccttcttctctggctctactagttcaaatagtgcgggtaaggaggaatgcccttttaggatggaaatgtttgctatttgctgtgtactgttaccaattcctgcttacaagagtctcatgcaatgagtttacctaaggaatataaaacatggtttgcttcatatcattcagaacaccagtggtaaagacaatatcagaattctggggctgggtcaagcatggctaatgagtgcatgcgtctgcctcccattccacctccatcccagggctgtcagtgataattggtcagaacacttttcatcattgccctccaggtagccatggccaggctgctagattcacatgaaaatgaccccgaatccctgcaccttaggggagacagtgacagcaaagcccccacaagtctggggccaggtcttgggctaccatgtactgatctgtaacttcgacgaaatcactttttttgagcttgagtttgccattcatatagtatagtcagtggcattgctaccttacagaggatttaatgacaaaatggcagtgggagtgctttgatcgagtacttctgcagatctgagctgtggcatcccagctgtttggttagccactctttcctcttagtcaatttttgctaacaccatgggatgctgtggctattccatcacttataggattcatatggttagggaaaagcgactgactagtctgttaagcaataggcagttctagttcccagcccatcatcaagcagcttcaagtcagaacattcctgcaccagggcttcaggcttgctaccaagcctgaaagaaacgctgcgcagatttttccacgggagcgcctcaaagggcagaggaaactcaagggctccttcactatccctgctctccctgatctgctggcataacccaaaacaaccccaggtccccaaagagaatattttcaagtctcttgttttatctgagaatgtatgtgaattttattttagaatatgtatgtttttgttttaatatataaataacgttttaacttactaatatcagttaaatgtccccctttaaaaacccttctccatttgtccacttcttgtatttcatgccttcctatcagttaggctttggtgtctaatatataacatctcaaccagttcataaatttctgcttttaatatagaccaagttaccactagcgcaggccacaggaaaataccagtctgtcctgtctgaattctggcttttttgaaagatttacttaggaacaatttatcatttagtttgcaatttttaaaataatcttaattgaccacatatgttatcaaataagagttggtcttgtagcctctgcctcgctcgccatctccccgccacctcccaccccctcatttgcacatgtgtacaaccttctgccaggatgtcagaaaattaattatgccactccaggcagataccatcgcaggaaaggctctctctgatttaagataagattaccaatatctaagctgttatttttaggagggaaaggctatcacttttaaacctctctccctcattttcctagttccttctctcctaatttggctccatgttttggtagccataagtcattagtggtttttaatttttctgaaactgaaataaggtctgaaagggtggatttgtcccttttttcctccttttttcctttttttttttggctggctaatcggaggaacgcaaccacatctgaagccacttggctcattatgaatttcatggaaactgattctctgaaagtgtttccatatgtgttcccaatatatcccatcctctctaaatgggagcacagacgtgtgcatgggctggaaatggcttcaggatgtgacagggcagtcatatgactgccacggcaccgtgggtggccccttctgaaagacacggtgtcctgggtgctggcctccttcctgcagtggatctggtttcaaagactatccatccttcctaggatttaaaaagttcttaatcaaggcctagcaggaagatctctctcatttttcctcccttttctctccccctccatctttggctcgttccttcccttactctccctccctgtatgcatacacactcactcacacatctactgcctgccccctttccctttataaaaggaaatatattcttccaacaatatcctcaaaatttgggtgggtttaaggaatggctgaattttctgaaaattgccaggtttttttttctctctctctctctctttttccttcagcataacatactttcttagccttaggatcagctagttctttcagaatttgtgagcatgcagtggaaaagtacaattcattacaacacagaaaacaaatatttagactggatagtcgagggactttccctctcttttgcaaaagaatggagtttgctggtcatttcattatcttaaaatgattttacaatctcattttgctggtttcttctccatcagcatgatccattgcatgtcttctatatatggtatattttcctaattattatctaatgaaatgaaaagtaaaactaagttagtgatggatagttggtcattttttagtgtgaggggagaaattcagggaaatttagaaaattggtcccttagaacctcagtgtggaaaatgcaaagtaatattttgcatatagtctacatttgacttttgaataatgtttatccatagcatttctacctctgtcgtgtttgcctccttgagactttggtagtaattcatctgctttgcaaaattttttgaagcatctgtcttctcagcaccatactataaggtaggatctggaagaagaatatgtggttcttcctcttcatttgcttcctctttagttggaaaatgaaaattcttatctaaaaccaatgataatacttaggaatgtgtgcagcagtaagatttatctacataaatgtccaaggttagtttggtaaatgaaatattatggtaagaatttgtgtgcccaggaaatccttgtgtagtggtgagctttgagccagagctcgcttactttggtctggcagagagaagagagaaaaccatgggtgctggggagagcatgggcaaagctcccgtgagtgtcctgagtatataatcactccaccaggaagaggggccatgcttaggagcagtgggatatgactttgaaatagggcagaggactctgaatatgcccatagcctccttccttttcaccccttcattacagaattgctcagatatgctttttgaaaggtggctggcctatgcttgagtaaggggtaatacactcttgttttaaggccctgctgcctgtgtgacttaaaaaggcagtaagtggaagaatttcccttttcatgtgtgttttcatagaatgcagatctcaggaagctcaaggcagaccctctatgttttcctctgcaccctgcatgctctgtcagggtgcagaggtagaatagaatgctggagctaggacagagaaccatgttggagtctcgtgttgccgctcagatctaccatgcctgcaggtttccgtgtctataaaactcatctatagaactcatctatgattcttgatgactctgacttctgcttctgtatactagtctaaaaaaattcaaacaagatgctagtttcactctctgttcctttaaactattcactccaaataaagattatgatcttagtggcagcgattaacccaggatcataaggaaggacgagtgtgcttacctaacagcaggccatgggtttctggcctggccctctttccccttcatctagtctccccagggctccctagtgtggatctacacccagatactggctgggaggcaggacaggtgctgggagtgaagaggaaataacagtggaagcaaagcagaggcatccgtttactagtgtcaactgctgttttgggggctcctgtctgcaatgtgaggtcaagtgatgcaataatgcttgggaatagctttgaatgctctttaaagagagttgtataaggttttataggtatggaatgtatttgaattacattttaggtttgatgtcagcattgctcaatgcttttcatatcttttccttttgtgttaaaactgtacagagttattgtacagagttcccaatccttagactcatttacgtattcatttatccatccaaccatgcactgacattttttttttcattttagcctcttacaatgtactaggttccaagagggatatgagaggaaaacatattctttaccatccaaagctgactttatagttggagaaaacagactaagaaacagctaataattcaataagggagtgagtaagggtccaaaagagtgatatagaaaataaatgctattggaacggaagtaaaataggaaattaaataatagagctgttgggaagggggcagccaaaacgtttaaaagggggagaagattcttggttaccaggggagagcagctccacataggtcttgtgtattacatgttccaatagaaagaactctgagaggggttaataaaacgtccttcggatttatttgagatttgttgaagcaataactcctaccatttaaaaggccccaatgaagctttgaagttaacacctcattgctgagaagtacaatggcttttcattctgtacctttatcccctcacataaagtgggcagaggactctgaatatgccagcatatgttcagtctggattcaaggccccccttccttttttctgccctgacctgcctgctctgctgggatgtgtgaatgtactgcacagaggccaagaggacatggggcatggggtttcccagctgacagccccaatggcaagtacccggtctgttattttggtcaaattccaatttcttttttgttctagagatctccttacccattttccgtcaaccaaccatatttattgggggcctagtcaatgagaaaatgtatgttaaagtaaaggccttcaaatgtcaaacaggtgtgactgttatgaagttctgaaggggaggcaaagaagtatcagacacttctctaccctccacagctcactctcagtgggagccaaacgtgactcaggataagcagcattcgaaaacagtgtgtgaaagatgccacagggaggattcccggccctgaaaattgaagatcagacattctgtttgattccctcttatcttggtttcacacactttccacttgaagacccaagaaacctagttgggtaaagagaggctatttccttttccctcatagaccttgggaggaggggcaagatgttttaatttttattagtgattttatttttatttgtgctccatggaaatgttattaatatattctttcctgtgtatattaggttgtgaaaaattgctgctgccgctgctgttactattttaatgagcaaagttcttgcagctctttttatgacagctacatttgtttgcaagctgtttggctttggctaggggtgtagacagcagttttggaatgaaatgcatctgtaggaagccagcaggtcctaaggggatcatacccttgaccttggtctcattcacatgttgccctgagcaaccaaactaattgcccattatttagcagattagatcaacaaggcctaaaagagttattaataatatcccaaagataggaactctcactggggcaacacttaggcagtagaagagtcaatttaagtattttgagatattttgagtatttttcatttaggcaaatcaacttctaagatagcaggtgtgtatgtgtatgtagatagacctgtgatcatgttaaccaaattccttaagggtaactaagatagcatatcctttgttagaagtcaaagaggtctgtctagctgtggctgtgattttgtgatattgagtaaatggcttcttttctctagataccagctttcctatttgtcaaacaggggttagatttgcattacctaagcagcaaattaagagtttagacttttccatcagagttcctcaaccagcataaaggagtatttgagtaccttgggggatctcggatcatagcctaaagctttacaagagcaaaattttgttgaagtcattttttatttatctaaaaattcacataaatgttgcactctcctccacatcatattcatgtttattgtatagtgtattattttccccaagttgagtaaaaccaacccatcaggaaaatgcacgatgattatcttgggcttctagtaactcctggcagtcccccaggaagatgtaggcacataccattttgaaactcttcgcaccaagtgatctagtgttggctatagcactctcaacttctccactgttcagcaaagcctaatagccgaatgtactttgtatatggaggagataacatggataacagcaaaaagaatggacttgtgcaagttgttccttgctattttaaaaaggtccccaaaccacctttggctttatctatccagtaagttgtagtcatgagttttaaactggctcttgggagctctgagcgtaccaggcatatcactgggggagtggctgagctttggttttatatttagaaaatcagattggggttgcactgcttttagaactctaggccttcataatatggactcttaataagtcaaacttatattttgcttactttagttgatgtaacatccagttagttctatgttggtaagtttgtggctacaatgtggttggtgacacaaggatgactagtttaggatacaatgtcaaaatagcccaagcaggggttctaaaagaaaacctgagttcatgtacaaaacagacattggaagcacagacacaaccttattcaatgaaagaaaatttaaggatattatttgcttctgtaactattattatttaaaaatttgaagattaggaaggagtttatagtctttcttttaagtttaggatttctcccaccaccttatcatgattattttataagggatctcgtatggtactagagcaaattgttactatttcttcctagagaacatgttgcaaaatgtttcaggaacatttcttggtaacataaagtgactaagcaaattccagaaaattctattgtttgtaagttgaaaaatcatcctataatccctttcaagtcaacattagcgctctttatcaagaaagagtccattctcaagacattaagactcaaatgcctagaagtgattggttaaaatactgtaaacctagcggaaatttgttgcattgttttctataaaccataaccagagctcattaattgaaaaacaaatgtcattttgtgttagctagcatctataaaccaaaaaggtacagtgatcctggcatgtgatgggcaataaaaacatcagcaaaatgtatcaggtaaaattgagaggaaggagtggggaggggtaaattcaaaaccatattggagtttactgccagggccccacataaagagttttaatgaggcttctgcatcaaaataagtgaaaccatacggaattgtaattattactgcagtgtattttaagtacagatacacctaagaagcagtttttacattaacatgtctatctgtgtgaactccatacttctgcagggggcacacgttggcgttttaagtgcgacttctttctgatacacgctgttcacattattctggttcttcttatatgatctaaatattgaacttaatgcatacagaagtgccctgcccatcgctgttagttctgccagctcaaggtcacctggatgccctgcaatgcagaggctgcctgaggaacgtctgtggcctccatttggcctctgtattgtacgaggcagggcacaagcactgggcgggggaaatgttatggagcatctgctcccatttctgattctgtcataatcgctgtttccacatttttaaatttaagcttgtcagaatttcgtttttgggaggaataggtagaggctagttgaggatggaagaatttataaaaagcagagagtgactgcctgggctgtcagttttggttcttcatcttgaaagtgtttgcttctggccttagaagctgctcactagcttttaccctctgcttatgggcctgcagactctgggaaatactaatgagggatgggaacctctctgtctacccctcccctaaggctgttgcttctccttctctcttggaattcatagtcatagaacattagagctggaagggaacttagagctcatccccctcattttacagatgatgacactgccacctctgacttctgcctctggccttccactctcagtaagaagagccaggcaggtgagacttttaacaattgctgggctgggcagggctgggctgggctgggctgtctggttgttactgtccgatttgtgagttttgttaactatatgttgcttttaaagagtcactttttattacaaatgcacatcatggcacttaacccttgcattttgtgaagattataagcagtgtgcattttaacaaaaattaataaccttcaatcagcacctttaaagaaaagtgttcggattattcccttaataaacatcgtaatatccaagaacaaggtctgaataaaaatgaggtgaagaagtacccattcattaaagtcctcaagaattgtttagtgctttcctttatagctaaaagctgtaggagaaacaaatatatgagatctgaataatcaaaatattttagaagggaacaatatcttaacaagagcactggtattagaaaagggcttgtcacaattctgtcaattctagaaaaataataataaacccaatctttaaaggtcacaactacaagattctagcatttcagaaaacaaatttccacatgaaatggtttataacggtggtttcataacttaggcaccagaaacatctattaaggaggcctactgttagctttagaagtgaaaggacttcatgttttaggggaaaaccatctttgccttcaggttactgcttcaagttgacctgaagctggttctgtaggatgtggtgctggggcctgggagacgggtggggagtgccctcctcttaatctcccctaggcagcgagcctctcgcaaaagctactgttagcacctggtctaaatcaggtcacaagtctcccatcaagacttgaaatcaatgattcctaaggtaccaagcccccttgtgcctcctaactcccattttcaaaaccgactgatctagtagcttatgaccctccctatccacccccagagaagttatgagtttctggtttgatttcactgttgctaagatgagacctctgacaagattttaaattctttaaaggccttaaaggaaatgataggaacatgataggatatctttttgatgttccttcattgatgaaagagcctaccaagagtaaataacagtaagacattattttggaatttctttatattgagttgaggaaaataaacttgtctgacttagtaaaaatttcacttcaaatatctaaagtgcaacgagaagcaaaaagagaaaaaaaatccatgaggatttggttttaaagtctggtgagtgaacctatgtgatcagagtgttgggttggtttacacattgacctggcacacatgtgggtttttaaagccctctgggattctctgggggtgaagaacttaaggatcaatgctgttaagactgcaaagtgggggaaaaagactgtaaagtgactggtgcatttgaaggtctgtctgtggcttgctgttcctttatgggaaagctaaagttttctctttttttttcttgtaacaattctatcattattttaattgatatttacagatttttccctccatcttctgttataatttttaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttcttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattcctaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgttatgtgtgtaccttgggtcttttcttgttcacggtttctccctagtctgatgtctactcctgcttacacctgggcactgtttggtcttaggacttgccagggctagttaagagaagagatgctatattactggggagaagaaaaaaaatcttggtaaacggtgtcttcttgttttgtcctgttcctagcgaggggtgggcaaagaatctagcagtgaactcacttccttactagcttgtgtctgaaggaaggagtgctcacctcatccttgagtaaggccatttattccaactgggggacctatcaggcgtatagatgcagtctcgatggcttcatgattctaatctctgagaacatgaacagggccccgcaagtgaacctctggctatcaacagaagatctcaggcagcccagatataggctagtctgttttcctttccacatctcttttgggttcttaaaaataaagtcaaccaaagcccaaggatgagtaaaaacggaccttggcctggagggctatagcctcagaagaattctcctagtgaacataactatagtttggagattttttttttcccgtggccattgtttatttttggtaagtccccccccttgtgataaggttgaagacctggggtagaaaggttgctttctctgtgtcctatgctttctgaatgcttgggctcaccacaattctaaaatagggacccaggaaaacatggtgcagagaaggtcagccagtggccaagctgacccacatcacagggagagttagagaccttgaagatctgctcattcttaaccctttggcactattttctaagaaatcttggaaatagttaaattccaagaataggaaatgtcctgaaagcacttgggtgagcttaagccagggaacttgtctgcaactctgaggatgtagatttatttatttaaaaaaaaatcaaacatctgtgtgactttaaagggcattcacaagggaggtggtcacagtggcttgctttctgtctccagttttctctatcaggatggtctagggcaaatccctttattcctctgtgtctcagtttcttggtttatgaaaaggcattgggctagatcttggcactattgacatttcagactgggtaattctttttgtgtgtgtgtgtcagggatgctctcctgtgtattgtaggatgtttagcagcattcctagcctctacccactaaatgttagtagcacctccctagttaggacaatcaaaaatgtctccagatgttgccaaatggtccctgggtggcaagatcaccaccgattgagaaccacttagctagaggctttattgacagaactgatatgagaatacattgcttattaaatcagagtagccaggcagaggctgagggacttcccagtgatggctacacctcaaccttttccatcccttcacttgatttggatgtatcatgagggctgctgttggctttttcgtctgcacctcttcactcctctctgcaacatgggctgtgcagccagtgaacagcccagctgtggggctttgttaagcctggattggttggccatatttatcatggcctgtttctcactgaaacggcaggcggaagaagaaagcaatttctgcagtgtttttgacccctggtgtcccctatcccccaaatatttaatcatcaggcatttctgcaagagtgggtgtttcctgttaactcaatcccagccgggactggcccaataaacacctcaggtctctgtcatagagtttatttggctgggaaatgggtattgccatgtaaacaggaaggcccctgaagttattatctacagacgcagtggaagagccgcatgtttatatttatgggacttgaaaacagtatgaaaggcaagggaggatgtcagggaagccctcattggcagtcagtgagagcaggtcctacagctctttattagttaatttttcattctctctggaaatggttggtaaacaataatgacctagccaagagccactgcagaaatggaggtactggcttgcctgtacctagattaccaggttaacaataagaaatgctatcagttggcctctctgtcctaactattcgaaaattattttagagatcagtcctaggaagcaacaatttggaggtatctaaaaaggatgcttatgaaacagtgtcaccatctctaagttcttctggggaagtggaggacaactcaactgactgctccagttgtagtgagtgtgggccagctcacctgtgaaaatcccaagcaaattctcatgcattcactccttagtcagtttctgtgaggctggaaaggacatcttcatgcaagagttcataacacctgagctgtccaggtattggtactgggaatcaggcttacaccctaggcctatgcaccccaggtatactccaaattgctcccaacccttctcggctcttccattgtctctctcctctggcccggaaaaggtgctaagaaaggccaggtaggaaccagtatgtggagagctgatactcttgatttaaactctgggttctgagcaaaggcaagggagtctttccttcctcaccaccattgctgtggaccctgagaagcctctttgtgtcttcttaggggcttctcagcagtaactactcaatcaggaggccttggaaaggaaattttaaaaagttatgaatcaaaacttaccaaggaaaaggatccagtgaagacgcaaagggtaatacaccagggatgtgtgtgtgtgggcgtgtgtgtggtgtatgtgtgtgtgtgtgtggggtgtatgtatgtgtgtgtatatgtgtctgtggtgcatgtgtgtatgtgtatttatgtgtgtggtgcatgtgtgtatgtgtgtggtgtgtatgtgcacgtatatgtatatgtgtgtgtatatgtgtatatgggtgtgtggtgtgtgtctatgtgtgtatgtgtgcatgtgtggtgtgtgtatgtgtgtatatgtgtgtggtgtgtgtgtggtgtgtatgtgtgtggtgtgtgtgtgcatgtgtatgtgtgtggtgtgtgtatgtgtgtgtggtgtgtatgtgtggtgtgtgtgtgcatgtgtatgtgtgtgtatatgtgtgtggtgtgtgtgcatgtgtatgtatgtgcatgtgtgtgtatatgtgtggtgcatgtgtatgtgtgtgtgtgtggtgtggtgtatgtgtgtatgtgtgtatatgtgtatgcacacacaggtatgtgtgtgcctgaagggagggaaggaggagggtgaagtttggaaagggtacctgaacagccacccactcagagaaagatggggctcaccatccctgcacatgtactcaggagacacagtgtttcttggcctcagttttttatttctgcaaattcttcaaaaaaaaaaaaagtactgcctttatcccacaagtgataaagaaacaattacttgtcttcaaataggttactgggacaagggacactggatgctccttgatatgtcaattaagggagcagggagaagctaacatttaaggagtttttagtaatttttgtaaagctattattcaaaagtttgtgactcaatccagccctgctattcagatatgctcagccatttgggaagcagagggatcaaatttctggaaacacatttaacatttaccaaaatgtcttttaattcctttcttattatcttgttgcattgatgtcaggccacttagtggggttttctgcaaaacttgcttcctgttttagcactgcaaacatagctcacttcttgattgctatctattctttccaggtcattctgtcccactctgtagccaataaaaagggaagaatttccccaacctgctattcttataaagaaatcaaggacatagagcaaaatacttttaacaaaaaggcaaaattcttccacataagcccttcagggagtagctcttggagcagtaacattaaatgggaccagaacacaaaagcgcacaggctcatgtggccttaggaaatttctctgggaggaccaaaagtactagagttaacccgaatgtggaaaatggaaataggatagagtgagcttcgtggaattagagatacagtatataatggcagaaactaagggtgtttttgagagatgggaatgccaagaacacccgaaacacaattggatgatggattgatagaaaagtacaaatttatttaaaagcagcaaaaagcagataacaaaatcacatgacatgtagaattgtggcacgattaataaaacagtgttaggatttaaatcaccttcgacatcctctctttcctaaaccaagtcacctatgtatcctaactccatctatctccagcagtgaaatagttggaccaatttcattttctgtttctctgtgagtttcccttcattcttctgcccccaaatgagaggagcgttttgtgggatcattatttatcccagaaatgcttcagcctgattttgttctccctaaccatcatttagtatttaaaatcctagaaatcacaatgactttactcttttttagtagagtgcttaaagagtctttgtgtgtgtagatttgggggcgtagaacatttggctccttgcagaaatcttatttatggcttcacagatgagaaatacagagattattattgaatacgattctcaaccacaccttctggagcacaaactgtgagctcaggttgtgcagggaaagattggtgaaccaaccgtcattcctcgtgggcatgagagggagagaaggatccaaggagaaagcaagtttgaacttcagcaaggagttaagtggttaataggaactcagtttttttttttattggctaataaaacctctcagcgtttttcatattatatggtcccttcaggctcctagcccaatggcttaaaaaaagggaaagacaaaaacaacaacaaaaagctggagcctaaataccaatgcagtcccagtcttgtttactttttcatttccgcagttgtaaaaaaaaaaaaaaattcctctggtagttcaactttatcataggaattgcaggaacggaccggtgtttgaacaactccagtcattcctgcctcccagtgaaaggaaaaaatatgctctgtctgtgtgtgcctgtttcagaaaaaaaagttgaccacgctgcaagtgatggatgcatcaggaaatcttaaaatgaaagcaggggtggaaggagggagcgcagatattgaactgaaacacatctctggaatcctgaatgcaaatgatctctgtccttttattgccagtggtgctgttctcccaacagagcaggatgttcttgtttttaataatagccaggccagatgctaaattcgcctcagcaacatgctgtataagtgagaaggcaaacagctgattcctgttaagacgaacaccaggagaataagccagaaagtatgagaattctctggaggtttttgctttgtaaacccctgtttggcagaaagatcacagaatctgaactgaaaacacagtgtgtcccctgcacccgttcctcggcggagctgcttgctgggggcctttaagcctctcgccttcgccatccagcccttttctaagctgtccagaagacgagcttacaggtttcccaagagggaaagtcggaagccctgagtcctttgacttttaatgactgtagaaaaatactcatcaataggaggatttttttttttacttgttccttgcagtaaaaaatagcgaaatcctgaacacgagccagtatttttaaatggcatctttgttccatctttttcactaccttcttccccctgtcagagtccatcaaatccctcagatactattcctttcagaataagccacacatgcaagatgctgctttcttctttcccagggagctgccagagcctgtgtggtgttctgtgcggctgggctgaccagatcagacagtgaccaggctgcacgccgctgctagctcatgccacctccaaatgctgccctgaaggcccttcctggagagcaggggtaccctgtggaaggggtctgcagagtgttgtcttccagtcattcctgggggctttgcttccaaggcctgcaggaaagtgagcgagagaagaaggggatgttaggaggaggttgagaggctcgccccaaaaataagttccccaaagacccctttcattacctttcctgttcatatcatcctcctaaaccctcatactttctctctccaattgccacatcc

SEQ ID NO: 1577 - DNA, 1524 bp, Homo sapiens
atgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattga

SEQ ID NO: 1578 - protein, 507 aa, Homo sapiens
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 1579 - DNA, 41554 bp, Mus musculus
  misc_feature (1)...(41554): n = A,T,C or G
acgaggccgggactattgagggtttctgttgttgacataaacaccatgaccataagcaagttggggacgaaggggtttatttcatcttatatagttcaggtaacaacggttcatcactaagggaagttggggtagtgactcatcctggaggcaggaactgatacagagtccatggagggatgctgcttactggcttgctcctcacaggttgctcagcctgctttcttatttatttatttatttatttatttatttatttatttatttatttattatatgtaagtacactgtagctgtcctcagatactccagaagagggcaccagatttcattacggatggtttgtgagtcaccatgtggttgctgggatttgaactcggaaccttcaggagagcagttggcactcttaaccactgagccatctcgccagccctcagcctgctttcttatggaacccaggacgaccagcccaggatggtatcatccacagtaagctgggcccgctcacattagctatcaatcaaaaaaagtcctaaagtttgcctgcaggccaatctagtgggttcttttctcaattgaggttcctttctctcaatgactctagcttgtgtcaaactgacattaaactagtcagcattggccctaacaagtgtgtgtgtgtgtgtgtgtgtgtgtgtgtgtgtgtaattaaaagaacaaaacaaaacaagaaactggagagatggctcagtagttaagagaactggctgatcttagaggccatagtttgattcctaacactcacattgcatcttacaaccttatctataactctttggcctccaaggaccaaacaaacacaggtgcaagcaaaccctcagaaagtaaaaatgactaaatatttttaaaaataaaataagttggacatggtggcgcacacctttaatcccaggactttgggaggcagaggcaggtggatttctgagttcaaggtcagcctggtctacagagtgagctccaggacagccagggctatacagagaaaccctgtctcaaaacaaacatacaaaaaaaattaataaaataagaaaaaaagaaacaattgttagctttataaataaaattgtaaagtcaggaaattacacaaaccttagaatctatgataggtagtaatgtagtaatactatcataaagttatgttgttcactggctgtaatacacaggtaatgacagcgtttctgaacctaccatgtgaggcatggagcctgttgttggataccagctgtgggatggaagacaatgggctgactagctgtggtcctctggctgaagcctccctggggtagcctcagttcctgctttctcccaaatccttagaacatcacctgatcaaatttctcaggaagtaggggacagccttggaaagtctagttctcatatccattccacagtgggacaggggctcctgggcctcatttcattcactcggaggcaggctcagcatcctctgtacccagcatcagctcaggtgtggagatttttgttctcaaggaagctccaggctacttacttacttacttacaaaacctaccgcgtagctttagacaaaatgtttgtgctctttttctttctcattctcctctagactaatgaaaaattcactaggatgacttcgcatttctgctcaaattgtgtgccgagctcaaaaggcagagccccacttcaccagggaagcaggagcacactgagaggcggcagctcctctcagagcccttagggaacaagggacatggggaaacgacagacagaggttagagggtgcacagaaacacagttcaccagggcagcctcagctgagcacagtgacatgtttaaacactggcaatcaagccggacagtgctggcacacatgcctttaatcccagcacttaggaggcagaggcaggtggatttctgagttcgaggccagcctggtctgcagactctgtcgagtgagttccaggacagccagggctacacagagaacatttctggacaacgctgagcccaacgatgtaggcaagaggagaaatttttttcccctcctgttcagagcactgtgttctctgtgggtgaggcctcccttcaaaggaaactacttttatcagagccttatcaacccaggggaaagccaattagatatcttccgtttcctttagttttgtgtctcacaaaaaaagaagaggaaaaagctaagatatatcttgaaggttacagtctagggactccggcctactaaaatatacaccctcatactgcacaaaagagactttattacaagcttcccatcacgagaaaccttactgtagcatcaacgtggcttcagtataaaaacgggaaattacaattgagaaagctataagctttcattcaaacaagtttctagagaaacttagacaagggaagcaaattaaagaggaaactgaagcctttgacacagttacagtaaacgataaacagagcctaactccaggcagatacatacaaaatcatcacagccctgttcccctcagtttctatgagacaacacattatgcctaactactggaaaattatagaagcaagaagaaagaaacccaaagacaggggctatagctcagtggtagaattcttgcttagtatgcatgaggctctgagttggtttttggttttggttttggccctgagttttatatatagaactgcactctctctctcattctctctctctctctctctctctcattctctcattctctctcattctctctctctctctctctctctctctctctgtgtgtgtgtgtgtgtgagagagagagagagagagacagagagagaaaatcatggccactctcagacatggcaaagatgacattactgagctaggaatttaatattaccaggatgagtattctaagggttctggtggaaagagaaggccacatagaacctcagtgctaggggtgtcggggggggggggggtggttggcccctgaggccaaccagtgagctctaaatggactaagagatcctgtctcaaagacaaagatagaggagacacgtaacacctaacagtgacctctgacctccattcacatgtgtaaacacatatgcacacacctggacaagtctgtatacatgcatacatacattacacagagacacagacacacgcatgctagacagaaccttttgctgggtgtggcctgggtgtgcctttagtcccctttcaagggtagagacagagaaccgggagctcagggccattcttttctgcagggcaagcttgaggcagacagggctacatgtaactttgtctcaacaaaaacaacaaccttggttttgcagtgagttttatagataacaaaagaatgatccaaggaggaaaaagaagcataagttttatttcattaaactaaaacctccacatctgggaagttactgccaagggaattaaaggcaaaggcaagccacagccaagaggatagtcagcagcacacatctgataaaggacaggaatgcagaacgaacaagtcccaacgttcaacaagagaacagacgacgcaatctaagatgggtaaaaataataaaatatccagcactcaggaggcagaggcaggcagatttctgagtttgaggccagcctggtctacaaagtgagttccaggatggccagggctaaacagagaaaccctgtctctaaccccctgcctccaataataataataataataataataataataataataataataataataaaagcaaaaaaagggggagagaaagaaagctcagcagttaagagacttggtgttcttgcaaaggatccaggtttgattcccaggccccacatggtggtgtataaccatccacaacagttccaaaggacccgaagcctcttctgacctctatggtatcaggcacacaagcggcatacagacagacagactgacagacagatacaggataaaaataaatcaatctttttttcttaaaaaaagaaaaggaaatggacacttcaataaagatatacagatgataaatagctcatgaaaaggtgtcgctaaggaactgtacattaagacagtaatgagatatcatgcatgccaattccaatggttcaaatcgacaaaacaaatcaacaggaactaaagtctgacacaccagatataggcatgctgagggagcaccactctttcctgctggtgtaatagaaaatgtacagtcattctgaagtcagtttcttaaaaagtcagaaacaggggccggagagatggctctgtggttaagagcactgacttaactgaggtcccgagttcaattcccagcaaccacatggtggcggctcgcaaccatctgtaatgggatctgatgctctcttctggtgtgtctgaagacagctacagtgtactcacatacattaaataaataaataaataaatctttaaaaaaaagtagggcatgatttaggggctagggagatggctccatctgtaaagtgtctggagtcacatgcatggtgacttgagatcaaatcctcagtacccataataatccaggcacagtaagacatatctttcacccattggtcagccagcctagctgaatcagtgagtgaaaggttcagtgaaaaactatgtctcaaaaaataaagcaagatgaagggcgaaaaagacatgcaggggctggaaagatggctccacagttaggagcccaggctccttttccagaggacccaggtttaattcctagcacccacatggtggctcacaactgtctgtaattgcagtcccaagggatccgacatcctcttctggcctcagagggcacaaatatacatgcagatcaaacacctgtttgcacaaaatttaaaaaataaatacttctattattttttttaaatggaagactcccaacgtcaacctacagcctgagtgcattcatgcatgcatgcatgcatgcacacgcatgtgcttgtgcacacacacattagacacatttaaatatcaacctaacagtcttgctcctacatattaactttcatgaaccgaaaactgatgtccacacaaaacctgcatttaagtgttcacagcagggttagttatcattgtcctaggcttgattgagagctcccttgaagctccattagttcccagggctcttcaaccaagtgctctcaactaggtggctttgaaacacaagccacatagtatctcacaactcactgacttcagtctagaagtccaaaataaggtatctatcggccatattctctcccagactcaaggcagactcttccaagggctctctttagtttctagtgttgctagtactcctgggtgctccctggcttgtagctacatcagtctaccccttgcctctgttgtcagagtattctctgggtgctctgtctccccatggcatgctccattttacagagccctgtcctgagtcaagacctactctaatgacctcatctattttgactatatctacaaagagctttttccaaatgaggtgacattcataggtatctaaggtctcaacttcaacatactttcatggaagacacaagtcagtctggctaatttatgtctttaagacagtatgttagctgggcagtggtggcgcacgcctttaatctcagcgcttggaaggcagaggcaggcaaatttctgagttcgaggccagcctggtctacagagtgagttccaggacagccagggccacacagagaaaccctgtctcgaaaaagaagaagaagaagaagaagaagaagaagaagaagagaaaagaaaaaagaaggagctgggtgtgatgtttcacacctgtaatctctgcatttggaagactagggcaggagaatggctgtgagttcaaagccaccctgggctgaagggtcagagactctgtctctcttttttttaaggtttgtttatttatgaatttgagtgttcattctacatgtatacctgtaggccagaaaagggcatctgatcccattacagatggttgtgagccaccatgtggttgctgggaattgaactcaagacatctggaagagcagacagaactcttgacctctaagccatctctccagcccaagagaccttgtctttaaaaaaaaagattagctttattagttaattattaatatagttaattatttattataatttgtggtatattcatttaacggaatagtgttcaatgatgaaaagaaatgagctaactagctataaaaagacatgaaggaactgtagtgagaatcttggtttctttaaaaaatacagaaataagaagtgtttttgttttaatcccaggagtgggatatgaggttgcttcacactgtccacagcagctgactatgatttgcctcatgctctagcaggggtgtgattttgccagctgcagatagtttctgcagtcatgtgacatttaaaattctggggacttttcagagagtatataaatactgggtcccatagagagggtgtgggttgttggttggttgatgttgtttgttaagtagttgtgggcaaagaagaaattagatatcctgacaacaaagatcaaactttccccaagtaactcgatgccccctaattagcaagaagcagtgtacactaactttgctcctgtttaccctctatctttttaaaaatctcctatctagtgttagggggttgaaaggatttggaacaaaaggggtggagaagggtggaagaaagaagaacacacaaagtagcaaagatacaactccaaggagctttaaaccatattgactcatgaaaaatgtcaatcagaaaacgctaccgtgtaaaatgtcaggtagttgccagaagttgagggtatgaaagtaggggatgaaggaatgaagcgcaggggattcttagggcagtaaaacttttagaaacagaggtgacattatctgtcatgcttggcaagatctatgggagtttaaaatacagagaatgcagtccaatgtgaaaaccggtgctggttaaagataatttatcaatactgctcatcaaaggaatgtcagtatgttatcaagaagagaaatgtgcagtcaggaatagggaggtattggaatgatgtaccgtccagtcagtccattctttcttgtcccgagactggccatgtgcccgtctcccacactgctgtaatcgctggcccattaggctagtcctttacccaccctgtgctatttagtttttgtcaatttgacacacactagagtcacctagaagaggagacctcaactgaaggatcacctgcatcagattatctctgggcatgtctgtgggccatattcttgactaatgattgatgtggaagggcccagtccactgtgggcagtgccacccctaggcaagcggtccattgctgagcaagctatgggaaggagatcgataagcagtgttcctccatggtgtctacttcagttcctccctccaggttcccgccttagctttctttagtgatggtctatactgtggaaatagaagaccaataaaccctttcctccccaagttgtttctatttcagcaacagagaagcaaactggaatatacctttgaacccatcagttgattgttgtggcttgctgacccctggcctagaatgcagagatggtgaaaggatttaatccatgcaaccctatagcaggcactaggggaggcctgacaaagagcaattctgttgactccatgtaccgatgatgtaacttgtggcgtaatcattagaagcctctaacccattaggcttctgtctagatggaggcaaaagactgtcctgtcatattagagctactgcactctgaacagactctggatttgtaactggtctttggtctaccaaaaacaaatccccatgaggttcttgtggtattaagaaacccatccagtgttctagttcagtggttttgattaaaatccatgatataaaatccatgatatatatatccgctccaagcttccgaatatatatatatatattacacaatgcacccttttttaatgtttatttatttattatatgtaagtacactgtagctgtcttcagacacaccagaagagggcatcagatttcattatggatggttatgagccaccatgtggttgctggtatttgaactctggaccttcggaaaagcagtcagccctcttaaccactgagccatctcgccagccctacacaatgcactcttaatctcattcaagttaaaagttgttgtacttggttcaggactgatgtggtctgcatctaaagaacaaatgtctgtacaaaagacttgaaaatgacctttataccctagaaagtctgtgtatacacacccaatctgaagtagacagccactccatagtcccagctaccatatagaaatgtagacagcagttttctgtccatagaaatctgatttgtatggttctgagttctataagaaagcaggctgagcaaggcagcatctctcctccatggcctctgcatccgttcctacctccaggttcctgccctgtttgagttcttgtcctgacttctttggtaatgaataatttggccgtgtaagtcaaataagccctttcctccccagcatcacagcaatagaaaccctagctaagacagcagctaactcaaagtgtttattcattctggaacagtacattgggaggatggggagttatataaatgaactggggtgctgataatgggtaaggacagagctctgattgtctcgcccagggaactattaagtcggagccatcagcgatgggtttcaaagcagcggacacagaatgacattgaaaagatcatttggtacttgatgggggcagggctggagagtcaagcggtgaatttgaagtctgtcattaagctaagtgagggtaaaaggagaaatgacaaaggcctattactttgttctttcactaaaaactgtaagcttcaagacgcaagtcttgctgtactccccagcactctgaaaattgccacacggaatttgtgggaaatgaacgaaggcgtggtggtggaggtattttgaagggctagacttaagggtcaacaggcttgagtgaagtagtaataaaatttaggtaacactgaaagccgtttggggatcccagggttctgtctctgacgatttccctttgaaggatacttggggaccagggaatctcaacgaagaactgatgtacactggtttttttgttttgtttttctgtttttattaagaccttggaaatgttctgttcctggtacttcatgaagcgtccttggtctaggaaaagaacagtaagtaccttttaggactgaaaggtgaactaactgaaaatggagggctgtctgttctcctttagttacaagcattcccttaacgcacagctaaaagcactgctaggctctccgaccccgtgagaattattttcagggttgggtaggaacagacgatcctaggctcaaccaagaccgctccaagcttccgaaccctgccctcccggagcccgccctgttctcacacatcccagccctggggcggccacctcggccccgccctctcttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccactgcccctacggtcgctgccaccgccgctgccgccagccccgcctgaggagtgagcccgggaaggacgcagtcgctgccctctgatcttcccggaagcgcctttgctccctccagtcctccgcggtgagtgcggcgtggctcccaggggccccagcccaaagccccttgtcgggcggcggctgcggccaggctcactgtcgccgccaggcttactgccgcccctccccgcttccggccaggcctgcgcctccgcgggaagcccgggcttctctctcggcgcgccgtacggggtgcggccaggcctgcgcggctggggaccgctgggccgcaggctccccccctccggcaccatctctgctcggcgccgcccctgcctgctcccttcgggccccgagccatccttctgggcctgtcaacctctctcattctttgtggctttcaaaaattgaaatgttagtcgaaggcgggcgagttcccgagccgcgacgcccctgccgcactcccctggatgagtaagggtttaaccttggcgacagctggggcgaatccctctcccactttgcagtaaagctgtttcatcatcgctggtgtgggaaacccagctggacccgagattccctgacagcagggttgaggtttgaattaagaaatggatttatctgaacctttcactgactcaaaccggattcccaatggggtgggggaagatcaggctgagaattgagtcttttctcttgatatttgtcgtcttttactgccagaatctcgtgtgtccatgccccaaattcatccatacacttttttgtggcatatatatatatatatatatatgtgtgtgtgtgtgtgtgtgtgtgtgtatgttatatattgtttgaaatttgtctagtaacctcagtgtttgaggaaggagtaggcaagatgtggacccttttttgcaagatgagcgcatctgggtctgttgcaaatggagaacatgcgtgcatcgaggattccaaaggtggcagcgttggtgagaatttgccaacctctgtaaaaatgcatggctcatgtccttgccttcagtacattttctctggtgagactagatagcactggactcttgattttacttgcctggtgtgggaggtggaatctggcaagatgttacaaatctctaaaatcccgggagccggtgcagaaaggtgtagcgcttaagagaatatgaaaattacatttctcactgtatctcaggtgttcctgtgaaaccatacagacacacagtttatgggactgaacacgtgcttactcagcatctcacatctagctgctggaaatttatacgaatattactgggatcttggtggatttctcttgactgcctccagtgcaatccatttctttgggttgcccgagtctttttaaaatttttttattttattttaagatctatgtccttagcattatatagccggcagatactggtttgtttgtttgtttgttttgtttgtttgtttgtttgtttttttcatccccacccaagttagaattttaagcatgaccttagaaatgaaaggctggaaattcagtactaaatgctaaattattttcttagcctctgccttctaactataagaaaccattcacccatcttacagatgaagtctttataagaaatgaggtgatttggcctaaacctcacacctacttacagactgaatattctctttcatcggtggcaagtatttgtggactgtcagcccctggagtatggctcctaccctgttatcttccatttcccatcatgcagtgcttgggttatattgaagccattttagagctggagctgtctggatcagggaggcagcctgtgtggaaaccaggccgagcacactcccttgatgctcggtccctaggcagagtccccagagatttgggctgctgcaaaaagtgcattttccccatttggctgtggatccaaaaacagctctggttaggtgactttgattcagttcttccctcgattgttttctggctgtgatcttccttcaggagttaattcatctcagcttctgagcttccctgtctcaccgttgtctgagaccttctgtaaactgtgttaagtacaagcttttggttttgttgtatttaaatccctgacttcagtgttttctttctccctttctgataaggtgcagtcttattttttacacttgctatgacagatgatatgaatgttccatggagaatatctagtaactctcatctggactcaacaaatgacaactgtttccctcttcccacctcttttgttgtgtagcccagcctaggctcagactcactgccccagtcttctcccttctgcctcttggatgctgaacttacaggtgtgcacctccgtgctgggctagtaatacagcttttgatgtgtgctggcagaaaatggaattaaacttctgggatacagatattcttaatacaaataaggttaataaacaaattgaacacgaatggatatacccctgtgtgacgtttaagtatatgtatgtattgtggaatgcttaaatagcctatctcagacttggtctttttttatggtgaaaataaagtcgattcttctagccagctaagaaatacagaacaatgttatgtataatcagggtgaagtgcatagcacgactgaactggcagctcctttgtaactgtaacttacatccattgatccgcctttatcttgtttcttactgttcacatacatgagttcacactctgattaggtatagcatatgtgcctgtagcatagaaacatacagaagctacccgtgtgactagtcattagctagcgggctatcctcaggtactagcccgtgatcacactactcaccactggtagtacttggtgtgtgctacacttcctgtaagcgctgcaagcctcggttcagtctgcagccaatgagaggtaagtgctgttggcttcatcctacaggtgaggaaactgaggtgcagagatgagaatttttacaaagataacatctatgtaacacagacttacatgctgaaatcaggagttacacccaggtcatttgactctgggtaatgatagatttaattgtggttgaacatgtattccatgaccacagttacttgtacaagcaccatattaatgtgctcagattccagttttagctgttctcaaagtatacagtgccatttatttgcagggtgatattactggtatgtatcagatgaaagctgctaaaaaggccagtttttctagcatttgctttatactagggagaaagtccatcagaaaactgcagactatattttagcataaccatttgtggttgctagccatactactatatagtattttaggttagattttgtatgggagataattccctctgtaagtagagaagttactgcatcctgagagaactgggctcctgctttgtcagcggcatcaggcaaaagcaggcgtgtgagggaggggctctaggagcggtgacttcattgtaagttggtgtttagatccttggttggctttaatatcagcccttgggggcagaagctggctgatccttgggggacagccttcattcttcatagttccagcagagacagagctatagagtgagacgctgactcaaaaacaagcaaacaaaaaacaaaacaaaacacttggtttatacgttacttaaggagataagaattcagacgagttaggggccaggagcatatagttacataatgactttaactttagatctatcttcaccacaggaataggattttagtagatctgcatttcataacaagagacacttggagctggactctgaagagtttttttctaaggagaatgttaaaggaagagatggatttgaagtgcttttctattctgtgatatgtctattaaaaacaactcggcggctgctttcgagaggcctatgtttctagtgcttgtagcgagatgaaagtgatcagtggcctcacagaaacacgctattctggcaggttgtaggtagacttttacttcaagttctgcccagttcttggttatgtaagtttcctgttctgcttgtttatttaattgttttccttaaaggctcagctagaagaattatttctgaatggccttgacacagagatgaatagccaaattaaagtagatctgagcctggtctgtcattgtcctcatgggaagagccttaaattaaagcttatctgaaagtttgacgagtgtttgtatgctatataactttacatgattcttcacaacaattaacagtagtactttaagtattgggagtcatggctgatcttaaaaagattgctacattgggaaaagaattaatgttgaggggctggtgaaatagcttagctggtaaaggtgcttgcccccaaacctgatatttcagcttcaattcccacatagtgaaggagagaaccaactccctcaattgtcttctgacttccatgtgcacccaaaaatatgtcaactttttaaaattaatgctgtgggaataggagatagctttgtggtaaaacacttactatgcaagcataaggacccgtgttttctctccagcaatcacgtgggaaagccagatgatgtgtgcatatctcagctcagttctgggatgtgcagagagaacgtctagagtgctgcgggtggtctctgtgagaggtctgtctcaataaaaacaacccaaggacagtactgaggaatgacacctgtggtctgagtgtgcgctcactcttgtatgtctcttgagatggatcccaggtatcttaaccaatataaattcctaaatgtgttgcccatttcagtagaccataaatgttgatagtattgttacttagcctttttagttgggttttgtatgggtactcgatacatttggtatggaagatattatttgaaagtattttagggacttgttggaatccactgtgagtctcttaagaatgagagcctagcctcgtcctgagctgagctgaggtaatgctctgggaagtccagctgcatgtgatggcgcatgtcttctaaccccagtattcaagaggctgaggtgggagaagtgctgagggtttgaggctaggctaggctgcataatgctagtcaactgatcatagagcaagaccaacaggaaccaaaaagagtagtctaagatagactatatctatggtttgtgttctatagctccaacgtagcctacctgcatttgtccacataggaaataacagcttgttcactttttaaaaaatcatcagtgggggctggagagatggctcagcagttaagagcattagctgctcttccagaggtcctgagccaacaaccacatggtggctcacagcaatctgtaatgggatccagtgtactcacatacattaaaaaaatagataaataaagattcatcggtgaccacgtggcttgaaattcagtgtggagggcataagttacactttggggtccaaaggatactagtatggattcctaacttaagcttgctgcccactgtaggtgccaataaaggtgttaacagtaaaccccaagagtcacattctaaagataagcataagtaattaacatgtactggttttttttttcagttcagtaaagagaacaggatagatttaaaagaaatgagatgcatattaatgtgtttcttactcattgccccttgttagctttgtgaaatttgtcagtgctgttaattgagtgcttacagacttctaaacaatggtatcacacattagaagtactctttataaatgattgggtagttagagtagcatggctatagatgatttaacactttaaaattattttggcaacaagaagtactgtttattgtcactgattcccacaggtaaccttagaagcagagatactgactaggaacagtaatttacttcaaaatgtcaccatgtttgcttctgtgtgctttcaaatctagttaaatggaggtagatacttatttttaaacagttgtaatttataaatgactactaaaggctaaagagtttctgagttcttatgtgtaagtcaactgcttgaacacagtgcaaagttgtactggtgtcacactgcagtctccttataaggagatcccctccccatggatgtgtgctctttactggatcataagatgacttaaccagtagctacactcctgaagcaaaatgaatccccacagctgtctactgccaatagctaggggtgggtgggacgtctcaaatgttgctccactccattttgtgcagggaaccccggctgagtcttgagtgcaaaagcagcagccacacgatgtcaggaagacagcctttcacggcacttctgtcctctggctcagacatcctgagggctgtccacagtcttccctgagcttcggggatgtgtcctgggcaggcagtagggacttcactttcagtgcttctaccagttagagtctttgcatcaaccactcactgcccaaaagcatctctgactaaggttgagatgaatactaatataagcctagaaatttaaaaggtggctcgacaacatgtttgtttaataaaacaacagtagtagattcccccaggtcctagaacctctttagcgatgggctttgattaggtttctaatccccggcatgaattccttccttcagagtgggcctcgcctctcctctcccaagtcggtgttgtgttgtagtttctgtgctgtggtagcgtgaatacaggacagaagtgatccagacggggagaaggtttattcactcacagcttattttcatattgtccccttcctccgttaggatctcctcctctcccactcatgggccctttttaagctttctgacctctacaggcacttaaaaacacaatccaaaacttcagaactaagatctaggcctggattacctcacttagaataatagtattgtctagtttcatccatcttcatgtgagttccttacaacagaatgaaattcatttcaagtatatttgttcaatagatggacacctgggctggctcgttctcaggttttataaccacagcactagtgaatatgcaggtggaggtggctctgtagtaagatgggctgggttgagtggctgcattataatctgttcatagggccagtctccttatgaatcagaattcacatatgtctttggattgatcacgtagagccggcagatcaatttattgtggtgcatgttatttgttcacacatcgggcataattagtaatgatgctcgtacactggtgtgagagatgggagctgggcgtgcttgaaatcccagcaatcgggaataggaggtaggaggatcaggagttcaatttgggttatatgaggccggctcaaaacaacatggagttccacaactgctgtgaaagaaggagaggattttggtttttctttacaagttagtgtttgctggacatagaactgttgtgtttcagatgtgcggtttctgcttccagcaagagtctgtacctgctggatgagactggagttctacgagactacattttgtgtgtggaatggcacacagtcatttttagagtaggtgtttttcagtgagtagttttctttgagagccaggagtgcttcacttgttcaggataacacccaccaaccaactggtcccactggcttgcatcaggaggtaggcagcttggcatgctttccctcatcagctctgatctgcggtgtggggctggggatgctctgactggaatgtgcatcagggagggtggtcatcctgcactcatccagtcacacttgggagcctaggttcctgtctaccactatagcttatttctctcttaccatcgcacagaaggcactaggacacctaccttttatttgtttgtttgtttgtttaagatttttttgtcttttttacatgtgtgcgagaccaaaggcatcgggtcctctggggttgaactaacaggcaggattgtgagctccagagatggttggttctttagagcagtgcatgcttgtaactgctgagcactccccgtggtcccagagcacacagcccttaacctgtcccctctaagtgtagttggtgctcttccaaagagacttggtatagctttaatatgtgctgccttcttgcattcccacacaagtgttggggggtcgggtggtgcagcggggtacactgctggtagttcttttccgctccttcacgtgagtaatccaaagaattcatggacttactggtcatttgtgcagttgtttcagcgttgggtagtgagcatttcctaaggtgaagtgccttgagaattgcttgcctatgagcctttactctgagcactctctgagcatttggtgtgtgttgtcttatctgactgatgtctatgcctacttttaacactgcagaaacaggtggttataacgtggggtgggggggtattgcttaattgcattgtattggtttcctgttggtactgtgtaagtctttgctggaaagagcgccatgtgttctataatttgaggctcttccatgtagtagaacaagttactgtgctccagcttattcttctcacagttgaaagtgttcttttccttggaaatgcatagttcatgattctaaacgctaaagttaccattttctttcttttttttttttttactttctcttttatttatttgcattccaaatgttgcccccttccctgttcccccttccccatggtcttcaccccatcacttctcccctttgcttctgagagggtactctcccacccacctactcccacctcaccctgctagcatctccctttcccactgaggccagagaaggcatccaaaaggacatacatagtctatactcattgatgagtggatattagccaaacaattcagaatacccatgatacaactcacagaccaaatgacgcttaacaagaaggaaggtccaagtgtggttacatcaatcccacttacaaaagggaacaaaatagtcttgggaggcagagggaagggggaacaggatcaggtatggcaggggagacaggaaagaagcccaaagggccaggaaaatgaatagaaatatgcagcagtgtggggagggacctctagcgagtcccaggcagcagggatgtgagaggctcccagaacccactggggatgtccttggcagaaatggcaacagtggggagatggatccagaagagaccacctccattagatagatatggcccctatttgagacatgggccacctacccatccatctttaaaatttttgtcccagaattgttcttgtctaaaggaaatgaagggacaaaaatggagcaggaactgaaggaaaggccacccagaaactggcccgacttgggagcttcccatgcacaggtaccaaacccaacaccattacagtgtcctgtacgtgggacaggggcctcgcttggccgtctgtgctctggggctccaccagcaggggactgagacagatgcagatacttagagccaaccattgcaaccccataggaagaacaacagtatcagctaacccagacacctcagagctttgagagactaaaccgctgactaaaccaaagagcatgcatgggctggcctctggcctgtggcccctgctacatatagagaggactgccttgtaaagttatcattttcaacttttcttaatttggaataaaattttacaagaatatatagactatatagatgagtggtagtgatcttgtgtttgctgggctactctgaaatgacttctccaaatgttgactgagctctgcctggaaaattaggaggtggggttgactttacattgcttggttgagttagcatttgtagttgcttttaggattgtattgtgaaatattcttgtgaccccagcactagagagatgaacagtagggtggaagagttccaggctaccctggggttacatggtgagagcctgtctcaaaacaccaacaaaggcgcaaacgtaacccactggtaaagcacttacctggtgtgccaaatctctggtggactccccagtacagcttcttcctcagagaagattatagagttgggggccttgcttgaagagtttaggaaccagtgtctaatcccctggagctagagttcaaggcagttgtgagctctggatatgggtagccaacctgggccttgaaagagcagcaagtctgccaagccatttgctctcccacctccaccactccccctcggccccctggctgattttcttttttgtttttgttttcttcagagcagaggacttgcttgctaggcaagtactctaccactgagcttaaatccccaaccccaaccccccccccccccagtctgctggctgatttctaaaaagcttttttattatgagacaaaatagtgtgttcctctggtgctcatcacaggctgtgttcttacaatgattgtagaaagtaaactcacacatacacatctcagcactggggagtgcacatgaggatttagaggtccaggccctgggcctcatctgatctggtgtgtgttgtgatccaaacatgggctaggatgattttagaagtagtggattgtcagatttgtttgtaatttgagcagttaggaagattccagaccagcctggactacataatgagtgagaccttgactcccaaatagaaaggtcaacattaacaataaggattataattaggatcccgagataaccctcctaccctaccctcgcccgtttgtattgatgtctaatcatgtctgtatgctctttaggaacatgttaggaatactgtgtgtccctttgtgcatagccctgtacatcttaatcgtctttcctgtgcaaccttcttttggagtcctgtcatttttactgtcttgtctctctctctctctctctgtctctgtctctgtctctctcccacccccacccccaaccatccctctacggttagatatttgaattgtttccagcacttcactaagcatttattagcaaatgtctcccagctctgtggcttgctgcttccagtggcttagaacaatcagattgacagccatcattaccatgtgggtgcgcttgagaactcttgttctcagacatggcagtgccagactagactgtggcctcagaggagttcctctgccctggtaaaaagcaaataggctgtttcttattccaagtctcagaaagaaaagcatgctgttctgttaaattgcctacaaacaccaggaaaatctgattggcaactgctaaaatgtcacaattaacatgtatgttcattttgaactcacttagaaaatgagtctcatgttaacatataactacttcctgtgcaaagatcagtctagactcgcttctccttcctggttttttgttcattgttctgatactgaggattgaacccgaggcgttgcgcatacaaaacaggtgctctttcggtgagctaacattttttgaaattgcatattttttaagaagctgtcactttgggttaaaataataagatataggcacttggggagagctaatggtcttcagattgtgtggtgtgtatttttaagaaagattttatcgggggcaggaatttgcaagggtggggaagggggctgcatttgggatgtaatgtgagtagaaaaataaattataagaaggaagatagatagatagatagatagatagatagatagatagatagatagatagatagatagatagatagatagaggatggatcgatcccggggcacagcctatggagaatcctttgcccggccagtgggagtgaaagatcttgagtggccagaacaaccaaagtgttacaactctctgaggggaagctggagctaggcaggctcaggctgccgggccacctctgcagccactgctgccctggagttagtggcaagcggggaaacacagctagcagccatgagccaaacaggactgaacaggaagtggctgtgggcaagcacatgcactgagctatttgagctgggtcaaggttcagcgacaaaagcttgaggagagaaaactctgcctaggagtgttacagctcgctaagacaggcactctcaggcggttcatgcaagagtgttacagctcgctaagacaggcactctcaggcggttcatgcaagagtgttacagctcgctaagacaggcactctcaggcggttcgtgcaagagtgttacagctcgctaagacaggcactctcaggcggttcatgcaagagtgttacagctcgctaagacaggcactctcaggcggttcatgcaagagtgttacagctcgctaagacaggcgctctcaggcggttcatgcaagagtgttacagctcgctaagacaggcgctctcaggcggttcgtgcaagagtgttacagctcgctaagacaggcactctcaggcggttcatgcaagagtgttacagctcgctaagacaggcactctcaggcggttcgtgccctctattccctatggagaggacatctggggttgggtgggatctaggggcagatgttttctattggcttggtatgaaatgttagggatgcctcatctgcatgtggaaggacttcaggtattgtccctaagtgactgattttcacagtcctttcactggggtgttgaggtcatgtgttccaggacaggcacctggctgggagtaggtttaaatgcctaccgtcctcaattatgagaattgctggaggttcctgaatctgctctaccttaccattttttctgtctggtccactgtcccacagatggatggatgggtggataccagatagattaattgattgattgattttatgactgtgttttttaatgccctgttcctggtggtcacagctactctgctgagggagatgctgttgtctgcatttgtgaactgaaaatctttagtttaatgggatcttttctgtgtggtggcagattgtgctttgacacatggtgctgttgcctttctgtgttctttgttctcccagtcgtgcctgttcagaaacttaacagatgcatatttgagcagtttgtggcattatgtctgaatccttcctttgagagtaatgtgtgggaaactaagtggtagagctttctccactaccatagaccagcgtaaagaagccctagacttagggtgcaggtttgtgtggattcagagtcctggattgcagatagctctaggcaggtggatacagtttacataggcatgaagtgaaatatccaggagaatattgtagatgaagagacctgcatgtttgagtgaggtatgaacagggcatgtgggaatgtgtacctaagaacctcacaggctgaaggactttgaaagcaacccagtagggtttcttaagtgatacgctagtccaaggggacccttgaggttattgggtatggctaacgtggcagtgagtctgtggggtacgggagtctgtggggtctgaggagtaggagcttaggattcttgaggaaggagaaaatactgccaagtttggagggtagggcccggatctgttttaccatctcatttaggagctctttgtgcataccaggcaatgtgcaggagactgggagagactggaaatagaatacaaaatttggttgattcattataaccttagaaacagaacaaaacaaagtccagggctgttacacaatgctagagtgtaatatacatgaggctctgagttcgaagccagcctggattacagactgagttccaggacagccgtggctatacagagaaccctgtatagagaaaaagaagaagaagaagaaaaagaaagataccacaaccaaaggcaagctaaatgaacagttttaaatatccgaaatattgtggtttcaaaaggtggcactagtcacattttctagtgaatagccacatgtagctggtggctgtggtgtagggatcatgtgaggaagagctattgcctagtgagtgagtcaagacagaaagtggatttgtatgcagacagccatttttacagcagcacgtgtgagagggtttggtgtttgttgctgttctcatgatctaggaagacgccatggaaacaatcagaggatggttctgatagttgagacgtgaggtagctcaagatggtgacctgaagtgcaggttgggtgttaggtaggcgaagaaagagggactgtttcatttttccttgtctgtgccttcctccaaactagtagatgttgtgtaacccatttcctgttgaaattggcccggctgctccaaatccatgctatgtaagtcttgagttatgtaagtaagcatcagggcctttagttagtgttttcttgtgtgtgtgtgtgtgtgtgtgtgtgtgtctgcgcacaattgaaagttttagaaaatacccgttttctttttaaagacatacatttatgtctgcagtaacatgatggtttttaatcttcaagaactctgacagtgtcaaagaatcttaaaatagttattttggatttgtttatttattttgatttttttgagacagggtttctctgtgtagctctggctgacctggagcttactctagaccaggctggccttggaactcacagagatccacctgcctctgcctcccaagtgctgggatggatttatttctttttatgtatataggggtgtgtgtgtgtgtgtgtgtgtgtgtgtgtgtgtgtatgtatgcatgcatgtgtatgattatgtgtatgcatgcgtgtgagtgagtgtgtgtgtacgtgtgtgtacgcgcgaacgtgtatgcttgttgctcacagaagccaaaagagggcattgcatcattgaagctagaattctgggtggttgtaagctgctacaagcatgaagggatttgaacccaagtcctcttgaaagagcagctcttccctgctgagtcaactctccagcccctggcacttctctttgatgctgcatgtctagtgtggcatagtccctcaggaacttgttctgtagaaagtcaccattggtgggctgcgcataagaatgcatggacttgtaggtgacagctctaagagaaaggcctagggttttcactggtttttgcctgggagaactgtcatttctgctgacatttcttctagccagaatgcttgctgtttgactcttagctgctgtgggatgctgtgaagtagacagtgagaagggtcttctgtattggcagggtgtagagctaaggttactttaaaaaagaaaaagcatcatgtatgtattgttatgtgtactgtattatatgtccacacatttatctgtgtaccacatacactctgcagccagaagtggggtgaaagtggtcagaccccctggaaccagcgctatgaactgccctgtaggtttttggaattaaatgcaggtcctttggattagcgggcagcataaacttcaaaaaaagttattaggtggctgtcaacatggcttagcaagaaaaggagattggagccaaacttgatgacccaagttcaatccctggaacccacgtggtgcagggagagagccagctcccacagttatcctcctttccccacacgtgtccatgcatgcactctcccatgggcgtgtacacacaaatgaatgtttaaaatacacagaaagtgttttaaaagcactttctgtgtattggggagggggataggatagtggaacaaagaagctctagaagaagcaggcaagtttaaaggccttgtattaaataataaagcgtgaaaacttctatataacgtttaaagctgtaggccttttgctgaggcagtctccagcagcccatctaacttagcctgacttccagcctgccccagccaggtgactagcggtttacctctctgctctgctctgctctgctctgtcagtgtcctttccctgctgccttcagctccttcagcctgtctcccctgcggcactctctctgcccagaaggtccacccttgtacttcctgccccagtggtgagacaactccagatcgcctctttggttgcctaagccattgagggttgttacaaataggaagctggtgatgagctgtagcaatgacaataccaaaattctgccatcaccagaattaacaatttaaaatacataccttaatacaatatggaaaaggtcactccaacagtcttgacttccactgtgttctacatgctgggctcttctgggttcattgttttctttcttttaatcttcatgttttctaagaaggtagaagggtttttgggatatgcctaccatgtaggatggttgataacagctgaccaaaatgagttttaaagccttggcccagtcttggctctgtagacattcagtatatgattcacattcttgattgcattgtaagagtgttggaaacctgacatttgcgttctctgtgctcttgctgttgtagaaaatgaccatggataagagtgagctggtacagaaagccaaactggctgagcaggctgagcgctatgatgacatggctgcagctatgaaggccgtaacagagcagggacacgaactctccaatgaagagaggaatctactctctgttgcctacaagaacgtggtaggtgcccgccgctcttcctggcgtgtcatctccagcatcgaacagaaaaccgagaggaatgagaagaagcagcagatgggcaaagagtaccgtgagaagatcgaggcggagctgcaggacatctgcaacgatgtgctggtgagggcggcgctcctgctttacacagcatctctaggcatagcgagcggtccagatgcaggctctcagacagcttaggggagagagagaggaggtgctctgctggactcaagctaagagccacctgtcacttgttctaaagcatgtaacttgggttttgtcaccgtttcttgatcagttcatcttctctggggtgttttccttccctcaaaaagacctacagcaaacaggaacattgcataaactttcctccatttttctttagaaattgaagtcaaataaagaggctatttagaaagatgcggcctccagcggacagttctggtttcagtagtgattcatctctggaaaggaagggatttaaaggccttcagccttttcttggccatgccctcacaaagtgtagaaatctgatgttgaagcttaggcatgcctgtcaagtgcagtgtagctttgaaagccaagtcagaggtggtatgggcttctcctgtgggttaggtacactgcagtcaggtggtggatccttctagctacattgggggttggttgggagggatacctaccctaaaacacctcatgattatattttttccctcatatctggagcccactagcccactaggaaattttattttctacgtgaaagcaggtgaaaggtaactgaggctgctttaaagagaaagggacgtctttcctgcagtctgtctgtctctctaaagtacttcccttgacgcttcttttgaaaaccagtataaagcttgtcggctctaaggccatgctcttccctcaacccacaggagttctatccctgtctgtctacacagtacttacaaacaactcctgcctctcgaatactctgataacgattaaatgaagtccctgatagctggactttgccttgagcctctctctttatcagcttcttggtgtaagataagtttcatggttaaacatgttgcctcttggttgtttgggggtttgttaatggtgcactaattcctgaatgttaggtgcatctggtattcagatgaagtatggcatgcattcaaaggcaagagagttccataatccctgaaatgtagaccagcttttcagagcatctgaaggaatgtgaagaagagcatggtactcactgcctcttaaccagcttttcaggatgccacattctaaaacaactcttcgaaaataattctctgtatacgaagcttggactccttcagaactacttttgttgtaagcataaatgtttaaaggaatttgttactaatagttctagactgagtgctactgcttatcaagcaatgtgttaagcactagatataagttaccttgctgtccttacaactgccttagacggtggtcatcctggtccccttccccattgtacagccaaggaatctgaggcttggggtcccaaggccatctctccagggtcacgtggacacagatagtaagcatcagaagaaggctttcctcccaggtcagatgaagtttaagcttagttcttggctggttggttccgctgctgctgctgctttttctttgcagaatggaaaggccccacacactcacagttacagaagcagcacaagtgtcaggggggttgttttgtttttaagagatagacagaagagttgcaaagtaaaagtcactgccaggcattgttagtattagtcctccaaggctttgcccatgttttgtgtgcatggccccacacttcaagattaaaatgaggtcttcttgtagtcttttccatttggatttggttagcagtgtagttctgggccatcttttttccatcccattccactgtagtggctacagtgtaaggagccctgtggtggtctgaggggcctggaactacaggcccctgctcatagaacttggccagatgggatttagcagcttgaatgaaaattggttgggtttttttggggtgggggagtgggttgatttggttagttgggtttgggggagagtgttttttggtgttttttggttttagtcttcagaaaaatcagtggtagtaatacatatcttaagctcaaatgtaattttaacgtctcacaagcaattcaaaattcttaatgtcactttttaggagctgttggacaaatatctcattctcaatgccacccaggcagaaagcaaagtgttctacttaaaaatgaaaggagactactttaggtatctttctgaagttgcatccggagaaaataaacaaagtaagtaacatttgaagaaacagccagtgcaatagctgatacttcacggtgaaacctgggttttctttactgtagacactaagttcgaagtaatgagacacgatattgtcatgtatggggtcacggggttaataaatctctaatggatagacatgaagggtgttagaagtttggtatgtaatgtgtttggcagactcttatctgggaactgatacttcctttttgtaggtacaactatagaacaataattccccttggctatgattttgttttacccacctttacttactgcatctgtagaccgaaatctaaatggaaaattccagagataaaggagtctaaattttgcccaaagtaaccctgtgtgtgctagtcacctagtcatcacctagttgccatattggctacttgattgactacttgagtatggcactctttgtgttcaagtgacttgatggtttctaaagtgcagattgcattacagtacactgttaaaactgttctgttggtttcctgtgttaatttatctgagcatgtgtgcgaggcttcagtactgtctagtttcagcatccgcaaatgagggagacctgtttgagaccaccataagggagaatctatctttcagcaattgtagctgttttattcagtgttcactgtgtgctaagtaattgggcttaaattatcctcttagcacttggaatttaggtgaggttttccaataaaaggaagcagacctggcagttaggcctttcacttgctccaggccacatgcaagtgggttgagaatttgaatttgtttatgccaatcttaaagcccatcactttttttcactagattatccacatttgttcttatgaagggatgtgtctgtgtttcttggctgctttaacagactttgttataaccgtccgttttcttccaaagcattcagaacagtacttagcataaacactcagcagaggtttaggctgagtgttgaagacatgaacctttgttttgattgcttgttcgctttagcctctttactaaagtgtcttgataatggatcccgtgtgtgatgtggcctgtgggagacgctaacagtttcatcttccttccagccacggtgtccaactcccagcaggcttaccaagaagcatttgaaatcagcaagaaagaaatgcagcctacacacccgattcgcctcggcctggcgctgaatttctcagtcttttactatgagattctaaactctcctgaaaaggcctgcagcctggccaaaacggtgagtaaggaaagaccctttgctgttccaagaacgtccttgtgcgtatgagcagtcctcgctgtcttagacatgtaagcgtgctctagggggcggggtttaggagatgggtgcagacctgccacttggtcctcgctcgggctgtgctggctgacggctgctgtgctttgtttgggtcctattggagtcattggtagaagctcccaggtagaaagtcggagttctcatcaggcttggacattgggcgttgtcatctttgttctaagataggactgactccatgaaagagggagcccacacttcgttagtgagatgcttttttctggtgaacactgttacttgaaacttgactttggaaagagtgcctgaagtggattctacaccgtgagccccagaaacagatgaagcttagtgaagagagctttgctcttctcccttggacctgtgtgtccagacctttttagtttacacaaaaaacttgaatgaatttttagactaaatgtgctacagttaacagtgacactgttaattggggggttatcattgctgtttggttggtgtgtgtgtgtgtgtgtgtgtgtgagatatgtcatacatttgaaacaggtggcagatagttgagagcagaacagttccgtcctcttacagtgggacagatagagctaagacagagactgtcgagatctttgctaaaaagccctttgttttaggcatttgatgaggcgattgctgagttggacaccctgaatgaagagtcttacaaagacagcaccctgatcatgcagctgctcagggacaatctcaccgtaagtagacagctccagagagcgggcacctaacgagtccaccgctatccaaggctgcaggcagctctgtactctgttaagtacagtacctgtatcttactgctggactttatgccttgtcagtcaccattgtctgtggtaagagggaattttgaatagttgagtgagggacctggaaacatggctcagtggttctcagcctgttcttccagaggagccacaccctcacattgcagccacagccacctggaacttcaggtctaggagatgtagtgctctcttatggcttcctaggacataggcatgcaaaaggcacacagacagacatgcacaacacccatacatggaaaacattttagtttttttcacaatggtagttaagtgaggtaagctatactggacctcctcttgaagaaaacttggaatgaccttaactttattacagctttttgtttctttttcttttgcagctgtggacgtcagaaaaccagggggatgaaggagatgctggagagggagagaactaatgtctgttgtgctctgtgatctgtttgtgtcactttgtatcctccacattatgtccctttgtgcgataaacaaaaacaaaaaatcgaatgtggactttcgatttttcacagcctaagccttgcaaagatggtccctgggatgaacagctggtatttgtatctaaagctcagactggtcccttaataccatggtattgtgaagtcttgattttgatcaacattgacaaggattactgtgtgtttaatttttacaaactgaacactgtgatcatggggttttataacttagcagaactctttctggtaggaaaaatagacctgaattatgtgtaacttcttggaaagtttaatctgatatcaaaatggtcactgaaatacaattctgttgtaaagctgtacagaaagttctagagattctgtggtgatgctgggacttggtgagatgctgaccaccggcatcctgagtttggtaactcacagtaattctgcctgtggttgagggcttaccaacccttgatcattcagggctgttgccactcaaaagttcatgaccacaaatatctgcagtgtcttctgaggaaactcaaaacctgaaagtgaacttctttggccgataattgggctgtgtcaccacaataaaaaaaggtcccgtgctcataccacctgtgtgactaaaccctttactatagcagtgtgttcctgattagcagcgtgtgaaaacagggctgttaccccctagctaaaggagagggggaaggaagagagaaagcagtgtatcttacaaatggccagaccagttttctggatgattctttaagaataatgtgttgaggcggcctctcgcctgaggagcactcatagtcttggggttcttctagcttggagggtggaagctttgaaatttaacgttctttccgccctgtccttctgactgttgacttttttccctctttaaatttacagctttctgcttccttgggtggttttctttggaagcctgtattagtcaggactgtatggacagggcggggtgttgagcacagggtgagcaagctttgctttaaggtgttgagaaagaagaccttccagtgccaccaccctgccttcctccagttctcagcacagttgttcttcatagtgtgactcatccaaaacaaacaaacaaacaaacaaacaaaagtattttgaagtctccatgatttccccctattgcactcagccctgacaatcttgttagtgcctgtcaccagaccctccagtgtactcatctagcttcgtgctcagacacgtctcaacaagaccttagaacacagggaagttgcatggacactacagtcgagacaaccaagaacagccaggccttcagtctcacagtctcacccctctaccttgacattccatgtagccgtagacatagtccatctgtttgtccatctgctgaaatatgaaaagaattcatgcactgatttaaaccaaaaaaaaaaaaaaaaaaaaaaaaacccacaaaaaaaatctcttctttctagctgaacaaaaaaaaatgtgcagttaatacttggcgcttgacaacgcagtagtgagtgtggaaccaagcctgtctgtatatctggtagctctttgctctggttttttgtttgtttgttttgttttttcccttaccagtattctgcctaatgtttgcttctgtggtggttctatttgcctagcaagcacacccgtgattgtgaaaatagtgtagcaaaaaagaaaagaaaccccagttactgatgtgctagatccgtgtatgtctaaacattctagtttcaccttacacagagtaatcaggaaaatgtaaaaacttaaagtgaaataaaacattttatcagttagttgcctgtggattgatgtgtcaccgccacccctctcgttctcaggaccattcccatcccgtttaatttcggcttcttctttaaagagtaaatagtttttacttcaccccttagaaccagcagtagagatgtcttaggtggctgtctctgataagttggatgtgatcactgccggcttgaaccagagcagccatgatcgcctgtgcaagaccctccctcgcctttcttttcgagggggtggggcgtgttccgtaaggtcacatgagcacttgggctggacaggcacagactgcactgctggtggtgtgaccattaaaggtgcaggggacctgacagtgatgcagctgccttagagcccactatgctccgtcctgtcagtagcccagtaaaactcaactagtttgccagactggacgtgggtggaatcctttcttcagtctcagtatcatccctatctggaatgaacagatgtgtcttcatgtctccctaggaaaaggcctgtgatactccattcaccaaaccaaagatgagtctggaagaagtaggtaatggccccacctataggtgataagacatataactgagccaagtgtcagggaaacccccaagtggctgtttgcctctgtaatagggtcttccaggtaagtgttataccccctcaaacaagcagctgctggacaagaaagtatgttacagtctcggaaggtatttgtgggtcaggattgtaagcaggcagtagtgtcagttgcagtggaccatgctgtaggtaaaaagacatgcggctgaggccacgccgccagtccagaattccccttcctaaagaaggaattccagtgggaagaatggatgttacccgctgtctgtgtgttaagtgggggaaagggagggatgaggtggaggactgttttatacaactgatgcacctcggatctaaacatgtggaacccgcaggaagagttgcgagtgcagaggaagggaaggtccatggctcaacacgcagaggtggccttagtaacagccctgacaggcaagtgctaatcaggttattgtgcctctgaacaacttgaatggagaaagcctaaggcttcatgggcaaacccaaaatatgtacctgctgctaagccagaccacccgagtttgattcccaggcctcacatggcaggaggaaagaagagaagacctctgaccacacatgcaccatgatgtgcatagaacacacaccctccacaaaaggatgaaagatgaacagcttgtctgtgaggctgtggagcatgggggaagttggggtggagctatgtcatgaaaatggagattacccttcctttcctgagaaaaaggctgatgtcggcgacaacagggaattggtcccttgtggactgtcagctcatgtggactattaaggacacttggttatttcttggaattgccacaaatatttggaactggaaggcgttgaaaagggagtcgttagggctggagagatggctcagtggataagggaccacttcagaggacccttattgaattcccttatcatgacttcctgtaattcaagtttaaggggagctgttgccctcttctggcctctacagagcaggcatgcacatgatacacaaacatacaggcaaaacacataaaggaagaaaaaaaaattgctttagaggctggagagatagctcaggggtcaagagtactgcctgatcttccggaggatgcgggttcaattcccagcacccacatggcagctcacagctgtaactccaattccagagaatttgatacctcacactaatgcgtttaagatgaaaatggaaattcttggaaaagggtataactgagaacttgttgcaaaggaattgattggtgcacaatgcaccacctggatcagacagttgatggagttagaagctagtttagcagtgacccccccaggactggtatgagcctttagtgggtttgctggtacaagaagtggatctgccgggcagtggtggcgcacacctttagtcccagcacttgggaggcagaggcaggcaaatttctgagtttgaggccagcatggtctacagagtgagttccaggacagccagggctacacagagaaaccctgtcttggaaaacaaacaagaaaccaagaagtgggatctgacctgtaaggcaggagaggctggcaggtctgagtgatgaatagtgtgcacttacagagtgagtgttaagacacctgagaggttctaggggaaggacaagcccaaggatagcttttcgtggttgcttaatgggcaaatggagtatttgtattgagctgggcggactggaaactaaatttggtgcctttgagcttctaaaacagcagttctcaacctgtgggtctgcgggttgaatgaccctttcacaggggttgcatgtcagatgtttatgttatgattcattacagtaacaaatgaatagcaaggacatcattttatggttgagggtcagcactccacgaggagccgcttaaagggcttcagtgttaggaaggttgagagccactgctctggagggaaggctttcaaaccatgcgttagctcattcaaggggtacacggtccagcgagagggttggcgtggcaggggaagaggattcagtgatttcaccccatttggaagaagattggaccacctcagccctcccgcagaagtggctaagatgaggaacataacagagaattgcagatttatttgccccctattaatgtggtgggttctggagctaaatgtaccttggcaaccctcaaaggtgtcaagacagcatcgatggacagatgaagagaatggtagaggtattaagtctgtcacgtgagggactaatgatctgccctgggcttctgtacacttctccccagatactgaggcacactccacacaccacttgggaaagttctcattgtctgtgaacttaaggcaggcctgcctggttgggtgagaggagagctggagctgaatagttgtttaaccccctgccaagagcaagagatgccaaacaatgggctgcccaggaatgtgggacaaaactacagaaaccatgaagaatttttgaaaggattgattgttcacctggccccaaaccctttcaagagcccagtgtgaccagtaaaacccgatggaggccaggcatggttgcacatcctttaatcccagcccttgggaggcagagcaaagtagatatctgtatatttgagaacatccttgtctacatagtgagctctgggactacatagactctggagagatacagagacagacagacaggatggagaaggagggaggcaggccgaggcagcagcagatatatgcagccatcgaggtgactcaattggtgggggctcttgctgccaggcctaaggatctgagtttgctctacaagggctgcatgctggaaggagagaaccaacttccatatgtcctttgacacatacatacatacatacatacatacatacatacctgttgtgcacacacacgtacatggttctgcatagacacacagaatgaataaattatcaatcaataaatgtatatgttacaacaaaagagccaaacagttcagttcatggagaatggctgaattatggagaactaaatagaataaggctaccctgtccgtgctctacctaacattgctcttttgccagtgcaagtggtgagatctcccctcccccagtgcttgcacaactactcccctaactgctggatgcccggaccaactcttactcagcaggaacaactctgaagtgcttcctccaggtctccactatagccccattgtcatggaattgttagctgataagcaaggcaggaaccttcaggtatggaaaatcccccattactgtaacttcaagatgtttatggtccattaaaactttatagtgcagactgactatgccctgaggcattcctgtccattgctttaatctttttttttaaagatgtatttattattataagtaagtacactgtagctgtcttcggacacaccagaaaagggtgtcagatctcattacagatggttgtgagccaccatgtggttgctgggaattgaactcaggacctctggaagagcagtcagtgctcttaacctctgagccatctctccagcccccccattgctttaatcttaaacattcatttcagcatcttaaactgagtgttctaatgagaatactttacctgagtgtacttaggagagaacctaagtccacctagccttatatgtatagtcttgtataaagcccccatacctacttcatccaaggagggcattgctttagaaacaaatcactctctgctacaggcagccaatttattattgtggtgttgttgttgttgttgttgttggcatttctcatcaggatgctgacacatcctgtttacataatgatagtccaggaccttggcatactgtctgccctctgtaagacagttccattagatagatagtatcacctctgggttttagacttaaaaacacaccctgaagatgtgtaaaccaactgtaaaggaaagaccaggaagttattacacatggtatgagagagccagttgagaaattcctgagaattttatggttgggtaagacatgtatgatttctgacaaggctatggatcaaattctgcagtatggctgttacactcatgaactcccagtaactgtggttgcctgcacaattagttaatggctgaggagaggagagtcagtgttctttagggctgtggcctctggaaagttgaccatgcactggtagatggctccaaacccatgcatatatgggtaccattattgaactcagtggactattaaaaaaagacctgaagttaggggggagaacagagagaggatttggaggaagctggagaagggagtgagggtgggcgtaattaagacactacatcaggctgggcagtgatggcacactcctttaatcccagcacttgggtggcagaggcaggtgcatttctgagttcgaggccagcctggtctacaaagtgagttccaggacagccagggctacacagagaaaccctgtgtcaaaaaacaaaaaaaaaaaagaaaagaaaagaaaaaagaagaagaagaaaaaaaaaaaagacactagatcagtataggaaatcctcaatgagtaaaaaaaaaaaaaaaaaaaaagaagaagaagaagaagaagaagctggaaagatcgctcagtggttgggtacatacagctcttgctggggtcctgagtttggctcccagaaccttcatttggtagttcacaacctgctggaagccctgctccatggaggccaacacctctgcccaccaggggtgtatgcactcatatgcaaatatccacacatgtatacataattttaaacataatctcaaagtggagcagtggcggcacaagcttttaatcccagcactcttgagggagaggcaggaggatctctgtgaggtcgaggccagcctggtcttcagagagacttccaggacaaaaggggctagataaagaaacgctgtcttgaaaaaaacaaaacaaaacaaaacaaaacaaaatcttaaaaaattaaaacaataaaaaatagttttaaaaaattctataatatcctgtgcttaagaatgtagggcagatgtaggtgttaggaatctccagggtaacggggcacttttattttatttgtattcattaagatttttttctttcttaaaaagatttattttaagccgggggtggtggcgcacgcctctaatcccagcactcgggaggcagaggcaggcggatttctgagtttgaggccagcctagtctacaaagtgagttccaggacagccagggctatacagagaaaccctgtcttgaaaaaccaaaaaataaaaaatattttatttttaatatttatttattttatgtatgtgagtatactgtcgctatcttcaggcacaccagaagagggcatcaaatcccattacagatggttgtgagccaccatgtgggtgctgggaattgaactcaggacctctggaagagcagtcagtgctcttaacccctgagccatctctccagcccttcgttaagatttcagtttattaaagcacttgggaggcagaggcaggtggatttctgagttcaaagccagcctggtctacaaagtgtcttccaggacagccagggctacacagagaaaccctgtctcgaaaaactcaggaaaaaaaaaagatttctgtttatttcaagtgtatgaattttttgcccgcatgcatgaattacatcacaagcacacagtgcccatgtctccatctcctcagggcttaaggtcacaggagcccctcatcatcgttcttagcttttacgtgggtgttggggtcctcatgctcgcacggaggcattttacccattgggccatcttcccagtctcaaaactctttaaaaacctcgaaacggggtttgagtaggagttctttagtttgtactgaaacccaaaaagccttcttttttaatcattcccaagagagagtactccccattttctagagagagcaaatgaatgacctgatgtttgaacctgcaccctgcctcttctaaaggactccatcacgatctgctttggctgcgctgccccagacctctctggccttcctcctaggcaaggcgggagatggcagccacctgcgcctttctcagcctgaggactcccaggtgggtggggctgggcaccaggattggcttgcaagcgtggtaaaggcaaggggctagcgcaggcaaacaagacaactggcagagccctgctacagccaccaccacgcttgccaggccccggccccggccccctgtgagctggggccgtttgctggcccgcttctgggtgccctgcgcatcatggacacaggtggccatggctgctcactctcctcgctctatgtgggcgatctgcaccccgacgtgactgaatctatgctctatgagatgttctccccgatcggcaatatcctttccatccgcgtgtgtcgggatgtggctacccggcgctctctgggctatgcctacatcaatttccagcagcctgctgacggtgagctctagagaagagaaaacgcttgcttttaacactcttgagccaaatactttccttttgataactgccatcctgaactggaaagctttctttcaaatgaacttctattagctcagcaatagtgatttttctatcttttaggtggaaatgggcctgtagctaattgtgggtattttacattacagatcatagtcagggaagattgggtagcctgtgtttccgtcttctgtatcatagttagggaaaatgaggcctggagacagggagttggaaggtaggcattcagtcgctgaggggagaattggcagtaactgctggccatgctggttgttggtgagtggctttggtattaagcagagctgggttaggaatccaggatctgtgtgacagcaggcaagtggctcaaccactctgagctcagttggctgtgtggaaggaaactggggttctgcctcccttgcagagtggttacataggagattgatagcacctgggaggaagctgcccaaagccttgcaggtggagagtggggaagaggccgtgggttcctgccctccagtgtagcctgacgtgagggctaccccaggtgcctcacctctctgattctggaagagccgcctcctgtaggcattgccagccactggcagggtgaaagcattgattagtaattgtcagccgagcacgtctggtcttccgctgaaaacagaggacaaaggttaagaaccatggttttgctgaggctgtgccaccgggcaggaccacccttggtgagaggccaaggctcgtttctctgggtcatgaagaatggggatcccgagtgtgaagtaccattagggacactggatgtattctcaagtgcagtgtaagaaaaccactccagagatgtaaccaagaattgtccttccccacctactgggaaaaccctggcaagaacatgaatttgaggccagcctgggctacatattgagatcctatctcaagatgaagtagttcaggcctcctgtgtgagttaggagtttccctgaagccaggatgttcttgccctccgctacactccacgtctgcctatgcctgtctgcaaagctcctgactgaaacagagtctggccatcagggcccggtccatag

SEQ ID NO: 1580 - DNA, 955 bp, Mus musculus
cgccactgcccctacggtcgctgccaccgccgctgccgccagccccgcctgaggagtgagcccgggaaggacgcagtcgctgccctctgatcttcccggaagcgcctttgctccctccagtcctccgcgaaaatgaccatggataagagtgagctggtacagaaagccaaactggctgagcaggctgagcgctatgatgacatggctgcagctatgaaggccgtaacagagcagggacacgaactctccaatgaagagaggaatctactctctgttgcctacaagaacgtggtaggtgcccgccgctcttcctggcgtgtcatctccagcatcgaacagaaaaccgagaggaatgagaagaagcagcagatgggcaaagagtaccgtgagaagatcgaggcggagctgcaggacatctgcaacgatgtgctggagctgttggacaaatatctcattctcaatgccacccaggcagaaagcaaagtgttctacttaaaaatgaaaggagactactttaggtatctttctgaagttgcatccggagaaaataaacaaaccacggtgtccaactcccagcaggcttaccaagaagcatttgaaatcagcaagaaagaaatgcagcctacacacccgattcgcctcggcctggcgctgaatttctcagtcttttactatgagattctaaactctcctgaaaaggcctgcagcctggccaaaacggcatttgatgaggcgattgctgagttggacaccctgaatgaagagtcttacaaagacagcaccctgatcatgcagctgctcagggacaatctcaccctgtggacgtcagaaaaccagggggatgaaggagatgctggagagggagagaactaatgtctgttgtgctctgtgatctgtttgtgtcactttgtatcctccacattatgtccctttgtgcgataaacaaaaacaaaaa

SEQ ID NO: 1581 - protein, 260 aa, Mus musculus
SSRKRLCSLQSSAKMTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLILNATQAESKVFYLKMKGDYFRYLSEVASGENKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 1582 - DNA, 43009 bp, Homo sapiens
catacagaactgcaaggagaaatagggaaatccattattattattattattattattattattattattattatctttgagacagagtctggctctgtcgcccaggctggagtgcagtggcgcgaactcggctcactgcaagctccacctccccaggttcatgccattctcctgtctcagcctccagagtagctgggactacaggtgcccgccaccatgcctggctaatttttgtatttttagtagagatggggtttcaccgtgttagccaggatggtctcgatctcctgaccttgtgatctccccgcctcggcctcccagagtgccgggattacaggcacgagccaccgcacccagccaggcaaatccattattatagttgaagacttcaacatacctctagcactaattgacaaatccagtaggcagaaaaaagtagtgagaatatagatgtgcagtaccatgaatcaactggatctaattgacatttatagactagtttatccccaaacagcagaatacacattcttctcaagctcctatgaaacattaaccaagatagactacattttggaccataaaacatatcttaacaaatgtaaaagactagcaatcatacaaagtataacaccagagaattaaactagaaataagagaaagctggaaaatcctaaaattttggaaatgaaatgctagtaaataacacattggccacagaagtctcaagataagttaaaaaatattttgaattaaatgaaaatcaaaatttgggggatgtaaggaaagcagttcttagaggcaaatgtattgcaatgaatgtgtgcattaaaaaagaagaaagacctaatatcattaatctaaacttccaccttaggaacccaagaaaggagagcagtataaacctaaaacaagcagaagaaaagaaaaagaaataaaaattcaaacagaaatcagtgaaactaaaaactagaaaataataggaaaaattgagaagaccacaagctggttctttgaaagatcagtgaagttgataaatctttggccaggctaatgaagaaataaggaaagaagatataaattaattaatataaataaaagaaaggccaaggccgggtgcagtagctcatgcctgtaatcccaggactttgggaggccgaggcaggtggatcatgaggtcaggagatcaagaccatcctggccaacatggtgaaaccccatctctaaaaatacacaaattagccaggtgtggtggcgcatgcctgtagtcccagctacttgggaggctgaggcaggagaattgcttgaacctgggaggcgaaggttgcagtgagccaagattgtgccactgcactccagcctggcgacagagcgagactccatctaaaaaaaaaaaagccatcactactgatctcatgaacattaaaaggataaaaaggaaatagaaataattctgtggccacaaatttaacaccatggataaaatggatcaattccttgaaagatacaaattaccaaaattcacaagaggagaaaaatataatctgaataggcctagacctattaaagaaagtgaatcaatatgcaataaactttcacaatagaaaacgccagacaaagatggtttcactgggcgaattatacaaaatttttaagaaataaatgataccaattatctgaagataaaagcagagtgaatgttttctatcccacttcaggaaaccagcattaccctgataccaaatctacacaaagacattgcaagaaaggaaaattagagaccagtttctgtcatgaacgcagatacaaaaatcctcaacaaattattggcaaatcaaatccaagaatgtataaaataaactgtgcaccatgatgaagtgggatttgttccaggtataaaaaggctagtttaatatttcaaaatcaatgagtataatctattacaacaacagaccaaaggaaaaaaatcatgtgatcacatcgacaaatgcagaacaagcatctgacaaaatctaacacccattcattataaaaactctccgcaaactaggaatagaaagataactttttaaacttcataaaaaatatctacaaaaacactgcaatgaacagcattctcaatggtaagaaattagatgctttctcctaagatgtagaacaaggcaagcctgtcccttttcaccactccaattcaatattgtacaaaagtcctagctaatataataagataagaaaataaaataaaaggtatacagattcagaaggaagaaacaaaaccatctttgttcacagacatgattatctatatgaaaaatccccaaaacttggcaaaaactcctggaactagtaagaaataatagcaaggttgtaggataaaaggttattacacaaagtgaattgctttcctacataccagcaattaacttgcgggatttgaaatttaaaacacaatgccatttacattagcacaaaaataagtataaatctaacaaaatatgtacaagtctatgtgagcaaaactatcaaactctggtggaagaaactaaagaaaacctaaataaatggatagatattccatgttcatggataaaagactcaatactgttaatatatcagttcttccctatttaatctatagattcaacacgatcccaataaaaatcccaatgagtaattttgtggatgtcgacacatttattctaaaatgtatacagaaatgcaaaagaaccagaacaaccaacaaaatgctgaggaagaacaaagttggaggactgacactacctcacttcaagacttacaacaaaactatagtaatcaaggcagtgtggtcttggcaaaagaacagacaaataaatcaatggaacagaatagagaatttagaaatagacccacacaaatagtgaactgatctttaaaaagaagcaaaagcaatgcaatggagaaaggatagccttttcaacaaatggtggtggaacaacaggacgtccgcacacacaaaaatgaatgtagatactgataactttcacaaaatttaactcaaaaaggcaaaactacaaaacttctaaatgataacatagaagaaaatttaggggaccttgggtttggcaatgaatgtttagatatgagaaagaaaagactctttttatctgaagaatgtgagctcctttatcaggcccagagaggcattgaaatgtgacagcactcatgtctcctcccacctggaggtaagtaatcatttcaaagatgcctgttaaatgaattatagactgactattgccaccaagagctatgaattaacctaaaacaccccatgctgaacaccataatgcatgctctatagtacagctctatagttcaacaatgtatatagccaatcactaatcaatgttatctctgtaaaccaatgacaattcattaaaaacaacttttgtaatcaccctctctccctttttttttttttttttttggagacagaatcttactctgtcgcccgggctggagtgcaatggcgtgatctcggctcacggcaacctccacctcctgggttcaagtgattctcctgcctcagcctcccaaggagctgggattataggtgcataccaccacacccatctaatttttgtatttttagtagagatagggtttcaccatgttgcccaggctggtctcgaactcctgacctcaggtgatctgccctccttggcctcccaaagtgctgggattacaggttgagccactgtgcctggctgcatcacgctctctcctaatttgttcttttttctttaaaaacttgagcctctcttttgttctgtggggcacttcctattgcttccctggctgcagtcctcaactttggtccaaataaactctatattaattttgcctgagtttctttctttagctcaacaggtataacataaaaaacatgatccatgaaagaaaaattggtaagttagacttcatcaaaattagtgcaaagtcactgtcgagaggataaaagacaagctacagacaagaagaaaaaatctttgcaaagcacatatcacctaaaggacgagtatgcaaaatatacaaagaattcttaaaattcagtgataaaaaagcaaataatccaattaaaatgagtgaaaaaatctgaacatacacctaaccaaggaaaatatacaggtggcaaataagcacatgaaaagatgctcaacattgtatgtcatgagggaattgcaaactagaacaatgagataccattacacacctattcaactggttaaattcagaaaaacaaaaacacaaacaacaagaaaaaactctcactatatcagatgctggcatgaatatggagcaaccggagctgttactgttggtggaaatacaaaatagtacagctcctttggaaaacaatttggtagtttctttatctttctttttttttatttatttatttatttatttatttatttatttatttatttatttatgagatagagtctcactctgtttgttgtccaggctggagtgcagtggcacgatcttggctcactgtaacctttgcctcccaggttcaagcaattctcctgcctcagactgccaaatagctgggattacaggcacccgccaccaagcgtggctaatttttgtattttttttgttttttgtttgtttgtttgtttttttagtagagacagggtttcatttactatgttggccaggcttgtcttgaactcctgatctcaggtgatccaccgatctcggcctcctgaagtgctgggattacaggcatgaaccactgtgcctggcctttttttttttttttctctgagatggagtctcactctgtcgccaggctggagtgcagtggcacattcttggctcacttcaacctctgcctcccgggttcgagtgattctcttgcctcagcctcccaagtagctgggactacaggcatgcgccaccacaccccgcaaatttttgtatttttagtagagatggggtttcaccatgttggccaggatgttctcgatcttttgacctcgtgatccacctgcctcggcctcccaaagtgctgggattacaggcgtgagccaccgtgcccggcagcctatttttatttttaatgtttttttagggatggggtcttgctgtgttgcccaggctggagtacagtggctattcacaggcaccatcccactactgatcagcacgggagttttgacctgctctgtttccaaccttggccagtttaccccttcttaggcaatctggtggttccctgctcccgggaggtcatcatattgatgctgaacttagcgcagacgcccaggcaacatagtgcactgcagcccagaactcctggcctcaagcgatcctcctgcctcagcctcctgagtagctgggactacaggcacgcgccaccacacctggccagtttactagtttctaacaaagctaaacattgtcttaacgtataatctaacagtcacactcttaggtatttactcaaacaagttgaaaacttatgcccaaacaaaaacctgcacacagatgtttatcatggttttcttcataattgtcaacagctggatcaagatagctctcagtaggtctattagttccctaagcctgccataacaaagggccacaaactgggtggcttaaaaccacaaaaacatattctctcaccattctggaggctagaagtctaaaatcagtgtgacagcagagtcttgctccctttgagactctgggtagaatccttccatgcctcttcctggcttctggtgctgcccagcaatccttagtgttccctggctcacagctcatcactccagtctcggcctccattgtcatgtgttgtttcccatgtgtgtcctgtcttcagatggcattttcctccttctttagggcaccagccacgttggattaggacccactcgaatgacctcattttaattgattatactgcaaaagcccttttccaaataaggtcacatacacagattccaagggtgaaagcttcagcatatctttctggaggatacaagtcaatccttaagaataggttaatgggccaggtgtggtggctcacacccgtaatcccagcactttgggaggccgagacaggcagatcacctaaggtcaggagtttgagaccagcctggccaacatggcaaaaccctgtctctattaaaaataaaaaattagctaggcatggtggcacacaccaataatctcagctacttgagaggctgaggcaagactcacttgaacctgggaggcggaggttgcagtgagctgagatcatgccactgcactccagcctgagcaacagagtgagactctctctggaaaaaaaaaaagaataagttcatgcataaacacaatatggtagattcatacaaggggattttttaagcaatcaaaagaaataagttatcaaatcataaaaagacatgaaggaaacttaaatcacattacttaataaaacaatccagtcagaaaaggcgacatatgtgctgggtacaatggctcacactttattacccagcactttaggaggccaaggcaagaggattgcttgagcctgggtgttcaagaccagcctgggcaacatggcaaaaccccatctctataaaaaatacaaaaattagctgggtgtggtggcacacgcctgtagtcccagctactagggaggctgaggtgggagaatcacttgaacccaggaggtcgaggctgcagtgagctgtgattgcactactgcactccagcctgggtgacagagtgacaccctgtcaaaaaaaaaaaaaaagaaggaaggaaagaaggaaggaaagaaagaaagaaagaaagaaagaaagcgagcaacatattgtatgatgtaactatatgacattctagaaaaggtaaaactatagtgtaaaaggtctgcggttgccaaaggttggggtgaggggagggagtgagggatgaagagttgaagcaaagatttttaggacagtaaaacttttatttatatacatgacattatgcatgtgtcaaaacctatagaactatgtacaacataaagaatgaaccccaatgtaaactacggactttagttaataatgatgtattaatactggctcatcaattgcaacaaatgtaccactctaatacaagatgttaataataggggaaattgtgtggaggagggagagggaatgtgggaactctgtaatatctggtcaatttttctgtaaacctaaaactgttctaaaaaattaagtctattggccaggcacagtggctcacacctgtaatcccagcactttgggaggccatggcaggagaatcacttgaggccaggagtttgagcccagcctgggcaacataatgagactctgtctctacaaaaacatttttaaaaattaagtctataatttgaaaaaagattcactgcagtatataaggctctagtatcacttctttaaggaaatctttcctgctctcccatcatattcccaagatgggttaggtgctcttctcccaagctcccataataccctgcacatatatttatttctatggttgcacctaccacattgtattttaacatttatctgtatcgctgtcagttcatagctgtggtttgctgacgcttggcctagaatgcagagatggtgaaataagctaatccattgaaccctttaacaggcacctaggaatgcctgacaaagggcacttctgttccctcaatgcactgttgatgtcatttgtggtataatcattattagccctctggtccattaggctattttctggatgacggcataaggcacagtcttgtgacattaaaagttacttagcctgagtagtctctagattactggtctagggtctgccaaagacgatcctcatggggaagtttttgcactaacctctccaggattcaaatccaatggttttgacccaaaaccatgctgtttacgttacacaacacgttctcaatcttgttcaacttaaaaggtggcacagtacaggggtcactggcacacatgcctacatgacagataacataagtgacaaaagcagactcaggtcgagaagggtccctggcatttgggaaagtccatgcccagtctagaacaggcagccactccttggcttcagccaattgttgccacacagaaatgtggacacagtgttaccagacaaggcagagaggcagatttctgttcacacagaaacttttcagtttaaaaaagtgttggcaactaagtcaaactgcttagaaatactggagatggcatattgggagggtaaggaatcatccaattgaattggggtatttacgatgggggagaaatagcagctaaaggataagggcagcttttggagaaccctgattgtcacactcaaggaacttatatattgtcatctaggtctgagtgcacactaaataatttaagcaagaacaggacacgattagaatggtatttttaaaagatcacttggcagttgacgggcgaggctgagaccaaatggtgaattagaagtctgtcatttagctaagtaagggtaaaggcaagacggcaaaggcctatttacttggctttttctcctacccgactgcaaactccaagacagcagggccccacctgccttgttcattgctgtgtctccagcactaagcaaaaagcctgttcaacatttgttgaaagaataaatgaacaggagagagggaaggcgagaggcattttgaaggactgagtttaaaaatcaactaccttgaagccggtcgaggtggttcatgtctgtaatcccagcactttgggaggctgaggcgggtggatcacctgaggtcaggagtttgagaccagcccggccaatatggcgaagccccgtgtctactaaaaatacaaaaactagccgagagtggtggcatgcacctgttatcccagctactcaggaggctgaggcaggagaattgcttgaacctgggaggcagagattgcagtgagccaagattgtgacactgcctgggcgacagaaagagactctgtctcaaaaacagaaaacaaaacaaaacaaaacaaaacaaaatcaactaccttcagaggagtagaatgttggtaattgtgagagcagtcatggaggggaggggagccatggaggcctgtttccttccctgaacttcctcaacgagggggcatcttaaagaagaaatcatgtacacagatttttgtgggttttttttggagacagggtctcactctgtctcccaggttggagtgcagtggcatgaccatagctcactgcagcctacaactcccggcctcaagcaatcctctcacctcagcttcccaaagtgctgagattacaggcgcgaaccactgcgctcgaccctacacaggttttttaaaaagacgtttgtgcattggattcctggcacttcacgtggcctcttcagtctaccaaagaaggaaaaggtaagtaccctgaaggattgaaaggattaaatgaacattgagggatgagcaatttctgttcttccctggctccagcattaccaaagcacacagtaagaggactgacatcggcctccgacccagtgaggattactttcggggtggagggggaactgctaaacctcgaatctccgggactggccctggcgcgtttccagtcccagcagaaagggcaatccccatccagaccacactcctagtcctccttattcccacacagcccgtatcttgaccacccccagctccgccctctctcctcccacctccttttcccgctcccccgccccatttccttcttctccgcccacctcctcctgggtccctcccccggccatccgccctgccccggcccctgcaaccctgcctttcgctcttcttcctcctcccttccgtctgcgcccctcccgtggggccgtggcaaccccgtgcctcgcttgcccaatgagaacacggtttggggcggggcgcggccaggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggtgagtgcggcgcggggtccgaccggggcccccgggggcccaaactcgaagcccctctctggctgctgcgacgacggcggcccagtgggtgggccccgtggggtagcggcgcgctgcctctttcgctccgcgcggccgccggcggcgaggccagacctcgcagcggcccctccctgtttccggggccgggccctttacctcttggagaggctcgggccgcctgaggtcctgccggccgggcggggtgcaactccgtactgtgccgtaagggacagcggagccggggatcccggaccctccctcactatctgcttcgggccccacgcgacccctccctgcgtcttggtcggcaagaacgtccccttcagccctgtcacctctgctccgtgctttctggtttccagaaattaaaatttaatcaaacgcggatgagttttctagccccagtccccgtgtttggctcctcctggatgagtaaggggtttaaccttgggagacagcagtgggggaaccccctcccattttgcagtaaaaccatttcatcatccttcactggttatggagcctggcaggacccaagattccctaggaagggaattgggtttgaatcaagaaaatctgtttgttggagccggttactgagtcaggccggatccccaggaaaaaatatcagggggtgagaatcggagtattttctcacagtatttaccgtcatttaatgccagattcttttgtgtctttaccccaaattcccccatattgtgtgttagcacgtttttcggtctgaaatttgcccggtggcttcctggtcggggggtggggagcggagggaagaagaggtgggaaggtgagtgcatctttgccgcaaatggagaactcccatataatggggttttcagaggtggcagccttggtaagcaatttgccaacctttctgtaaaatacatgtttcttgtcgttgccttcattgcatttctctttggtaaggctagatagcatcaggtcctgattttgcttgccctgtgtgggagatggaatttggcaagatgatgctatgaacataaaatcagcctcgggaaccaaaagagaaaggtgaagcacttataagaatatgaaaattgtctgcatttctcattctgtcagttcatgtgaagccagacacagatgcagtttgtagacctggacactgcagcttttgcattttcatttggaaatgtgtataagtatttgttcttggtgaatttcttcttgactgcttccagtgtaccctatttcttacttagggatatctcatttgtttgagccctcatttttcttggatccctgtccttggcaacacacggtgtgtgagtgtaaaacctgtcaatcttattggacctaagttagaaatttaagtgtggctttcaaaatggaaggctaataatcctgtagcaactgcagaattattttcctggcctgtccttccaatgagataagaaaccattcacctatcttgcagatgaagtctttatgagaaatgaggtgatttggcctagactatacacctagtttttttcaaactgaatatcctcattcatcagtagcaaatatttatggattgccagcccctggagtatgacgcctaccctgtaatcttttgtacatttcacatcttgcagtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcaggtaaatttggttgaaatcttgcctgcaatattttctagctttctgaatcttcagcatgttaatctctggttcttggttttcttatttccagggttatcattaagccttttttataaactgtaaattgttaaatataagcttttggtttgttttttaatcagagttcactattaatggctttttctctccagttaacatctgatgacactaaaccctgctttgtacacatgttgctttcaaaaaatggtatattattataggactttattttgcatataggcaaatccagtctttctgaatcattttctcgtctatatagcacaaatggtaatgcagcttttgatatatttttgttgcgacaagctcaataatgaaaataagcatctgggatatagttggggttcaatagatgttattgaccatctgcatgaatatacacgtgtatagattagacatagcatatatgctattcatggacatttatatagaatccatccatttgtgatttattcaccaactgatgaggtggtatcagacaattagtctataataatagttaccacttacagtacttactgtgtgctaagctttcttttaagcactttaagcatattagctcagtcttcataacaaccaatgaaaggtaagactgttagccccattttacagatggggaaactaaggcactgagaaggataattttcccgaggtctcacacacagcgcaaggtaagtgccagaaccaggaatgaaaccaggtgatctggttctgaggaatgatattatagatttctgcatgtggtagagacagcacatgtatatgttttatgtgaacaccatttagtccttaatttttctttacaccaatcctaataaagtaaacgtttgaatgggaatattagctatttttgaagatagatacaggacaatttattgtggagcatatacccattctggcctgtagggatgataattgctagcatgcatcaggaagcaagcttgtgaacaatccagtttttctagtacttgcttcatactagggagaaagtcatcagttactttggcatagaattttaggttcttcatctaatagaatttgattgtgaccattaatttttgtttatcttacgacttcatcagtagatgttcagatttttctcattttgttggcagggaggaaatgaggaaatatatctacgtaaatagagagaaacttctaaattaaaacatcctgttgtgctacctgctctttcggtgtcaacaaactgagttttcctttaaatgctggtaccttagagaatgaactaaaatttccttgtagagatacttttaagttccttgtttctacatttttctagggaaagatgacaattcactagttaaggggcaagaaattatggttacataatagcaacctttaagctttagaatccttttgatctctatgtgaatatgatcttagcagtcatctgtattgcatgatggagaaactaacggttggagctggattctgagggaatttttctaaggggaatacttgaggaaacagactaaaagtgctttctgtctcatgatatgtgtgctgaaggccaatcatcttactgctttctcaactaaaagattttctaatagaggtgtggttatatgtatctgatacttgtaatgagatgtaaatgatcagtggcctcaagtcattcctagcagattgtaggttagttaactttttttttttttttaaattctggccagttctttattatgtaagtttttcccgtactggttagtttattttattgttttccctaaaagaaccaacaggaggttatttctgaatggccttgaccaggacaagaagattgaaggctacaataaagtagatatgagtcctgtctattattattatttgccctcagctaagagctttcctttaaaatttgtttgacattttggtaagtctttggcatgtttttatgctgtttttaactccttgattttgtttttatttttaaagctagataacattagcttaataggccagttttaaaatttcactgtaacaaccttgtatagttcttttaaaagttgacaattctctcttttccttaagtgagcattggagttcataattgatctttaggagatagggttacataaaggaaagagcattaattttaaaattaatgttggtttagatcccagatctgccatatatagctgtgtgaccctgaatgagttaactctttgcatttataaaacgggacaatgtcacctgcctcataggatacttaggatcaaatgcgtttctaggaatccctgagtgctttgcaggccataaatgatggatggatatttttgttatttactaaacgagttagctggtttgggtttctgtatagtgaactttttgtatagcgaactgattggacttctgaatggaggagatggacagaaagtaatccaaaggcttgttgaaagtcagtttgaatctataaatacaatgattggtagctgaaaaatattagtcaaaatgtatagtgttgctcctgatgagagctggctggcttttttcaaaaagtagtctaagacaataaaaacagtctgtattttataggtcagatgtgtgctaccttcctctgtccacgtaggaaataattgctttttcactttttaagaatgcatcagttgatcaagcagtcactcagtgtgctaggccttgtactccacattgggtgtccaaagatacaagtctggattcctacttttttttttttttttttttttttttgtgagatggagtctcactctgtcacccaggctggagtgcagtggcacgatcttggctcactgcaacctctgaagcccgggttcaagcaattctcctgcctcagcctcctgagtagctgggattacaggcgcctgccactgcgcccagctaatttttgtatttttagtagagacagggtttcgccatcttggccaggctggtcttgaactcctgaccttgcgatccacctgcctcggcctcccaaagtgctgggattacaggcgtgagccaccacgcctggctggattcctactttaagctcacaatccggtgtgggagccagcagagacacttgcattgcagtaaactgtgataagggccattttagaaataagcatagggaaattgttatgtgcctttcttttaaaagtctttaaagaaagcagagtacgtgtaaaataaatgaggtacatagtaagtttcccttcactggctgaccattggttttttaagttttgtgtggaatgtactgtggttgccatttatttgagtgcttactgttttatatcataaacaggtttactccttacaggaaccctagtaagtagatttgcctatgtttttttttttcttcacagagtcttgctctgtcgcctaggctggagtgcagtggcgtgatctcagctcactgcagcctctgccttcaggctgcctcagcctcccaattagctgggattacaggcgcctgccactatacccggctaatttttttatatatttagtagagacggggtttcaccatgttggccaggctggtcttgaactcctgacctcaagtgatcaccctcctcggcctcccagagtgctgggattacaggcgtgagccaccacgcccagcccagatttgcctgtattatggatgagaaaacaaattcacagaggtcacatagcctgtggacttggtgtgcggtactggtaaatcagactgataggcttcattatgtcagtgggccccaaactgtagaaattattcataaggtcaaccaattgggctgtctttatggatcagaattaacatagtgtcttttggattgattacttaagccaagaagtcaatttattgtcatatctaccattaagtcacatgtgtaaccttgcgcctgtcacttaacaccctcagtaagtttaatcatggctaattggacataattagcaatgatatgcaacagctgatgtgaaagagggaagggattttgaaataatagaaatgcagtttctctccaaattcagtgttcactggacttagtgctaatgactttgtattacagatatgctgtgttttgtttcctaacaaagaacctgcaaatgtttgaatggaattaaatttattacaggactctaaattttatatgtagaatggcacacagacagttttatagtgggtgttttttagtgagtagttttctctgagagccaggagtgtttaactttttctgggtaacacccactaaccacctggtcccactgactttctcagtcccttctgcagtagcttggcatctgatttttcttcagcagagagactccagaactaaaacttctgctgtacagtgctgtggatgctctatctggaatggtacatctgtgaatgctgttcagaatatgtgatcagttccttaccccattgaaacattcgagcctagatttttcagattttcttgtcagttttcttccttattctcatttctttatctgctttggcctttgatttttatctcatctagaaaaacatacatgcactttattaataacatctctttttaagtcacgacctagctacctttaaacctatttcctctagttctgtctggttggctttctaaggagaggcattgtaacccttaaacgtgtgctgtttttttttttaattgatgtgtaatagatatacatgtgctcttttcttgtgtttctaccactagagtttaagctctctgaggggaggactacactgctttcttttaaattcctctcaatgaataatccaaagagttcttagaaatttggtagtttttcattttgttagttatttcaacacacattggattatatgtgttacatttttgtgaggtagcttaagaataaaaaataagaatggcttatgagcctttactctaaccagcactatatgggcattttatgttcattatcttatttgatagctattaatgtctctttttaacactgagaaaacagattcaggtaagttataatgtggaaatgtagaaaaatcacctactttctctttagaagctcagatgtgtatgtaaggcttgctaaaagcagaccccaccgtatattttatatgtatagagcttgggtaattcctgacatataataatggagtcttcatctgaaatttctaagaaattattaaattcaaagcttattattttcgaatcgagcatgttctttgccttgaaaacaaaacatagctgaaagccagtgcttctaaaggccacagctgtcattttcaaccctttctgtctttgcactgcctttatttaaaaaaaaatggattagcagtaggtagtcttctttttcttttctttctttcttttttgattcttctcctaggatatctgctctagccactgggaaataacttctcagtattttgaccctgactagaaagatgtcccttggggaaggaattgggatagaggggctaggctgtttcctagatcctctattttcagcatttattatctgatttaggattttgtttctttgaagaaaatcctattttgtgagtacctttagaattatttttcatagctgtttatctgcactagtggtttctctttaaacagaaaaacactttttttcttaaaaaaagaaatagtacccaatttttaaaaaagtaatacatacttgaagaaaatttaaaaagataggaaaatgaggatataataatgttattacccagagacagaaccagtgttaaccatttggtgtaacctttctgttcgggtttgtttgttctttaggggatattttacagaaataaaatattgtgcagcctcgtccctccagcccccattgctcttaaataaatcttttcatgacattaaatctcttcttttgatggccacgtaatcttgtaccatctatctccttccctcccctgcctttttttttttttttttttttgagacggagtttcgctcttgtcgcccaggctggagtgtagtggcgcagtttcggctcactgcaacctccacctcctgggttcaagtgattatcctgcctcagcctcccgagtagctgggattacagtcatacaccaccccggctaatttttttgtatttttagtagaaacggggtttcaccacattggccacgctggtctcgaactcctgacttcaggtgatctgcctgccttggcctcccaaagtgctgggattacacacgtaagccagtgcacctggccagtctccttattttttaaaccattcccatattgttggatatttagatttgcttccattttttcactaagcaatctctgcgtttatcaacaaatgcttcccagtcctgacttgctgcatccagtggcttagaacagattgacagccatcatcatcatataggtgtgctggagagctcctgttctcaagcacgtcagtctcttcctgaaatatgcccagcacaaggaaaatctcttggcttactgcagggttgggccttttgtggcctctaatgagtttgcctgcgccagtatcttgatgcttctgcagtggtgccaggcctgacgatgagactatagtctttcaaaaactttttaggagacaaataaagagtatcttgctgactttttttttagtgggaacctcattcaaagtcttggaacaacagtaggtcttgattaaaaaccatcatggcatatcactagaaaattcaattagaaactaatggataaacttcagttacatttaacatatatgtccattttaacataacatactaactatctgtacaagattaatctagacttttgcttttccttctcacaaaattgtatatttaaaaagaaaattcaagcttatggttttatgggctgctacagtgtaatagtcgtggagaagaataatagtacttcagtttgattttgcactatgcatttttcaaggaagatttccacatttagtattctttaattccctgcgcctcatcttcacagcaactctactgaggtagatgccatcttcattttatggattggaaggctgagatttaacatgctcacatggctgtatagtggcacattgcgctgtgacacacagtcctgctgccttccgactatactacatataggtactctgtgttccttgtgctctcccaataatgatttgtagaaaaacttgatattcatttgcatatgagttttgtgcttagcacagttataagcattaaatgtgaaacaaacatgaagctttcctttgagggcacacacgtgaagctgtaagtggtacagtactcatctgtatcacagaatggcataaagaagtcctagaccatgtaataggctataagtatattcagagtcataggcaaggtaaatcagtgagggctagggcagtcagggaagggtttgtagccctagaagaatgggtggagttcagataggcaggcagtaaataggagagcactctagatgaagggaactacaaaagcagtttcagacacgtttgagcattgtgtttatagggcatgtggtgctggccagcctgagagaaaggtacatgttggagaacagtggatgagaaagccaaacaagtaaagaggagacaatttatcaggaatttgaaagccaggtagagcttaaatttgatggagtagccaaaagggagtcattggaagttactgagtaaggacaaaggcaagactagaggtaatttaggaagagtaattttttgtttgttttgagacagggtgtctgtcacccaggctggagtgcagtgatgcagtcatggctcagtgcatccctggcctcctagcctcaagcgattctcccatctcagcctcccaagtagctgggaccacaggcatgagccaccacacctggctaatattttattttttgtagagacaaggtcttactatgttgcccaggctggtcttgaactcctggtctcaagcgatgctccagctttggcctccaaaagcactgggattatagattgatctgccatgcctgactggaagagtgaattactctttgaatttcagagggcacagaaattcaagaaactaggtacaaatgtaatgaagatttaatatgcttgtgaggctaataggtgctttgaattatttgagaaaagggagaactctaccaactctgcagttttatgcttacatttcaggatcagtttgttcattcagcagatatttgttcctaccaattatgtacaggatgctgtgggagatatgtccaaaggagcttatggtgtaggaagggaaataggagacactatgtaagtaattttagtactgaagaaacgtggtaagacattgacaggtatcagcgaaatgctttgtgagaatatattcattagagcaatgccgtcccataggaatagaatataagccacatgtaatttaaatttttctggtagctgcatttaaaaatttttttaaagtgaaattgattctatctgtttttacttaacccattatgaacaaaatatgatttcaatatgtggcactagccacattttaagtgaatagccacatgtagctatggctatggcttaaacagcttaagaaaggcttcatggaagggatggtatctgagccacactgtgaagaatcttgtatgcagagtaaatttgggaaaagccattccaggtagagggagtggcttggtgagcaaagatagaaaagcatactttgtatgtaagaaaaccattttggcagaagcacatatgatgtggaaggcatgatgtgggggtctggaagataggttggcaagctttcactgataggggaggaaatctgactctgcttttggcatcagggaactttaaagaattttgagcgggaagtgacttgagcagagttataggaaaatgggtcttacagcaaaggcatggagggggctgtagataatgagtgactgaaagcattgccactagggcaagattttggatgggagatttattgtagatgtagaaataggaacaatttcatttctcctttgctgccttcctccaaactgctgggtgttgtgtaacccatttcctgttgaaattggtctagttgcttcaaaatccatgttatataagtcaaaagttatgtaagcagtagccatcaggacctttagctatggattttgtttgttgtaagttgtttctgtatgtgtataattaaaaatatttgaaacagataaatggatacagattttaaaaaggtgtgcattcagtccttatcttgccatgatggttctcaatctctaagaaatcttgcagtaatctcggagaagcttaaaatagctgaccccaaacagaaagggtgcattttattttgggaaatagggaaggcatatttgggaggtcccactgaatagtccagattctttggagtagtatgatttaacttttaatccttgagaaggagagaagtaaaagggggatagcttaattttggggcctagtagagctgaagaggttgatggcattatttagcaacggcaatcctttattactccattatgataccacatgggatggcttagctctgaattggcttttggccagtactttatgatttggagtaatccacaggtagagttgcataggtactgttctatgaactttgaagtgggcctctaagtgacttctaactttgagttagtctacagactggaaattttctgaaggttgttgggtcattgaaagttggcttctttctggtgtacctggcacttttagaaaccatgaagtagggttatttaatgatgaagatatttattgtcctgatctcaaagaccttatggtcaagaaagttagatatatgaagacagtggtcatcctttggtatccagggggtgtaggttccaggacacctggggataccaaaatctgaagatacttgtttattttgtgtttttttccttctttattttccaccacggttggttgaatctgtgtatctggaacctgcagatatggagggccaactatatatacttttaagatggtagagtatttttgatgtacttgtattagagtagaacaggttgtcttgtggtaaccaacagctccagcatctcaatgttttaacccagcaaaagtttcttttgttttcaccctgcgtgtccaatgcaggtctgcaggagtcttgcactatacagtcacccggggactcaggctgacaaaaactctacagttgcatgactgtaccacctagaatacatggccttctcagtggctgctgtgagggaaaagagcctggggaggcacacgtaggatattcacagtgttagcctggaagtagcgtcatttctacttatctttcattggacagaactaccatgtggcctcttctgactgctgtgggggttctgggaaatagaagggaacaaatggaatgtttcttgaggattactctctctgccttagttttattctagtgttgtgagtgaagatgtcagatggatcaaagtgagacttgcctcactgagtgtaagcttacaattagtgagccttatataagacacagctctgcatgtgatttagataataagcagtaggaagaaaaattatagttatgaactggagaatcaattctttctgaatcacctagattttgagtgtatcttattgtgctccctaaaacatttttaggtgataaggccctgtgtgtagaatttctctcttgaaaatacagaaatgacttttgaggcaaaatcattttgtgagtggaggtcatactttcttgttttttttttccttttttttttgagatggaatcttgctctgttgcccaggccagagtgcagtggcgcgatctctgctcactgcaacctccgtcttccgggttcaagcgattctcttgctcagcctccccagtagctgggactataggcacgtgcactgtgcccagctaattttttgtttttttagtagagacggggtttcaccgtgttagccaggatggtctcgatctcctgacctcgtgattcacctgcctcggcctcccaaagtgctgggattacaggcatgagccactgcgcccagcagaaaatggttaatttaaaaatagcaaagaggccaagtgcggtggctcacacctgtaattccagcactttgggaggccgaggcaggcagatcacctgaggtcaggcgttcaagaccagcctgagcaatgtagtgaaaccccacctctactaaaaatacaaaatcagccgagtgtggtggtgcatgccagcagtcccagctactcgggtggctgaggagaatcgcttgaacccaggaggcagaggttgcagtgagccgaggttgcgtcactgaactccagcctgggtgacagaatgagactccgtctccaaacaaataatcattttcagagccttaaattgtgataccatgtatgtagtaatgaaagaatttgttttgaaaatactggcattggctaggtgcagtgggtcacgcctgtaagtcccagcactttgggaggccaaggcgggcagatcacctgagtttaggagttcaagaccagcctggccaaaaatggcaaaatcccatctctactaaaaatacaaaagttagctgtgcatggtggcacgtgcctgtaatcccagctacctgggaggctaaggcaggagaatcacttgaaccctggaggtggaggttgcagtgaaccgagatcccaccactgtacttcagcctgggtgacagagtgagactctgtctcaaacaaacagacaaagcacacaaaaaaacctgacattactactactgtttaaagtagcatttcatgtttttatagctcaggatattagtgtatttttatactgtgtggcacagattgatatatcaatatttaaaccaacagtacataaaattaactcttcttgtttagtaaataacttttcaattattttatccaaaaattacttattaaaattaccgcactctgtaaatggtgattattgcagtggggaactgactgtggtgagttgataagagatattcactgattggcatatggatttgataaattgataaactgaagtcactaggatttttgtctatttcagaaaaactttaaatgaactcagttatggttcagatgaattcagttatggtttcaagttatgttgctgtacatcttgttatacacccctttctcttgcaacctataccatatacaaaattagtgcctgatatttttatataatgctttatactttttaaggtgccttcacatgtatcaggtcttttgttcctcataacaggcccactaaaagagttggtagtgttctttctttttttttttagagacaggggtctcagttggttgcccaggctggaatgtaatggcacagtcacggctcactgcatcctggaactctgggctcaagtgatcctcccacctcagcctcctgagtagctgggactacaggtgcacaccaccacacccagccaattttttcttcttttgtagagatgaagtcttactatgttagagactgatttgccaggataatcttgaactcttgggatcctaggcgtgagtcaccacatccagccctgggtagtgttcttattgcccagtagagaccgaagctctcaggttaagtgatttaaccaaggtcatgccacttgtaagtaagtagcagagctagtgctagatagagcccaagtctgactgcccttagtttatgttcttcctgtgcagtgtgtcctagtaacaaagttagcagattacagaagatgtgatataatctttcccatccttcagttatctactgcttgatgggtgcagccaaatagatcatttaaaatcatatcttttgcttcaggattggttgaaacaaacatcatacttactctttcctgtactatggaaaaaacaggtttagtcaaaaccagagttgcttacaggacagtgaagagaggacttcctgtattacaggatacagttggattaaggtcattaaaacaaaccagacaattactgagagaagtcaaggacatatatatagtaagcataaactttttttttgagatggagtctcactctgttgcccacgctggagtccagtggcgtgatctcggcccactgcaacctctgccttttggtttcaagcgatcctcctgcctcagcctccccagtagctgggattacaaatgcctgccaccacgcctggctaatttttgtatttttagtagagatggggtttcactgtgttggtcaggctggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaatagtattaatttaatgtataaatgcagactctcaaaacagcttatgagagagaggtgtctgaatatactggaaagctgccaggtatttacaactaatttttaagcatatgatataatttgtgtcacctattgcctgatcagaggttgtacatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcctgctttggtctgaaagttaggcacatccatcaagttcggcatgcattccagagccaaattcaaagtgttttgggcattctcctctcctgtattttacataaacccttagtcagatgattgattccctctggccgccacttgggattgaatgggaggggtacgtactccaaaacaaatcataatcatattgtctttcccgcacatcctgagccattgggaactttctttttcttccaggtgaaatcaggtaaaaatgaactcagcgagggctgctttgaagggaaaaggaattcacacttggggacctaccaccttccctgctggctgcctttctaaattactgcccatgactcctttcttttgaaaaccagtataaagcttgtcagccatcaggcagcaccccttatccctaacctattaggagttacacactgtctgtctacaaagaatattaaaacgactgccgccccctgcatcttctcactttggttgattaaatccccttataactaagctttgcattgagcttctctttttattagactcatggcgtaagagtgtcatgactaaatttgttgcctgttggtaatttgggggtttgttaatggtgcactaattcctgaatgttaggtacatctggtattcagatgaagtatgtcatgcattccaagggcaagaaagttccataattcatgaaatgtagaccaacttttaagagcatctgaaagaatgtgaagaagagcttggtacttactgcctcttaaccagtttttcaggatgccacattctaaaacaactcttcgaaaatattgctctgtatacgaagcttggactccttcagaactacttttgttgtaagcataaatgtttaaaggaatttattattaatagtattagctactctttgagtgcttactacgtgccaggcaacgtgttaagcgctttatgtatgtcaacttatttatcattataactaccctagaagatggctataccctagaagatgacccttcgtatagctgaggaaagtgaggctcaaagtgattaggtaatttgtccagagtcatacagataataagtggcagaagagggatttctacccaggtcagattgactttaaacttagttcttggcagttttgctctattatcacctttttcctcctaaggaaagatattttttcccctttaattatagaagtaataccagtttgtgggtttaaaaatggtggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagtgatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggcatctggagacaacaaacaaagtaagtaatatctttaaaaagaaattcgaccagtaatggagccagtcttctttcacagggactttttaacgatttttgctttgttcgccatagacaccaatgtcacagtactaagaatttaaaagaccacagcattgtgacgaacggggtcatgggcgggcaaataaaaatttatctgacagggaagtatggagggcattacaaacctggtgcgcagtgtatttaaaaagatcttatcttgagtattatttgttagctctctttttagcagtgaactttttatacttggtggtacgaaactaccctagtgatgcattgcatttatcacatgtattaccgtgatggtggtaatcttaaccacactttattaagtgcttctgtgccaagtacttccgagtctcacttactcttcacacagccttacgagttaggtggcaggctgcccatttttcatataaactgaggtttatggaggtttctacttgccccaagccacagacctagggagtaagagttgggaattaaagtttggatctatcgactctaaagcctgtgatgtttgcactagaatgtatggtttttcacattctatattgttaaaggttatagctgtatttaactgctttagtagactttgtcataattgttttcccccaaagcatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtgatgtgagtttccagacattttgagttttagtttaaataaataaataattttaaatagaagattgctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagggtaataatagcctaggttcccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaattaccattaattaaacagcctctttacacccgttacttgatacctctctaccttccacaacaaaccatgcaggtattaggtcctctttagtgacttctaagatttggtatggacagttattttgcattgtattcgagcccaccatcccttccccattttttaactctgagatacaaccaagccagtgaaataggtaacctatggttgcataagtcttggtcatcaccaagctggcgtctcacctgtcctcacactgtatggtggcctgcagagctggttcctcacaggatttgccccttctgaaaacatccacattaccacaaggagagaaaaaaatcaggatagaggggtcttttttagcccaagattagaattagtgcttccttgctactctgaggctggacagccagatgggcaccttctgtccctagtttaggagctgttccacctgttgaagccacactcaaccaaaagtcagtgggggcctacctgctctgttggatcagtgagaccaggaaagtcctatcagaggaaaagtgaagtattggtgctcagtggagtagttgttttgtttttgtgttgtttttaatgtccctataccacagattgacgctgcaagctcagattcacagtcttgctctgtttaggtcttgctctgctattagttcccaattgtccgcatttaggctgagccacaagtaactcagtgaacctccctggtgtaatggatgtgtaatggcttagcagagggacagggaatatcccaggaaaaggggtcttggtaatatgagccagtaccaagaaaggccttagtggtctccagttctcacgtctcaaagccatttccatccttggtgcgaaacggtgggactggatcaggctctctggaggaagacatcttcaatggagcagggtaaaattctctacacaagctttgaaacagtggcctgttcggaattccgtttgtgtgtgaaacgcaaaaagcgcggtttgggtctcctttcattcttgtcaggagggaatcattcccattttacagagaagggaaacgggttcagaaagatgatcatctgttccggggttagaactcagtcccctgcgtcctttccgtcccagtcctcggctctttcaaaagagctgggggttttgagagctccactcaagtcccagcagccctgctcaaggccaggttgaaggctttttccgcctcccagggcggggtcagaggtgtccccacctgtagcttttagatccccaagtgctcgcaggtggggggtgggcccaggagggatcccgggggaggggcgtccgagcgcgcccacgattggtgcgcagggacgcgggggcggtaaagggaaggggcgggcccgcgcccaggaaggagggcttccgcccgggtgagcgcggggccgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacggtgagccccggggatggggcgggaggggaaggaccgacggacaagcaggcggacagacagaagccggaactgggccgcttgcgctttcatcttacactttgcagccggggaaactgaggctcaaagataacagggcgttggcagaggcctggcccctgagacgggaattggtaattagtgtggtttactgctattcctctacagaggagagagattagggtcgagtgaaaacagatacaggctttgtgggggtgggggtgggggtcaggcggaccagggatagaagcccagcagccgtgtgactctgggcaagttactcgaccattctgagcttcagatgcgtgtctggaaaatgggggtcctagctgccttatagagtgcttgtgaggatgagagattcaaagcacctggtgaggaagatgcccaaggcaacacagctggtgagcaggggaggcaggagaacccagccttgggctcaggcctttcccagcgcgacgtgagatccacactgggcgcctctacctgcacgggctctgaaaaaccgctgcctccaggccgcaaggccgctttctcagagctgatagcattgattagagcttgtccgatgagtttgcctgcacttctgttgagagtggagaggatgagtgagcttgggcaagccttcacgctctgcaccttttcatctgcaaaatggggctaaggcgtattctccaataacataaagaatggagaactgctgtctatgcataaagaatggtaactgcttgttacctcgtaaacgctcttaagtggtaacctaaaataaataaataaataaataaataaataaataaataaataaggccaggcgcagtggctcacgcctgtaatcccagcatcttaggaggccgaggtgggcagatcacttgaggtcaggagttcgagaccagcctggccaacatagcgaaaccctttctctactaaaaatacaaaaaatagctgggcatgatggcggacgcctgtaatcccaactgctggggaggctgaggcacgagaatcgcttgaatccgggaggcagaggttgcagtgagccgagactgcgccattgcactccagcccgggcaacagagcgagactccatctcaacacaaaacaaaacaacaaacaaaaaagaaacaacaacgaaaatagtggctttaacattctgatgtaagactccagaaactcacccaaaaaatggccggcgtccactagagggatcccttgcgccaggtcgcctgggtgaacctggtggttgcctgagtgggtggtttgctagggaaggggttgttccgccgggcctgttccccgccccttactgggctggattcctgggcacttttctgtttgttctgctttgctccacctcctgcctcttcccatcttcctccaagccctgtgaatgaagtgggactcggcctggaaaccgtgctgcagagagaagggttttgccccaggtatttatgataagactaggtggagaatccgggcttcctgaaacttgctccactgtgttccccacagcccccttccatgtctctgcactagcagactccctgaaacaggtcacgtgtatcacccaggagagacacaggctgcagcagtggccggaggctgggcatcggctgctgttttgagacattattttgtgtcaggcacaaagttacaaacaaggcacttttacataccttctttatttttcagtccctccaacaacctggtagttggtagtatctccctttgttaggtgtggaaaagtaggtaatattaccatcattccccctttacaggtgaggaacaggctcagagaggtaatgtccactttccccagagccggactgcttgagatctaacctcagctctgccctgcagcacctctgagttttaatttcctcaaagtgctgccaccccttgtcatatggacattgttatccactcagtgtactttagaatccagaatagacctgacgctgccacagacctttcatgtttcttattctcagttttcccatctgtaaaatgaggggcaggaatccatgctcatgtggctgcagggagttggttgaatgagatcataactggaaggttgggggagcaccatacacactaattctcagcttatccttcctgagcctttgggctcttatctcagttatttgggctcttatcttggcttattgtctgggacccagacaatgactttctctttattggctcccagttaagcacctcgaggggtgggtgatcaaggtaagaaaattccctaaacttgctaatttctctcctcttccttctgtccagcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtagaggatgaagggtgtacgtctttgggtagatcggtgtcaactacctgcctggtagaggggtgacaagcaacacctcactttacagtttacaaggtcctttcagtcaagtttcaggtacagcaagcacctgaatgacagccgttctttcagtttcatcttccgtgaatgaccagacattacctgtgtatcagtcagctctcgctgtgtaaccaccttcaaatttagtggccgtcaacaacaatcatttatttagctaataattccacagttggcaatgggcaaagttcagctgggcagttcttctggtcttggctgggttccctcctatgcccactgaaagctgagtgggagctctcgctgggtatatgagggagcgactggctgtcagctggaacatcttggctttcctccctatggccttttgtcctccagtaggctagtccaggctattctcatggtattctcatggcaatggcaggggctcagaagacaagagtggaagcacaccaggcctcttgagaactaaatgcagaactggaaccatcacttccactacgttttttttttttaattgagatgcagtcttactctgttgcctaggctggagtacagtggcatgatctcagcttactgcaacttcctgggttcaagcctcctgagttcaaacgattctcctgcctcagcctcccgagtagctggaattacaggtgcgagccaccatgcctggataatttttgtatgtttagtggagacagggtgggtttcactgtgttggccaggctggtctcgaactcctgacctcccaaaatgctgggattacagccatgagccaccgcacctggcctctttcactacattctattgaccaaagcaagtcacaagaccagcccacattcagagtgagaggggagtagaaattataggatgaagggtgtggctacaggaaggccattaattggggccatcaaggcaattaagttattgaatcttgtttttaagattgtcttacattagatgtaagttccatcagtgatcttgttcttagtcattattgtatcccaatacttagaataagatgtgaaacatattaggtgctcaataaatatatgttgagccagtggaggtatgtcatttgagaaggattctgattatttctctgactttttatatgaggatgttgaggatcagcggccatatagcaggtcagtatgtctggaacagagggcttaaacctgggtgttctgtctctagattttataaggatagttgatcagttaccccgtagcctttggagtgtctgctattctagggaggatggggacagtttttgtagcctatgtgtcagaacttttttttttttttttttttgagacggagtctcactctgttgcccaggctggagtgcagtggcgcgatctcagctcactgcaacctcctcctcccaggttcacgccattctcctgcctcagcctcctgagtagctgggactacaggtgcccgccaccacgcccagctaattttttttgtatttttagtagagacggggtttcaccgtgttagccaggatggtctcgatctcctgaccttgtgatccgcccgcctcagtctcccaaagtgctgggattacaggcgtgagccactgcacctggcatgtcagaacttttatcaagtgctactgtgtgccaagcataatccttaagttctcaacgagggctctcaaattcccagtcaataagaggctatccctgtggctcagaggagcaggtagacttgaggagatgtagtaatgcactaagggttatctgtgacagagagacggggctgtttcctgtctttgaggatcaaaggaagaaagactcttaactgtgtattaagttcttcacaataataatggcagatttatcatgtactttctgtgtgttaggttttctgcatacatgtatactccttaaaagggtacctggcatactgttaagcttctaagtgataactgtaacaatcaaagaattacttctgttggctgaccttggacaagtcatttattctcattttccctctggggctcagaggttaagaaatgactgaaaggattctcttatgactggcatagataacaagggaagtatgtaatgcccttagcaggttcttgacccacagtggggacccagtcaacgtggttaaatccaagctgaggcttgagttgaaagtggaaggcccctgtttcaggatgagaggtggaggggtatgtgcaaggcatgggtttggaagcaagatctgttgtgcaacacccactggggagcctcaaatgccaagttgatatagttctgtggatagaagctactagagattgaagggatgtggtcagaattacattttagaaagagcatcacagtggtagtgtgcaagctaggctgggaggcagtgcttgtcatccaggcagaaaatgccactagctgagctgagcctgtagccacagggatgagtggagccacagtcaccttgaagtggggggttagtggtctttctgcgagttcaacaagagggatgggggctatgtgaactagaaggtctttccttgttctcaagttctgtcctgctggcctgagtcaggagggttacagaatgggaataggatattgtgcatctttaaaaaaattgaggcggggtgcagtggctcatgctcctaatcccagcactttgggaggcccaggtgggtggatcacctgaggtcaggagtccaggaccagcctagccaacatggtgaaactccatctctactaaaaatacaaaaaactagccaggcatggtggcatgcacctgtaatctcagctactcgggagtctgaggcaggagaatcgcttgaacctgggaggcgggggttgcagggagccaagattgtgccattgcactccagcctgggcaacaagagtgaaactctatctcaaaaaaaaaaaaaaaaaaaattgaaatgagtctgttgttgcagtaattcatgtattggcaaagtttaaacaatgtggaagggaagaaagtgaaaaacaagactccatttctttcagccctagtccccaaaagtaatatgaatacattttatgtgtctttttcaaaatttccaatgtgtagatgcctactttagcctgaatggattttttttttcacttaacaagactgtcaggccatgtaacctaccacattctcttcaactgtgcacatacagtagactggtgtacaattgaggctcccccttgatgaataccccggttgtttctagtttgctgatagaaacaaggatgcagatatgggggtttgaatctaacccttttgcccattgccttaggaagacaattaaaagccagtatgcagtatagatgaaacctgtgttcatttcgttctccctcttaaatctgttttttcttttctgtttttatttttttgacacagagtctcactctgtcacccaggatggagttcagtggtgcaatatcagctcaccgcaacctccgcctcctcggttcaagcaattcccctgcctcagcctcctgagtagctgggattacaggcacccaccaccacatctggctaattttttgtatttttaatagagacagggttgcaccatgttgtccaggctggtctcgaactcctgacctcaagtgatatgcccacctcggcctcccaaagtgctgggattacaggcatgagccactgcacccagccttccttaatccgttaacttgagtggtgacactctttgagcttccataccccatccctaacatgcaggattgccttttccaggcacagcaggcatgcagagactggtcgtgatcacctttgccattcctttctacctgaaccctctgtcagtactcttcctgtccttcctccctgtggcccaggtggcgtgtgacgagcatggctcccggggtttcggctttgtccattttgagacccatgaggccgcacagcaggccatcaacaccatgaatgggatgctgctgaatgaccgcaaagtgtgagtggctgggcccgagggaggggcggaggctgcagggacagaagcatggcaccaccgactaggaatcgatgctaccctcaagctgctaatgggcaccaggcacttgagcggcaggcagccctcctagaagtgtgagcccggagcagctgctcaacctctcagggactctttcctcacataaagatggagctgatgatctgcattagagtatggtaaaggaagtggtgattttaaaactctagagggactggctaatggtcatatcatcaatggactcagtgttttcatctgttttccagccttctcagtatggggtgtatgtgtgtgtgacagggtcttgctatgtagcccaggctggagtgcagtggcatgaacacagctcactgcagccttgacctccttggctcaagtaatcctcctgtctcagcctcctttgtagctgggaccacaggtgaccacatgccaccatacctggctaattttttgatttttttttttttttttgtagagatggggtctcactttgttgcccaggctggtcttgaactcttgggttcaagtgatcctcctgcctcagcctcctaaagtgttaaaatgctgggattacaggcatgagctactgcgcctgactttttctttaaaccttttgtgtttcatgagattttggcagaaagaaaagtaggcatatgctaagcctgccctcatcatactgttaacttcgatatcatccccactacacagatgggaaaactgagaggcagataatagagagaatctgcctctggctgttccctgcccagaattttgattttgttcatctgagaggccagctcacatggtcagggccatggagagaaggtggctttgagctgggggatgcactgagagtcattttgtccagggttactcagaggagggtccagtcaacctgtcaaacaaatcttggtgggcttttcccagttctcagaagaatgctcttcgttagctccaatttactcaagttcacctttgccactcagttttcttcaaattttggtgcctggtacaactttgtttgtgctaaacgtgctatagataccatcagaatttattattatttttttaatctgggatgctttcctagatgtgtttacatgaacttggaaatgaacttttaaaattaatcttgtgactgggtgtggtggctcacacctgtaaccccagcactttgtgaggcagaggtgggtgaatcatctgaggtcaggagtttgagactagcctggccaacatggtgaaactccatctctaccaaaaatacaagaattagccatgcgtggtggcacatacctgtaatcccagctacttggaaggctgagtgaagcaggagaatcgcttgaacccaggaggtggagcttgcagtgagctgagatggcaccactgtactccagcctgggcgatagagcgaaactcagtgtcaaaaacataataaataaaaataaaattaatcttgtatttaagtgattttagtcaatgccccccatagcaacactagcattgactgcgtctaattcacttacccctgcttccccagtgcacccaatacatgttaataagcaaagccccatgatgagaatttgagtcccaattttacagcaatgaactctgaggctcagagaggttaagtagcttgcccagggtcacacagctaggcaactgcagagcgaggattcaagcccttgtctgtctgactctcaggctcattcttctgtgctctcagctgcctggtatataatagtaattatgtgtgcatttgtcgcaagaatgaaatcttcttaaccttctgctggggacaagctctggaacata

SEQ ID NO: 1583 - DNA, 3296 bp, Homo sapiens
aagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaattaccattaattaaacagcctctttacacccgtt

SEQ ID NO: 1584 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 1585 - DNA, 40463 bp, Mus musculus
  misc_feature (1)...(40463): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggccctaatagccttttcatctgattcagaactactaagaactggctccctgagctcacctagtgatgagtataggctccttctcctagagacctccgctgattgatcttttttcttttctttttccttctccttccttctaatctctccccaggtattcttacctgacctaaacttttccttgggttcaagacccttggaaaggcctgtatacttattttgtgtaccatattttctctttattcttactctctctccccactttacttctgatagattgtcctgaatttcctctagaatttttagccctatcttaatcacttgataacatgtgaaaaggaacaaaagggctcctaacactagaaaaaattcaaggccaaacataccttgtaaagccatttcccactttacttctgatagactgtcttgactttccttagaaagttcaagaccagacttaccttgtaaagctattttccactttacttctgatagactgtcttgaatttccttagaaagtttaaggccagacttaccttgtaaagctattttacactttacttctgatagactgtcttgaatctcgttagaaagttcaaggccagacttaccttgtaaagctatacttacgggttaccgccgttccccagctgaggagttctgaatccagactggatccttctcaacagtctgttccacgggaacctttataaccgtgacccgcagttctggttccggaatgagggatcttccttgcaccggtgatggttaactctcgtcccgagttttcttcccggatttttttcttcccgggtttcggcaccaattcttaaaaaacgcgttctcacgcccggccaggaagaacacaacaaccagaatcttctgcggcaaaactttattgcttacatcttcaggagccggagcgcaagccccaagccccaagaacgaaagcccctcatcatccccaaaacgaaagcgaaacccctgtccttatttcggagagttatctttttttgcctcagacgcatcactccctgattggctgcagcccatggccgagttgacatcacgggaaaggcagagtacatggggcggagacctannnnnnnnnnnnnnnnnnnnccttgccaagggtggctaaggaagggtttacaaagatggacatcagcagtgggcatcacagttatctcatgcttggtggaacccacagctgggggaagaactggctttcctcctctcagttgtttctcatcgcactgtacagagggaaagggtccgcctcatcccagtcccagagccataagcaggtttacagaagccagagcaaaggggttgactacctcacagaagcaatgtcctgtttcctcttcttgtctcacatagggaaggcctgtaggcccctaggattctcctgcattttaggtcagaatggctccttaagctatttaaggagttcttggtacaccttaagttccttagttattatagaagagtcacatataaattgtcacacaagcaagaccactcaggggaaatggaaagtgtcattaatgactgagagagtggtttcttcctgggcaaacagtaacacagtgccatcaggttagggctggccgtcacattcccaccaggagtgctaatctttgaacctggtctaagactgaaaggtgacacatttattgggagtggtaactaagcagttgttacaaatgacctaagaactctctccaataacaccaatttagagacagttaaaagcaccaacttagctgagcatggtggtgaacgcctttaatcccagcacttgggaggcagaggcaggcggatttctgagtcagcctggtctacagagtgagttccaggacagccagggctacacagagaaacccggtctcgaaacaaacaaacaaacaaatcactaacttggggctatgtggttaagaggacctatcacactcccagaaaaccctggttcaattcccagcaactgcatgatacctaacggctgtctgtagctccagtttcaggggatttttatgtcctctggcctctgtgggcaccaggcacatacatggtgcacagacacgcatgtagacgaaacattcatacacataaaataaaattcccctacacatttgtcgcagatgtgcagcttggtcatcatgtgggtccccaaacaactggagcacgggctgtctctgactctgctgcctgccattggatctccttcccctagctggattgcctgggtggggcttcccacccgaggcgggagaggatacacttagcacctgctgtgatttggtgttccagggctggttggtatacaaagggggctttcccttctctgaagagaagggaagagaagataatggcgagaggaagaggagggtgagactgggaagagaggtgggagagggctattaccaggatgtaaagtgaataaataaattaatgaaaaagaaatgaaatgaaataaannnnnnnnnnnnnnnnnnnngcagagtacatggggcggagacctaccctggcacatgcgcagattatttgtttaccacttagaacacaggatgtcagcgccatcttgtgacagcgaatgtggggcggctcccaacagttgactcccacacgctggttgtttctgcagaataaacactctctgtctttgcatgctgtctgagtctggagtcttccttcagcggtttttggacccttacaggttgacctctgcggtccgtgtatacatgcctacacatacacacacatgtaaacaaatttcaaggctatttagaaaaacaaagctttgagggtagaagggatgaaagaccagggggagggtgctgggtatggcagtggctctcaacccaatgcctccagcccttactacagttcctcacgctgtgatgatccccagccataacatgattgtcgttactacttcataactttggggttgctgctgttatgaatcctaatgtaaatatctgataggcaaatggtcttaggcgacccctgcagaagggtccttcaacccacagaggggtcatgacttacaggttgagaaccactggtttagggcaaaagtcaaggtatggatgccagcccacagagagacatgtagcagtgaagatcagagaaggactgaatgagaacagcccccagaggctcctgtgtttcaaagcttgatccccaggaggaattaggagatgtgaccacgatagagggggtgtgtccctgggggttttatgtttgaaaagcccacaggattcctagttgcacattcccctccttccctgcacacgattgtagatcagaatgtaaactctctgctgcttttccagggtcatgactgcctgcctgcttccgtgcctgcccccataatgaccatgaactctagccgctacctgactattttttcctataagttgccttggtcttggtgtcgtatcatcccaaacagaaaagtaaccataaagagggttaataaatagatgaattgataaaataagataaaggggttcaagtgacctcaaatcggtcttcacagagatgacaggaactttgacattttattgacaagaggaacaatggaactggttggttaaaataccaagttcccttatttgctaccttcatgttgttgggctagacagtattttcaattattataatcctaggtatattctgctatgttatatactagtcaaacactgagaaaaaataaatatggattaaacccaggtcataatgtctagactttgatgttatctgtggtccaggagtttctgccttaacggctttaccagccatttctgtttcttaaagatgctttccagcctgctacatcagatcctagcaactcacctttcaaacagtgaggaaaaatcaatatttgactcttgtgtacatgaaatgtgatgcttcgtcctctgggggatcctagaaagaatgacaccttacactgagcctttgggaaggctgattaactaattagaacttcagtgattactacagagagattggaatgttgcaggtccagagtctatttatggttttccttgggctatctttatcttcctcaatagtcattcattccttcatcacctatgtgtctgacccaacaccctgtgattaacttaacaggcctttggtttcttagcttccaccagccagaaggccaatgttgtcaacagatagcctcagacctaaagaagagattttccttcctcctctttgctgtaagctgctgtccatagttgggatctggttgctgtgataaacaccaggaccacaagcaatctgannnnnnnnnnnnnnnnnnnntatttatggttttccttgggctatctttatcttcctcaatagtcattcattccttcatcacctatgtgtctgacccaacaccctgtgattaacttaacaggcctttggtttcttagcttccaccagccagaaggccaatgttgtcaacagatagcctcagacctaaagaagagattttccttcctcctctttgctgtaagctgctgtccatagttggatctgttgctgtgataaacaccaggaccacaagcaatctgaggagggaacggtttatttcagcttacaggttaaaatccaggaaagaaactcaaggcaggaacctgaaggcagcaactaaagaaaggttagagatcacggagaaaggctacttccaagtttgctctctggcttgtgttcagccaactttcttatacagtccagacccacttgcctaggaacagtcccactacagtgggctggagcctggtgagcctggtgcatcaattcgcaataaagattaattagccaatctgatcataagattccaccagtgtatttgagactgccttagtttatgactttattaatttatatgatgggtgttttacctacatgtatgtctgttcaccatgtgtatgtgcctggtgcccacagaggtcagaacagggtgtcagagaccctgggaactgaagttacagaacttcatgggctgccatctaagtattgggtcctttgtgtttctgtttttttttttgtttttttttttttttttcctttttccgttttgtatagctctgactgtcctggaacacttactctgtagaccaggctggcctcgaacctgcctctgcctcccaagtgctaggattaaaagcatgtaccaccactgtctggcctattgggtcctttgtgagagcagccagtgcttttttttttttaagatttatttattatatgtaagcacactgtagctgtcttcagacacctcagaagaaggcatcagatctcattatggatggttgtgagccaccatgtggttgctgggatttgaactcaggaccttcagaagagcagtcagtgctcttaaccactgagccatatctccagcccacagccagcgctcttaactgccaagcccagactcctggaccacgttttctgtttgtttggttttggattttcttttgttttgtttaggtctcatgtagctaaagctggccacaaactccctgtatagcagaaggtatccttgaatgattttccccctgagacagtgtctctctctctgtgtagccctggctattctaaagttccctatgtagaccaggctgccttaaaatctcttctcctgcctctccagtgctgtgattaaaggtataaaccaccaagcccaggctgaccttgaacttcttatcttcctcccttgtgcagagctctgggtgccgccttctaggaatttgactaggacatgatgggttaggacaaggaagtaggctcaacaggaatacagctgaggaatgtgttctttgtagaccctgaatacagtagtcatggggcctttgtctatgcttagtgtgttttttatctaccttgtttatgcctttggactgaccaccacattctttttttttgtttttgagacaggatttctctgtgtagtcctggctgtcctagaactcactctgtacaccaggctggcctcgaactcagaaatccgcctgcctctgcctcccaagtgctgggactataggcgtgcgccaccactgcccagctgaccacattctttgtacctagaatggtataaaagcagacctgaggaaaagaaggtccagcgacaggcccaaagtgggacccagctcaaggggaggtcccaaggccttatactattactgaggctatggagcgctcacaaaaagggagctagcatgaccacactccagaagacccaacaagcagctgaaagagtcagatgcagatcttttcatccaaccgatggacagaagcttctgacccctgtggttgaattagggaaggctgaacgaagctgaggaggagcactaccctgtaggaggaccagcagtctcaattaatctggaccccccaagatctctcaaacactggaccaccaaacaacaagtagcacacacccggctgatatgaatcccccaacacacatacagcagaggacccccggggtttgtgttcaattacagatgatagcacctaaccctcaagagactggaggcccccagggagtttagaggtcaggtagggtagagggtggggacagcctcttggagacagggaggtagggaggaggtatgggatgtggaacagttgagggtggggagggggaataaaatctggagtgtagatagatagataaataaataaataaataaataagcagatgggaaaaaaatcaaacctggggttttttttttttcatgttatagtgactggagtcatgttatagtgttgctgtctcatcctctgtttcttcaatccttgatccctccctagagaccctgttgacagagatggcttggccactccctctataggccaagcacaaggatcctaggtgtataccaccaagcccagcccaaccttgaccttcttatcctccgaccgcttcaggccaagtacaaggtgtatattggtcaccaggcctggcttacgtagaggtggagttcaaatactagacaagcactctaccaattgaactacaatcctcagcccttgaataaacttctactgaaaaaaaaatcctcctgtatataccatctcatattacttattgagtgaaattgttggtttctgggtggaagccagaaaaaagaaaactcatttccagagataagcttaaaactgaaagctttattttctaagcatgcagggagccggccagtttgggatctgtacttttttttttttttttttttttttttttttttttggtttttcgagacagggtttctcagtgtagccctggctgtcctggaactcactctgtagaccaggctggcctcaaactcagaaatcctcctgcccctgcctcccaagtgctgggattaaaggcgtgcaccaccaccgcctggctgggatctgtacatttttaagggatgggaacccaaagcagggggtagtggggagcctcagtattatctaattgtattttgatattatgggtacctattggagactgggctgtatcctgggcacctggcttcaaggtcattaattcagctcttggagtcaagtcttctggactctggcccggaattttagaatgataagggaacagaggagtgggcgagctgcatgtagtcaattagtgcataacaggcaatggttataggtttttataacttatgcatgttggctcagataacagtagtttctatattctttactggttaacagacaagaaaacatttggacaagtggggtaggcattcggagcaggaccttgtttggcccggccttcaaggaggggaagttgtccctgaaatatctggactcagacaattgttttcaaccgaggttgctgagctgttggtaaagtccccagctcccccagggcctgagaccttgaatttagaaaacgaaaacggtagtacttagcataagtttcttttgcttgttcccaacaaaatgaggacatgactgctccaaggtatggctgaggagaaaatttttattatagatatgagaacgagtacagccagaggcatcgggaagagtctaggacagggaaagtagtgagctgaacctggccagcagactgacccccgcggagggagggggcagggggaaaggggggcaggggaaaagaggaagggggaaaggggaaggggagacaaggctggagaagtttccggtagggtgtggggtaagaagagtggcttttttgttcgtctgaaactctatgtagcacaggatagttttgaactcctgatcctccagcctcatcctctttagttctgggattacagatgctaactgattattgaatggcccaacatagcctgtttgcctctgagtttgccaacattccatctctcaataatcacaaagtactgcccagccacgacttaacagtctgtaggatctttatttaattcggatgtagcttcttccgaggataagtgcagttcgtagggaacatgctgtctttctgcacctttatgttgcctctgaccaccagcgccccaagcgagcccggagttgtatgccacgaaccctctacgtcctctgccaccccagcagtcttaggctccgccttctccccctccgtgggcggggccacccaatgacgtaaactgggcgtcctgcgaagggcgggccctgtttccggcttgaggatccgtcgcgtttctgaggcgacgcctcagtcagcagttaggatccgctcggagcggtcggtctcggccccggcgtcaccatgggggccgtcctcggcgtcttctccctcgccagctgggtgagtctcgaggcctcggccgtccggggcctgaggcgcgcagggggtgggtgtcgggccgcccgaggcggaccctcccactctctgaggctaacagagaggagcgggcaggcccagggtccaggcccggtagccgtcgtcccggagtcggggtgcggcggctcggctggctctcgctgtgggcggagggtcgcgggaggccggaccgccattgtttacaatttcgacgccccgcccccgccagccttccggacccagggttcccgcggccaggcgacgccgaggttccacggcgcgggttcctgagtggctagaggatggcgtcagggaatttagggccactgtagtcatttttcttcatagttcggcatatgccagcgctactgagtggggttgggaacggggcttttaagtcagccctgctgcaggtcgcgagcaaaaggcgtttaattagaagccccgcggcctaaatattttcgaattaaacaccctagcattcctctcctccagaactgttgtgaggataaagtaaagaaattagtccgattccccttgtcaatggtaaaacgtttttagaagttaattttaggatctctttaacctaaggaataatctaacaaatctgcctcagaggaacttggtagcttgaaccacagtgcctaattgttttctccttcccgagctgatgtaatgaaccaaggactcaggctctgctcatgtcaatggcatgtctcagggcagaagtaatgtcgaagatatcttgtatatttttctcctcctggtttaaaaccataatttgaaaatatcctatccaggtgttcatatctagaaactccttgcatatattgttaattcagtttttacccagtagggggttaggataccagagtggaatgagagaagagtacgaaattaaaggctgtggagggccatggcagatcatttgttatttgttttgagaccctgtctcaaaacagggaggtgcaaattacagtttatgggtaggtttttagaggctgtgggtttagtctccaattgccactatccacccccatctcccatcccacgccaaaaaagggggacagaatatcagggagccaaatcatgcagatacccactgtatgcctttattttttaggcaatctctttggtcattctgggtgtttaagattgcacccaggaccttgtttgtccaaagcttatctctgagagctcctccagctacacctccagtccagtctggattaaagatttcaaaggacttttgtacgtgtttaatttttgccttattgagataggtcaccagatctccctgagtatcccatgctggcctttcattcacagttctccttattgggattgtaggaaggtgttactcctggcaaagaagtttggcctttactttttttgaaatatggttttacgttgtagcccaggttggccttgaacttttagcaatcctcctacctcagcctagtgccgaaactacagatgtgagtccccactactggcatgtcttagtaaaatgcttcacattattattacttggggcggcggggtgggggtgggggcaggatttcactctgttagctcagcctgtctagaactgcagatccttctgcctcagcctcctgagtgctgcggttacagaagtatgccactttcctggctttttttttttttttttttttcctgaaaagagtgtatctgtggaagactgagttttggtgatgagtaactcaggtgattaggtcttgctgaaagaccccccagacgggtagtcgatcaatctgaggagaccctcccaaggaacagcgagaccacgattcggatgcaaacaacaagaggctttattggtaacacgggtacccgggcgactcagtctatcggaggactggcgcgccgagtgtggagtttttactccttttatagggctggggagcaaaaagcgcgggtacagaagcgagaagcgagctgattggttagttcaaataaggctaggggaaagtcccggccatttggggaaccttgaaactgatgtggggcagtctcgaaactgttgctggttccgctctatctgggtaccatctgttcttggctggtggggcagtctcgaaactgttgctggttccgctctatctgggtaccatctgttcttggccctgagccggggcccaggtgcttgaccatagatatcctgtttggcccctgtcccgttgttatttagccttaaactttaactgaacttccttgtaacttttgaggtctcagctctagtacttttccatgccttgcaaaatggcgttactgtagctaacttgctaagccttatggtggggtctttcattgctgcttgtatgtctgatttaggagggaaagaagaagaggcaaaggaggattttagcatgaggataaggacttttgtcttttgaaaaagtcagtggggtagatatgtgttgttgtgttgcattggcatgagaaatacttaccctacctttaaaacttccctttaaatggggctctgtggccgtattttctaggagttgcttctttaagtcagatgagggagactttgaggctagatttctggcctgagttcttcatttatgaaatagagagaagataaagcatatagtaacaggtagattacataatagttactgatttctatgtagaggtataaagtacagcctcctctaaaaggtatttgtggcacagagaaataaataggtatattggttagggttttactgctgtaagagacaccatgaccaaggcaacttttttttttttttttgagacaggttttctctgtgtagccctggctgtcctggaactcactttgtagaccaggctggcctcaaactcagaaatccgcctgcctctgtctcctgagtgctgggactaaaggtgtgcgccaccacgcccggtccaaggcaactcttataaggacaacatttaaccagggctagttatgaagaaatacagtttctagcttaactgatgtacaccaaagctatttacagagcttgcagcttttgcttccctgtctcctgctgcaagctttctgcagcagcttctccctatctcctgctgtctcctgctgcttaaagaatttccccttcccctgccagtgtaaacaaattcaagaccactgggccccttccctatcttcagggacagactagtggtcataaagaccacagctgccagaaataaccgtccttgagaaaacttccctacccctcctcagtctgaattctgaggaaaactataaactgctttgatcttgctgattgctgacagagttttctgccaaattaaaattatactgttgtgccaggcggtggtggcacacgcctctaatcccagcacttgggaggcagaggccagcctggtctacaaagtcagttccaggacagccagggctatacagagtaagccctgtctcaaaaaaaccaaaaagaaaaacaaacaaacaaataaattatacggttgctttactagccaataataatatagctgtgtaaacaccttcaaaagagtataaaatagctgtattttggacaatcagggttgactctccctgcaaggctgagcgaccccacgaatcggaataaaaacctcttgttattacagcaatctgtcattaagctgtgtttctgtgggtcacattctctacccctacaggttcagaagttcagtctcctatcaaggtgggagcatggcagtgtccaggcaggctagatgcagcaggagctgagagttttacatcttcatccaaaggcaaacaggagctgggcgtggtgcgccacacctttaatcccagcactcaggaggcagaggcaggcggatttctgagttcgaggctagcctggtctacaaagtgagttccaggacagccagggctataaagagaaaccctgtctcgaaaaaaaacagaaacaaaaacaaaacaaaacaaaaaaacccaaaaaaaaccaaaggcaaacaggaaaagactagcttctaggcagcacgaaagagggtcttaaatcccatgcccgtggtgacacacctactccaacaatgctgcgcctcttattagtgcttctccctgggccaagtataaacgaaccattataattagtttgctcgtactttcaagcaaagtatcacaaatcagtataagctatagcaatgggtggaagctacagatctgacattactgtggctcaggattgttaaccttctgcaattgattagagacgttgtgcctttgccctgttggtttgctggtaatctttactttctttggcttgtagatgtgggcttggcaggccaataatgcccaggatgggaataatccaccaaagacagaagagggcaatagagagcttattagattcactcttcctgttggacatacttactcaatatattgagccctttgtaggtcaggaattgtgctggttactttatattctagacatgcatgccattcttcacagtgaccttgttcagatgataagtggcattaggctcattttacatctgagagaacttctaagttaatcagcttgctctaatacaaatagtctgatatgtctggaaaagctgtaaaagtggttgctgagaccatgttataagactagaaccatcttctttttttttgtatttaaatgttttagattattttatgtgtagagtgttttgcctacatctccgtatgtacaccacctgcatgcctagtacctacagaggtcagaagagaaggttggattcctggaactggagttaaggctggtagtgagctaccatgttgggtaccggaaactgaactctagtcctctgcaagagaaacaactgcacttaactgctaagccatctctctagctctagtcatccactgttaatagtaattggttatgaatctgcattaactcattcttgtgctgtgatttgataatctcaactatcagcgcaagttgggtagtcccaaacaagcatgtaatgttgtcttattttgctggtggggcaatattgggagagggcctcaccgtataacattggctggcctgaaacttactatgtaaaccacactggcatcaaattcatagaaatctgcctatttttcccttgcgaatactaaaaggcatgagccaccgtgcctggctgtagtaatgttgccttatgatgaaacatcattttgggagcaaacagtaaaccaaaagtagagatgtttgtatttttcttacattgttttcacacaaaataatgttctctgtgaatatattttagaagctcttcctgtttcaggcacggtatggtaggctcatttattgtagtaaagtctaaaggaggaaatattttaatgagtccatgctacaaaaagaaagctagggttaaaaacatttttgctaaagtggtggaaattatattggttctaaagcctctgcatttttactttgtcttaaattgttttgtgttgggagacaggcttcttatgtagtcccagttgtcttcaaacgtgtgatacttttccataagcttcttaaatgcctctgccttctaagtgctgggattactgagaattgccatgttaaacggattctgttaaaatttctaagccctagtttgcctcctaagagcagtgaaggagctctcatggcccatggtgttgctcttaaaggtcccgtgcctctgtagtggtgcatcatgtctgctgtgcagttgctgtcccatcagtaagaattccactgtaactcggctcatctacgcttttatcctcttccttggcactattgtgtcttgcatcatgatgacagaaggcatacaaactcaactgaagaaggtaagtagaagttatagcgtcttaccatgtggttgttttttaaaattacttttttatactttacaatacttgtaatttttttactgttatacttgatcaaggtcatttaaaatagtttttaaaaaattttattttctgtgtatgagtgttctcaaatgtgtcatgatgcctgcagaagccagaaagagggtgttgtgtcccctagaactggagttatgaatggttgtgaacctaccatatgagttctggcattgcaacctaatagggtttcttgtagcctagattgaccttaaacttactgtgtagtttaggctaactttgaactggcctcatgcttcaaaccccccatggcttttgtggtgtatatctggcagacctatgctttgccactgtacctttctttcttgaacccagtcaaaccaccgcatgagggaaacaccacacaaagcttagttcagaaacaatggtaactcagtcgctgggtacaacaactagaatcctaatgtaagccatgttaaatctaaatcctctggtggcaaatccttgcagattctccatagggcacactagtagctacatcttgccctcttactatccctttccaaaaggcccctaactctctctcctcttcctctcttcctccctctaacccagaagtcccaccttctcgcccagtgattgattcctttattcattaggggacccattccccattccccattccctggtccagacaaccctttctgggaaatggaaattaacatcaaaatacaacaactccccggccatccccaacaaccaaatttagaaattactctttttcttgtttgtgtaagctgtaagctatattagtactttactttggaaggagtttattatagctgaaaagttttgtggggaaaaaggagataacctcgggaagatgggttatttaagaactgaacttatcctgagtcctgccctgttcagaaaattgcttactgaagaaacacccggaagcctgcctctgcactttcccaccactcaccactcgtgcagagctcccctccactcttctcccagcagaaatgcctctagcctttcagagggagcaaacagaaagagcccaacctagctccagaatattgcaatcccccttttcatacatatcccagcctcctgatagataactgggacttcctgggtgtagatagctcctgtccttgagaaaaaacaaaccaaacatccttgaaaaagataagtgccccacttattggccttgagaaaagggcaattaagtgttcccagacagctgtggcctgttgtaaaaatacaccagcttctgatagcacaagttacttttcccaggtcagaaaggtccctttccagctgcacggttctgcccccactgtctgaacaaacgttatcaggtgtgaaggacagcattccttcaccctcttgtgcaatgccaaggctggaaaacccccttcacttagacctgggggttcactctccttccttttccatcaggaaggctggtggcccaagctcgagcttgaataaagaccctcatgcaattacaacaggttgtgattcctggtggtctcttgggtttttacaatctgggcacaacattctaaatgacccaagctagtcttaaactcaccatgtaatcccaattggctgggaacttgtggtcatcttacttcagcctcccaaactttggaattatagggtcaactgtcataagcattgtgtgtgtgtggtatgtgtgtggtgtacgagttttttggcttcatgtatgtatgtgcacaatgtgtgtgcttggtgcctttggaggtgaaaagaaagcatggctcccctggaactgtagttacagatggacagctgtgaacaaccatgtgcgtgttaggaactgagtcttggtcctctgcagaaagtacaaagtacaaagtgctcttcattgataagcagtctcttcatctcagcttttagtttttaaatgtgatctgttgtttatgttcttaggtaataagattgtagtcagttggaagtcaaagagaaaaatctcatagttttgaaattgctaagggggtcttatttatttttaacaattccctgcttcatagtaggtagcattttttgattttgatattctcattgaaattccttgcctcctcagattcctggattctgtgaaggaggatttcaaatcaagatggttgatacaaaggcagagaaagattgtgacgtgctggtcggttttaaagctgtgtatcggatcaactttgctgtggccatctttttctttgccttctttttgctcatgttaaaagttaaaacaagtaaagatcccagagcagcagtgcacaacgggtatgtgagattgtctttcaatgtgtgtggttcctctccctcagcagataatatgccattggaatggagacaatggaatacttactcagtggtcagatggacacatgaacaattgtttattgtcatcattttttataactttctaaatttttattttaaagtaccttgtaaaataggtcaggcacagtgcttagacattgtatgttttcttcattcatagataagtatgtacttgatacatgtaatcacacatgagtacacaggcagcagagatggaagataaacagtaaaaaaaaagaaaaacctccatgggctgcttacttatatattctcctggttcccctgctgacccttcatctctcacatgtacttttcagctggaagctaatgggagcttggttaaatactttatttatttgttatttttatttacttggtttttcgagatagggtttctctgtgtagccttggctggaactcagagactagggtggccttgaactcagagattcaactgcctcttctatagcgctaggattaaaggtgtgagtcaccataacccagcaaatattgtggtttttgtatagatgttgtaagtgaaatccagagaagttaaatattttatctaatatctcttagctgggaaaggttgaaggtaggatttaagttcatgtatgttccattctcaaagcttaatacttcatgttctgccatgcaggccacattgactatttggttggtttggttttttttcagacaagccctcttcagctcaggctggcctgaatcctgatcctcacacctccacctccctagcagggtcacaggtgtataccatcatagccggctcaagacagtagtaaaggctgtagatgtaaagttatatttagccctggcctttttgctaatgagttctatcattatggacaaggtatttgtatcctattttgtaaatgtaggattggggaataatttctcccataaacataatgattaatgaatgacttttcatatagaactgttagaactagtaattctaaaaaaagtattatctttatgtgctaaaactctgaaatttactcataaatgtgacttatcttgcatgctaattgttctctcccagaaatcatccaactcttctgacccctggctctgcctctcgcttgtagctactaacaagccacccttccttgaattatcagattatttttatctagtgccatcctgccttgtgactactagtgcatatactaagtcacacatagactgggtattgaggaaacccctccaaatttcccagtaacctatcttcctacagtgtctcctccgtcagggtcccttcttgtaatgctgtaactctgtcttctgggggaacttaaggaaactgatgactttcgcctttaggacctccatcttgcagtccatgattgttgtctcttagggctgcctatggctatgatgctgtaacgctaatgaagctcatctgaagggttataagtctcctctttctgctggaccagtataacttgcttataatattgtgtgtgtgtgtggcagaggtgagattgaacctagggccttgcatgttctgggcaatcattctacccctgaactccagcctcagccttttttttttttttttttttggttttttcaagacagggtttctttgtgtagccctggctgtcctggaactcactctgtagaccaagctggcctcgaactcagaaatccacctgcctctgcctcctgagtgctgagattaaaggcgtgcgccaccactgcctggcttacttttttatttgctttactgaaacagggtttgtttttggttttttatttattttttcagtttgtttgagccagggtttctctgtgtagccctggctgccctggaactcactctgtagtcaccaggctggcctcgaactcagaaatttgcctgcttctgcctcccaagtgctgggattaaaggtgtatgccaccactgccctgccagaaacagggttttgttttattctgtagctcatgctgtcctggaatttggtatcttcatacttcagccccttgagtaactcggattacaggcatgagtcacaaggcctggcttttaatatattttgtatgaaatattgaatgaagtatactggaatcaaatgaagaaacaaacctagatatttatgttgcaaatgctagttaggttttatttttgtaatcagaaatgtacttttctcagtgtaagaatgaaaattcacataagtgaatttattttaacaggttttggttcttcaaaatcgctgccattattggtatcatgattggatctttctacatccctgggggcagttttactgaaggtatgactcactgctgaggggttaatatgtacaactctgtggtgactaagagctgaatttctgttagtgattggtaggactggcctttaagatgtggtgtccagttgtataactacatattaagacagtggtagattaaaaccaggagatagtccacgtctcagcttttctagaactatatgataattactgtttgccttagtcagggtttctattcctgcacaaacatcatgaccaagaagcaagttggagaggaaagggtttattcggcttacacttccatgctgctgttcatcaccaaaggaagtcaggactggaactcaagcagggcagggagcaggagctgatgcagaggccatggagggatgttacttactggcttgcttcacctggcttgctgagcctgctctcttatagaacccaagactaccagcccagagatggtcccacccacaaggggcctttcccccttgatcactaattgagaaaatgccttacagttggacctcatggaggcatttcctcaactgaagctcctttctctgtgatagctacagctgtgtcaagttgacacaaaactaaccagtacactgtttaatagtttatcttctcatttggtaacaaaaagtttatcagcttgtcaatatgagaacctaacattctcatgctgccttttccttgtcttaatttacttttataccatggcaacaggtgacatctgacaatctccaatgtggttttcccacacacacacactaaaaataaaggaaaagttgtgaagttatttggaatgtgagagcctattgaagtcactaacaccatcctgttctatgttagtgtctgcctggacacccctgtttcaccccaaatagccacatctaccttggaaacacatttagactgttgatcctgaccatggttcagatatattagctgaaataatttcatttgtacaaacttaaaactaaaacaattagaggaaataaaaattaattgccatgtgttgtctggaaaatattgctaagctctgcaaaaagacagatattactccaatcccagtgttaaaagcactgtaattgtggttttgtcttttaaaataatgtactggggctggagagatggtttagtggttaagagcactagctgctcttccagaggtcataagttcaattcccagcaaccacatggtgactcaaaaccatctataaggggatcagataagggcgtgcagatgtacacgcagcagagcactcatatattaaataaatagaatttttaaaaagggcaaaacaaaaaaccctccacacacacacaaaacaaaaaacaacagtgtacccctgagcttgagcatcaagagacattttggaggcattagcctatgcttggtctgtccatttttaaaggacttttatactctgtgtgtgtgtgtgtgtgtgtgtgtgtgtgtgtttcaagacagggtttctctgtatagccctggctgtcctggaactcattctgtagaccaggctggcctccaactcagaaatttgcctgcctctgcctcccaagtgctgggattaaaggcgtgcgccactgtgcctggctaggacttttatactcttaattggctaatgcatggtcatgggtaactaaagttttaaaaggtctcagggtgaaaggtaattgccaggaaacctgatgtctagcctgagcttgacccctgtaaggaggaaactgaatcacagaaacaattctttggtgtctgtgtgtgctgatgagcacgtgtgcgtgcacacacacaaatagataaactgaaaatgtttctaaaacatgaaatccagcacaacattcctcaaatacctgtaactttgaaatgataacaatcatactgtacagctggagatagactcttctaccctgttgatgactgctcataaagtttggcagtcatactgaaatgttattctttactgcattgttctttttttaaatgtatttttattttatgtgcattggtgtctagcctctgtgtgtgtgagtgtgtgtgtgtgtgtgtgtgtgtgtgtgtgtgtgtgtgtgtatgtatgcctgtatgtatgtatgtatgtatgtatatcagaccttggagttatacagttgtgagttcccatgtacatgctgggaattgtgaaatgttattcttatggtgagaaataacttctctttctttacagtctggtttgttgctggaatgttgggggcctctttcttcattatcatccagctggtgctcttggtagacatggctcactcttggaatgaattatgggtaaatcgaatggaggaaggaaacccaaggctctggtatgctggtaggtatctgtactcacctcagagcatcatactgctaccttaagtaggatgtatagtaacatcttcagttttaaatatataagctctcagtgtaaggtttctatttttttttttttaaatgcatgagggtgttttacctgcatttatgtctgtgcattttgtgcatgcagcatctatggatgccagaagagggcatcagattcccctggaactgaaacccatgacctctggaagagcagagaaccttttctccagctctagagctgcctttataaagttgagatttgttagttgtgcctgttgtgaattgtatacatcgctggaagatgagcatactccagtcagttgtattctctcggtctgtaatgcaactacttctgttgagatgctcaacaagaactttcagattcagaattatacagctaatagattatccatgtgaatgtaaagggatatttctatagattatttgaaagtagcagacgaactgttatcccagaccagggaggtcatctcattatttgtaaagggagccaggttagtgtagccagtgactacagaatgaaattgtctcagaaggggcctgttttatttcccagacatcgtccctggcatatagttactaggagctctgaccttgtgtgaggagatgagctctgtgtagcttaggctagccttgaacttctgatccttctgctttagctttgccaatactaggactacaggaacccacccattacgcctggccctgaactgctgttgaaagaccaggaatcatctagaaacgcttctatatgcatttttacctggtggatttaggagttgaatggtgaatcatttcaaaactgtatgaaactttaaccttggggcatttcagtttcctgtggcttactgctcaccataggaatgaattaagtgtcttcattgtacagcatggaagaagactgatgtcacttgtagctgtgattgacatggtggacactgttcatgctgtttcccccttttctagccttgctgtcctttacaagcctcttttacatcctctccatcgtctttgctgcgctgctctacgtcttctacaccaagcctgacgactgcacagaaaacaaggtcttcatcagcctcaacctgattttttgtgttgcagtttctattgtgtccatcctccctaaagttcaggtatggaggttctctgctttctcccgtggaagaattaatgctagctaagcttaaattccagacaggggcaacactggtattcagtccttagtgaattggtgaatttatatcagtggttaactacttaatatttcttcatatcataattaagtttttgtaattatagcttattaagcagaagtcggtatgtgctattgagtggcaatatttttttccttttttttaatttttaattttatattttgagattctctcacattatagtcctagctggcctagttctcaccatatactccaggtcttgaacctcagaacctccttgttggcatatgccaccatggcaagttgagttcttcctatattgtgttaacattcatttactgatcattaaaaactaggtaacttggggcttgtgaggtgcctcagtggtttagtaaagatgttcagtatcctgagttccattccctggacccatagggttaatgaggagaactgactcctgcatgttgccctctgaccttcacacagcttcatacaagggtgtgataatttcataaggaattggaggctgatctagaaaactgtagtgcagccctttctcaagaatcaagaagaagtatctgagatgtctcagccagtaaaggtgcttgcagttgaccttagtaccataccttgaacccctgtagtggaaggagaaccaattctgacctccatacttgaggtaacacacacacactgaaaaagaacatgaaagcttaggatatagcatggttggttgatagagagctttctcagcttgcacaaagccccaagtttgatcagcattaggcagggtgctgcatgcccataattgtagcattctggaggtggaagcttaaggtcagttgttcgtcatcatctttggcttactgagttcaaggccagccttagataacatgagatcctgtctcaaaattctttgttaacttacatttaattacttgctggacatggtgcatctccaacccagcaatgctggaggttgaagcaggactgagtttggtcaacaatatctaaaagaattagtacaaacaaagaaaactgaagtttccaaaaagtggtaggtcatttagctatcttgtggtagagttgagcagatttttctagaaagctaggcagtggtggtacacgcctttaatcccaacacttgggagacaggtctctgagattcaggacaaccagagcctcatagtgaaatctttctttttttaagatttatttacttatgtgagtatgcaatagctgttttcagacatatcagaagaggaaatcagatcccattacagatggttgggagccaccatgtggttgctaggaattgaactcaggacctctggaagagcagtcagtgcttttaatccctgagcccatagtgaaatattgtctcaaaaaaaaaaaaaaaaccctaaaaaaacaaaacagactagaaacttaagtgtcttaaaaacctttgtgtgatatacagaagttttcaagattgtgaaatgtttttccaaaccatcagtaagtaagtgcattgagtagagtaactcaaactgaagggctacctgtcatcttttagctgtcaggaagagtaagatttcaatttggctgcatctcgtggaggcacacaggctttcacaaggtcacccttgcgatccatgacattgtttctgttttgatttcacaggaacatcagcctcgctctggcctcctgcagtcctccatcatcactctgtacaccctttacctcacgtggtcagccatgaccaatgaacctggtaagggaatggctgactctagataaagtactcttggtaggtgtgcacactagagctggagcggatgtggcacaagcagtatagtttactttgactgtggttcggcctgcttacaccaacccattgcatagtgtaggctttatctaacttagactaagtcacagagttaagagtgagcttgtttggtcttttggtggaatatctgttttctgttttctaccccactcccatcccccagtgggatttgacttaagtcccttttttgcagtcctagctgtcctgtagctagttatgtagaaaggctgatctcacaaaagattctcctttctttatccccagagtgctgggattaaggaattacttctcaatagaatattctacagatgatgatgatgatgatgatgattcttcttcttccttctttcttcttctttttttctttttgtttttttcgagacagggtttctctgtatagctctggctgtactggaactcactttgtagaccaggctggcctcgaactcagaaatccgcctgcctctgcctccctagtgctttgattaaaggtgtgagccaccacgcccggcctttattgagtgactggaataagataagaataagctcccttttggaaaacctaaacaccatggtaaaactgtcaaaacagtgaagtcacaatagataggggctggagagagggctcatcggttaagagcactgactgctcttccaaaggccctgagttcaaatcccagcaaccacatggtagctcacaaccatctgtaatgggatctgatgccctcttctggtgcgtctgaagacagctacagtgtacttatatataataaacatctttaaaaaaaaaaaaaaaaactcgagatagtatttttttctaaagctagatcattgtgatgtaaatacagtattgactgctgagtttcaggttctaagcataactttcctgtgttttaaataaagctaactggtgtgtggacaagccctctgatttatgtgaaaataagagtgtgaataagagtgagctgtaactaatgataacaaacaattacatttcagagcggtcctgcaatccctcccttatgagcatcatcacacacttaacttcaccaactgtgtctcctgcaaattcaactactcttgctcctgcctatgctccgccgtcacagagtgggcactttatgaatttggatgatatttggggactgattatctttgttttctgccttatatattctaggtaagttctaggtaagaggtgcttacagtatcctcatgaaagtgaataataggtttttttttttttaacgatttattaatatatgtaagcacactgtagctgtcttcagacacaccagaagagggcatcagatctcattatagatggttgtgagccatcatgtggttgctgggaattgaactcaggaccttcagaagagcagtcagtgctcttaaccactgagccatctctccagctcctaatatgttgtctttaaaccattgtgaagaattaaaacagtgtagggttttttgtttgtatatttttgttttttcaagatagggtttttctgtgtgttgctggctgtactggaactctctttgtgtatgtagaccaagctggcttggaactcacagagatctgcctgcctctacctcactaaagctgggattaaaggcatgtgccaccatacctggttcaatagagttctttttaatgaaaagttgtttacatatctttgccagtccagctctgtatgcctctttttggtatttcgagacatggtttctctgtgtagccctggctatcctggaactcactctgtagaccaggctggcctagaactcagaaatctgcctgcctttgcctcccaagtgctgggattaaaggcgtgtgccaccatgctcagcactgatggctctttcagacatcctgagttcaaatcccagcaaccacatagaggctcatgatcatctgtaattggatccgatgccctcttcaagcgtgtctcaagagagtgatggtgtaaataaagacttattttacgtaagtgtagtgggaggagtaccaaattttgtcacctttttctgcctgtagaaatgatcatgtagtttttgtcctctttctgtattttttttttactcattaacttgatcttctagtgagcatctacagtgctggcatccagaggtgactgtagctagcaaggcaggattggcaagtgttggcaggacacctagagagctgtgagaaagaggtgagaggaagctcctcacccagcttagacaggggtgaggtcagaagaatttcacgaggctatggcactgagaagagatgtgacagataagtgagttagccgggaatcgctgggtggtacaggacaagcatagctgaggcactcgtgtagtagtagaatagccactggaagtgagctgtggagcagcaactactaagactactgtcctggagttagcaggcagcaggttgctgggcagagctttcattaggctttctgtgtccaaggtaggaatagcccagaaataactacacatttgtaggcaaaagaatcatttcatctaaaacagttcctttttgatgtgattttttttttgtggggggggcggattattttccagcttccgtacttcgagcaacagccaagttaacaagctgaccctctctgggagtgacagtgttatccttggtgataccaccaatggagccaatgatgaagaggatggacagccacggagggctgtagacaatgagaaggagggggtgcagtatagctactcctttttccacttgatgctctgctgtgcctccttgtacatcatgatgaccataaccagctggtacaggtaagaggcatagacagaggtagaagagcactcagcccttgggaattcctataacatctctgaaccatctttactgtggagccctttgctgtctcagagaaggaagtttctctgaaatcctttcggtttctttgagatagactagctttgaactttcccattgttctagttctgctgtagcaaacttactctgcgattccaagcatgtatcaacatgctgcttgaaatagagcctggttggaattattggtggctttctagactagttatttgaaagaaaatcatgacctaaaagccattcagtgtgaccttgataatttttttctgtgcttttagagatgccatattaaagtaataatgtcctaaggaggaaccacttcagggactgcatttccactttgccaataattagagtaattcagatagtactgaataacattgctgaaagaatagttaggtcttagcaagaaggaaaatgcttgagagtcacagtcctttggccataataactgaaagtagcttctcagctccgtactagaacagtactagggttaatggtgccagctaagcctcactgtggggtcttttggtgttggtcaggatgggtggaatgggagggatgcagatttgcaatactaatctctttctccctccctactctctgttttcttagccctgatgccaaattccagaaggtatccagcaagtggctagctgtgtggttcaaaatgggctccagctggttgtgcctcctcctttacctctggactcttgtggctcccctggtcctcacaggtcgggacttcagctgagctcagtgtgtcaaggacactgataaagctgaccagagtctccttttctgaaaatgcatatccattttgcgtttcatcaacgagactattaagtgaacgctttgcagatttggctgtattcaggtttatatcaaaaggcaagattgagtaatgcttgatgcagaatctgagctttcatatatatatatatatatatatatatatatatacacacacacacacacacatatatatgtttattnnnnnnnnnnnnnnnnnnnnnnnnnnnnnnnnnnnnnnnnnnnnnnnnacatatatatgtttatttgtaaggctatagcacaaagggaacatttttgtgttttaacatgaactacagctgtgctgtgaagagaattctttataaagacctgtagattcctacaactttggtttaagttttaagttagaagattgttggatatttaaggctatttttaatttctattacagtctccttaaaaaccaaaaaggaatgcattaatccacatttccccttcttcagaggtgtagtgtcctggctcttggcaaggaattatgtatttaggtcagtccccagaaatgcagctgctcatacagctgagagaaggctattattgagttcctttacttactttttatactacactgatgctgcttgatagaagtctgtggctttgtcagatatgtcacccaagtaaatgctttgtagatctgattaaaatgaaaagctcacttgagaaacactgcagagttatgtaatgatcttgttgtgagtgtgtgaaagtcaaaggcatgtcagtttattacatttgcaacataaaagtacttaattaaaatagatatttagtttcttgtttgtttgtgtatttgtttagaaagggtcttttccacataacccagacttgcttggaatgcagatcatcctatctccacttccaagtactgaggaggaggtttctatcaccatagctagtcttttcttaaagatccttctgcagtggggttgataggttttcttttattgttgttttcttgtttagagagtcccaaatcaatctgacatttcaggcaaaatgctcctcttctaacacttaagatttgactagtcaagtttttaagttcatttagaaactaccctaaatattttctctggggaagatcaaagtaggtaagaaacagtttaggcactgtcaaaaaagatattcctgaaaagcagtgtgcaagggaggtatgataaaacaggcttttcaagagaaactagtatcggttctgcactaggccctgttgggatgaagacaagacagacattcttccatctaaggaaaatgagctgaccagcctggtaaattagtgctgaaaactcataaacagaaatcagtggatagaggctagcacagtgacttcctcgagagagtgctgttaggatttgtaacttaggttctcacccaggtatcagggcagttcatctgagatttgaactaaagatgtaagggggtttggggaaaaattgacagcttagagaatttccacattggtgtttaaggggataggaaaaacttatttcgagtttaatctgtgtacataggttctgcttgggatcctggttgggatggaggtggtcccttcctatgatgcataggtttgggagtcagacctctggggtctgcctgacctctgctatttctaggttgactggctgtctaatgctcactgagtacatgctgtgcttgtgaccttgagctgcttgtgaccttgagcactctgcctgggcctcatgcagaacttagtaccagagattatttgaagataaagttgtctcagaatggatatgttgtaaggatgtttgacagtaagtgccaatgtcactatggattaaagcaagactaaatgtacttaaaaggtcagaagtgttcagaatctgatagaggctgggttgaatgtagttttagagaattaaacatagttgtaatatagacagctaggtagagctggaggctagggaagctgggtttgatgggttgttggaactactgtcctttaggatcatgtgtcaaagcaaactacaaaggatttgtgaagcagataattgtggcccttaagcttaactgtgtgagacaaatacctgtttttaacagtaggggaaccataaatttcaaagcggatcctattctttgtcttatatgattaaaaataaatggagttctaaactaccaaataatgtaatagagttcaataaagggttttttttttttttcaccatgataccttagattaatttgaaataagttctcttaaaaacagagcaatttctactgttgcttggctgcactctaagttaagtctggctgttaacatgaaacagttgttcatttcagtctcgtgcagaactgtacacaggcgtgaaataccggcgttttgagtaagcctgtgggtatacttcagaactggacatagttttgagttatctcatgccagatgagtccacttgatatttcatcacagactcatctgtagactgagggccctgattcagatgagtggcatggtctaggaattcattgaaggcaacagcagaggctggctacagctggggaaactagttgacccagcttgaattagtttcctttctaagtcagcggatttcaatctgtggatcactgcccctctgcaggggggtagtgtgtgggaggggtgttgtttttgaacaacccttttactggggtcccctaagatatttatataaccattcataacactagcaaaattacaattctgaagcagcagtgaaaataattttatggttggagtcaccacagcttgaactattttaaggctcgcattggggaggttgagaaccactggtctaggcgagtctttgtttgtttggaagtaaggtcttgctctaggctgtgctagcccaaactcactctgtaggtcagccatcccgccctcttctgctccctaagcacaggtggactgtagacagcagccaccacccccagcttcaaattttatctttataactaaaggcactgctgaaaatggcctttggaagccagggatggtagtgtacatgtataatcccagttactggggctgctaaggcaggaagatcacaagttctaggcctgacttggctctaggtcatgtttcaacatgagctgaatacggagaccatatcttttttttttttaagaaatatttaattattttacgtatgagtacgctgtagctgtcttcagactcaccagaagagggaattgaatcccattacagatggctgtgagccaccacgtggttgctgggaattgaactcaggacctctggaagagcagtcagtgctcttaacctctgagtcatctctccagccccaagggagaccatatcttaaaattaaaaaataaaagaaacagagacatgtagcttagtggtgcagtgtttgcctagcatgtatgaggtgttaggtacagtctccagtaatactcctttctctctataaacaatctatggtcctggctattgaaagcctagaccaaatcataacagatctgactataagcaggacagcctttttgtctatgacaagttcttgtttggttgtatttttcttcttacataggaacaaagcttagtatgttgctaacaggtgatctctgggctattacctggcagcctgtgccaggcctgtgcttattattagcaggaattgcaattcatctctttacaccttttatattggcccatccattctgttacccaggtacaacttagtagtctacacagtgatgtcctggtttctgctgtctttcttaagcctgtcttcaagtgaagaataatatatcatctggctagcatgcagaaagccctgagttcactctttagcactctgccccccaagtcatataaatatatttgccagcagtgatttagcagtatctgctaatatgcagttggtgtttacctcttttcttttcttttcttttttttttttttttgatttttcaagacagggtttctcggtatagctctggctgtcctggaactcactctgtaaaccaggctggcttcgaactcagaaatctgccagcctctgcctctcaagtgctgggattaaaggcgtgcaccaccactgcctggcttacctcttttctttttcataggttataaactgaggcttagagaagtgatttgcccaacgttacccaggaaatggcaaagcagaaaaaacctcaggtttgacttaaagagagacctcattgctcctgggcccaccaaggtatagagacactagggtgtgtgggggagtagggggagcaactccccacatttatatcacaggagtaggcactagtatgttttcctttgagataggatctcaccatgtagtagtcccagctgcacgagaactgatagagaccaaggtagcctcaaactcacagagctctgcctgcttctgcttcctgagagtatggcctggcttgtcactagtatcttaaggtcatatctatagcgactagtatctattcaggtaaggtcatgaacattttttttttaataccttaatgaaagtgattccctaaaaaaaatattactacctttttaccttttcttacgatgctgagggtcaaaatctttttgaccactgctttttacacattgatcatgtgccccatctctaagccacaaccctagccctacttaccgatcttaaatacaagcacataaaacttttactgtcagtgactgtggcaatgttcaaccagtgtcacgtgcttaggcaaagttctgcctcagatcagggagaagtattgatcctcacaactgccttaaagtgggggtcaagtgtcaggctgttctcatccaagagtgagaaacaggtttccccagaaagacacgcttggagggctggctctgctgtggtatgtgtacttacctgttgcgtcatcagacgctagcagcaagcctacatcctgtgctagagtttttcaacgtactcaactgtcattctaggtaggctagtcatgaggacccagctgctctcttctggggcgttatgtcccttatataaacaaacagcaggtagcagcttagtatgtgacacacaagtcccagcccagtactcttcagtctgtacctgtgtataaaaatgttaggttacaacttcagtcttgggtgaaaaacttggggaagtaggtaatgaggccacactcccactgaggacattgttatactcagcagagggtcatagtgttctacccttcccctagtctctgtagacaactaatggttgctaagggagagacattttcttcagaagtgtagccacaggcaaatggcgtgtactcctgtaagtaaccctaacttaactcaatggttcacaccagaaaaggcctgagtagaagagggactagttaggaaagtgggatcagtgggaaggagaagataagggacagtaaggaaataagcatgaatacattgcatgcatgtatgaaaatgttataatgaagccattatgtgtacttagtgtatgaaatgaacccaaaggagctaggcctgatggctcgtgcctgtgatctcatcactttgagaggttggaataggattgctcagtcatcctggactataagggtaagaaaaatgtacattgaagcacacatgtgaccccagcacttgagtgtggaagcaggaggattgtaaattcagtgttatgcttggttaatttttaagtttgatatctgattggactacataagaccctgtctcaaaaaacaaactcaactaatacaaaaaaaccatttcccacccccacccccaaatgtatgtatttccagaaaacaagccaatttcttaaagccttttgactaaggtctaatggagagatggtggtctggctgttgtccagtttcaccctagacctcagcctcagctagaatagcagggactaaggcatatgccagtttatttggctcactgtttctctgatccttccctctccatcctcaccaggattggttacatgagtgtaaggagaaatgtgtgccactaaactccatcatgtcctcctgatgcaggatccagtcagactgcctggctaattaacatttgtgggccccatttttctcaaggaggcaatacacttcatttatggtgtctgaagatttaaatgagattatgtgctctgtgtacttggcacacatgtccagcccataggtgctctttaggaaccattagttttcattggaaggattcaggatcagtccagagaaatagctgtcttggaaactgaaaaatgcataatgtctctaccactgtgcgaagctaagtccatttcccttcatatacaactggtgtgatcttcagtggtagccagtgccttccacgtgcccctcccaacctcatccagagggcaggaagctgtccttgggcccgtggttaggaaacctgtgtctatccaggtcaccaggactacatagtgagacctgtctcaggaataaaaaccacaatgcactccgctttccaggggtttttattttggagacccagtcatgcatactaaaattacatattttcaccacttagaaaaatgcactagaaaaataaacttttggtcaaaacactgaagtaggtgaatccatcatatgtgcctatactcaaagccaaactgaatttcagtttgaagtaagggatgtgactggggactaaaatggtggcctagactggtcaggaaaatagcccagttcccacccatcagagagggtatctgaggtcttggccactgagaagtttcaagtattttacctgttgggccctttgtaatgtgccaagaagctgaggcacatccacaagaatccaaagcggctaccagtaactgcctgatgggaaaagattgaaaaccagtaaatttggtcacaaaccagtaaatgtgattccagctgcaaattccactggaccttcctgtggagcaagttcccgctgagaagcagcatttgatggtgcttcttgcattttgaagctgaacatttctgagtcaggagagcagaaagcaggtttacaaagtgaacagactgcagtactgagcctcaccaagatgtctcccaacagctcatgtgtctggtgtttctgcctaacatgaccacagcacaactatacttctatcaactgagttagccttttccttcctaaaggaggtgtcataagaaaatccttgatgaggtattataataccaccacaacaccagagtagctagctgttgctgcccaactgaaaagcaagttccatgaatgatctcaagagtgagatgacatctacccaaattgcctgctaggtaataaagccatttaaagtattcagaggaaatgaccccagtcctccaactctgaagaagctgccccataacctgtgatgcttacaaacctgggatgaaatgtgaacagtacaaatccacctgtgcctgaagccagcacttttactgtttctgtaggttttatctgtattcctgcatgaaggcagaaaacgtacattaataggaagctgaattgcctagaaatctgtagcgggcttgaaggaaattcccatatccctacactaggacatttcagcaccaggcaaagtatagcgtccttacggccagagtctggtcaggaacaggattcagagtttagcatacaagcccctgtccagcactcagggtgttaatgttctatccctttctcttccaatataccacatgaccttgaatttaggaaaggtggatttccagctgtctgtgaagcgtctagcactttaccccaaagtcagatactcccaggttcttgctcacttgctggctccaccagtgtgcttcccgcaggtgaggccttcgtctcccctgctgctcaacataagagttgctttattttgcaccaggaggtcctggtctcacagcctgcttcaaagctgaggtgccaagatggatctctagagtccacaagcattagtgagaacatagcagagccagcctccttagaggcttgatggaatggctccctcttggcctagccagaaaggcctggcaaacaggtaacatttctgccctgagatttctccccaagagcctggttgtccctttgttaagtcaggagaactagtcaggtgacacaatttaaattcagggaacccagtgggactgaggttttccctttgttttttccttctgaaccacctaagaaagcttctaataagactctcccatcaaggctgcagggggccatcatgggtcttttcaggtgtctaggaggccaggagctaaaccaaatagcagaaactcagcagcaaatggtctcaatgggcagtcaagaggggtatattggccctaaagcttagccaggacctaaaannnnnnnnnnnnnnnnnnnnnnnnnnnnnnnnnnnnnnnnnnnnnnnnnnnnnnnnnnnnnnnnnnnatcaacgaattagcatctaaagtgaaaagaatgtcccatagaattgacattattgaggtaagtttccataaagagcttctgtagacattttgggaaatgctgttaagggtggaacagcttagtaacaaccgactgacctttgatctccaagcactgtgtgtaagctgtatgcaatgcctgcttaagtccaggagatgtacaaccaacagtacttgacactataatacatagtgaatacaaagggaacaagtcaaaagccaggagataaatcacctcactcagtgcttgagttaaggctaaaaccttgtcaggtgtctaaaatacccaaacacagagctgacattcagtccaagtggtcctcccatacgagactccagtgtgtctgagagggcagggcccccaggtgaaccagcaatagcctgctcctgtatgtttccagggacaaaaacagcccaaacctggcaattactgtggctgtttctaatatagtatgaatgtctccagtgtggaaggagtttgtatgagatctggtcggcctcaccaaagccatccctttcaagtttacccattattctgcaaaggcagttggtctccaccaactcccaggaacatactagtttctttaaagggagggccagatggtgctgttcctttacataaggctgtattcatactacaacaaaacaaaacaaaaagatccaaccacctctaggtaatgtcttcccaagcagaagcctaacaacttcagcagccacaaagaccctcattccatgtagcctcactgagagatgacaagctgaagcccgtgtcttgtcagtcatacgacctgactcctggtccaaatgcttttagccacacagtcctagaatccagtattttatgctgacctacatgattccatggagaaccagagctaaggctttatggggttgggaaaagtttctattgcaagatttaaccctggactcccagggatgctttgaagcctttggcttccaaatttgatcttaagtactacctgggcctggggtttctaccactcagttagtgcttcccaggcccaacaatgacaactggggcctgaaccttgaactttgctgatgagcaagaggtcaacacctagggtttatgggaaagagactcaaaagtcttacgtgtggccacctctaaggattggtgattgtttcagagttgtgatcagtcaagttgtcttctcctggtcacttcagagtgactttgaccttagttctttccaagatgcataagaaacagatacagcttccagagtaacagctgcaaacttaagagtacaccagggcaatttccatgtcttccctggaataactcagtcaaaggtctgcctgtgatgggcgtgccttaaatctctgcaggcagctccatgctgttgcagagggatggagcaagacggaggtcctggcatctcagcctgtgcatttctaaggaaggaaggaaggaatcacacacggtactctcccgaaagagggctaatagcaggagtagagctgggacttcatggctcgcatggagtcatcacactgcgcatctgagatcagcccctcaggtagcaggggctggcccaggaggttgtcgcaggcaggcatgggctggcagaactctttcacaaaatcctcctctgaggccagcagcacggcgttccaggaggcagtgtccagctccccagctgtgcccccatactccttggggaggatattccttggcaggtttgtgtggagagagttcaggtcagacccatggaggaagaactaaaacagaacagtataaaaagcacagtcagcagccgtgatcacgggcacaggattgtgcccttccacatgccatcatggggttgggggaacatgaggacccactccttcctcagaggagacattttcttcagtgttcaggccatttaagtgcccaaattcttgtaaatggtcctttattcatgatattgtaaataaccctagataaactctttggatcactaaaacagacaaagcacacatgaaagtagaagggactgttgagaggaagaggctcaggagtgtgaggaggacaagtcacagggaatgaagatggcaccatgcagctgagtatcatattaacatgttaattgtgctgggttttgtcaacttgatacaagctagaatcctatgaggtgggagaacctcaactgggtaaaggcccctatcagattggcctgcgggacatttcccatccctgtgaaggtggttttgggtgtataaaatagcgaatgggggtaagctttaaggagcaagccagtaagcagcattcctccagtctctgattcagctcttccctcatgtttctgccttgggatcctgccctgaaattcctgccttggcttccctcagtggaccat

SEQ ID NO: 1586 - DNA, 2235 bp, Mus musculus
cgctcggagcggtcggtctcggccccggcgtcaccatgggggccgtcctcggcgtcttctccctcgccagctgggtcccgtgcctctgtagtggtgcatcatgtctgctgtgcagttgctgtcccatcagtaagaattccactgtaactcggctcatctacgcttttatcctcttccttggcactattgtgtcttgcatcatgatgacagaaggcatacaaactcaactgaagaagattcctggattctgtgaaggaggatttcaaatcaagatggttgatacaaaggcagagaaagattgtgacgtgctggtcggttttaaagctgtgtatcggatcaactttgctgtggccatctttttctttgccttctttttgctcatgttaaaagttaaaacaagtaaagatcccagagcagcagtgcacaacgggttttggttcttcaaaatcgctgccattattggtatcatgattggatctttctacatccctgggggcagttttactgaagtctggtttgttgctggaatgttgggggcctctttcttcattatcatccagctggtgctcttggtagacatggctcactcttggaatgaattatgggtaaatcgaatggaggaaggaaacccaaggctctggtatgctgccttgctgtcctttacaagcctcttttacatcctctccatcgtctttgctgcgctgctctacgtcttctacaccaagcctgacgactgcacagaaaacaaggtcttcatcagcctcaacctgattttttgtgttgcagtttctattgtgtccatcctccctaaagttcaggaacatcagcctcgctctggcctcctgcagtcctccatcatcactctgtacaccctttacctcacgtggtcagccatgaccaatgaacctgagcggtcctgcaatccctcccttatgagcatcatcacacacttaacttcaccaactgtgtctcctgcaaattcaactactcttgctcctgcctatgctccgccgtcacagagtgggcactttatgaatttggatgatatttggggactgattatctttgttttctgccttatatattctagcttccgtacttcgagcaacagccaagttaacaagctgaccctctctgggagtgacagtgttatccttggtgataccaccaatggagccaatgatgaagaggatggacagccacggagggctgtagacaatgagaaggagggggtgcagtatagctactcctttttccacttgatgctctgctgtgcctccttgtacatcatgatgaccataaccagctggtacagccctgatgccaaattccagaaggtatccagcaagtggctagctgtgtggttcaaaatgggctccagctggttgtgcctcctcctttacctctggactcttgtggctcccctggtcctcacaggtcgggacttcagctgagctcagtgtgtcaaggacactgataaagctgaccagagtctccttttctgaaaatgcatatccattttgcgtttcatcaacgagactattaagtgaacgctttgcagatttggctgtattcaggtttatatcaaaaggcaagattgagtaatgcttgatgcagaatctgagctttcatatatatatatatatatatatatatatatatacacacacacacacacacatatatatgtttatttgtaaggctatagcacaaagggaacatttttgtgttttaacatgaactacagctgtgctgtgaagagaattctttataaagacctgtagattcctacaactttggtttaagttttaagttagaagattgttggatatttaaggctatttttaatttctattacagtctccttaaaaaccaaaaaggaatgcattaatccacatttccccttcttcagaggtgtagtgtcctggctcttggcaaggaattatgtatttaggtcagtccccagaaatgcagctgctcatacagctgagagaaggctattattgagttcctttacttactttttatactacactgatgctgcttgatagaagtctgtggctttgtcagatatgtcacccaagtaaatgctttgtagatctgattaaaatgaaaagctcacttgagaaacactgcagagttatgtaatgatcttgttgtgagtgtgtgaaagtcaaaggcatgtcagtttattacatttgcaacataaaagtacttaattaaaatagatattta

SEQ ID NO: 1587 - protein, 483 aa, Mus musculus
LGAVGLGPGVTMGAVLGVFSLASWVPCLCSGASCLLCSCCPISKNSTVTRLIYAFILFLGTIVSCIMMTEGIQTQLKKIPGFCEGGFQIKMVDTKAEKDCDVLVGFKAVYRINFAVAIFFFAFFLLMLKVKTSKDPRAAVHNGFWFFKIAAIIGIMIGSFYIPGGSFTEVWFVAGMLGASFFIIIQLVLLVDMAHSWNELWVNRMEEGNPRLWYAALLSFTSLFYILSIVFAALLYVFYTKPDDCTENKVFISLNLIFCVAVSIVSILPKVQEHQPRSGLLQSSIITLYTLYLTWSAMTNEPERSCNPSLMSIITHLTSPTVSPANSTTLAPAYAPPSQSGHFMNLDDIWGLIIFVFCLIYSSFRTSSNSQVNKLTLSGSDSVILGDTTNGANDEEDGQPRRAVDNEKEGVQYSYSFFHLMLCCASLYIMMTITSWYSPDAKFQKVSSKWLAVWFKMGSSWLCLLLYLWTLVAPLVLTGRDFS

SEQ ID NO: 1588 - DNA, 42123 bp, Homo sapiens
aggcccggagcgttggggccgcaaccggccgcccggctcctgctcacctgcggtctcgccgcctctccgtgcctgggccgccggtccgcagcgcctccccggggcagcctagcgcccgcagcccgcaacccgcagcggagcccgttgccttggcgacctgggctgccgaactcccgcggcactcgcgctacggcggctcggatgggaccaggacggttcgcgtccccttccgcagccgcggagggggcagaggagggacgaagtgggagtcgagggctgagctgcgaaggagggatccgggttggaacttggcccggggaagatacggaaagggggacagtgaggccaaggggaggtcttgggccgcgggtgctgcttgtgcctcagtttatctctctgtaacctcaaatggggaccgtgcgaggaggagacagggcctcaggtggtggcttggtagactgggtttttgttattttgtttttgtttttgttttgagacagaatctcactctgtcgcccaggctggagtgcagtggcgcaatctcggttcactgcaacctctgccccctgggtttgagcgattctcatgcctcagcctcccgagtagctgggattaccggaaggtgccaccacgcctggctaatttttgtatttttagtagagacgaggtttcgccatgttgaccaggctggtctcgaactccgacctcagctgatccatccgcctgggcctaccagcatggtgggattacaggcgtgagccaccactccctgccaagactgggaatatttaaagacaagaaaactgatgtgggaagggtggcagattcctctcttttatagtctctgaaggggtggtgtggcaaagagtgaataaattggtttctttgatggagaattagatcaccagatttaatttcaatatgaggaataatttatttttccttgtgtctagcaactacacttcttggaataactctgcagatatgctgaaacctgagcacaaaggatatattcattaattcatttttgtaaaagcaaaagggttgcgaccagtctaaatatctatcaggggctgggcgcaatggctcacacctgtcatcctgaaaccacctttgcaaaaaatcataactgagatatcagacctaactgaccccatcttgcttctaacctctaaagtgtcctgttcattcctgggtataggctaaaccagttttttttgtttttttgttttttgtttttttttttgagacggagtttcgctcttgttgcccaggctggagtgcaatggcgccaacttggctcaccacaatgtccgcctcctgagttcaagtgattctcctgcctcagcctcctgagtagctgggattacaggcatgcaccaccacgcccagctaattttttgtatttttagtagagacagggtttctccatgttggtcaggtgatcctcccgcctcggcctcccaaagtgctgggattgtaggtgtgagccaccatgccaagccaggccaaactagccttgggaaggaatttagtgtatcatttaaacaatagccctttccagaaagctaaactgttcttgtaaaacaaatgaaaggccacaggccaccagccaccaagccaagatgagaagggctggagttctaaatagtacccaccattattcttattctagaggtcataagatttttttgttttgtttttttgagacagagtcttgctctgtcacccaggctggagtgcagtggcacaatcttggcttattgcaacctctgcctcacaggttcaagcaattatcatgcctcagcctccacagtagctgggattacagggacctgccaccacgccagctaatttttgtatttttagtagagacggggttttgccatgttggccaggctggtcttgaactcctgacctcaagtgatctgcctgcctcagcttcccaaagtgctgggatcacagacgtaagccactgtgcctggcccccaattactcttgaggtaaaatcgctattgtgaacctaagatcagccttttgagatgtcttttcaggtttttgcatttctaacaaccagatggccccactggacctgccaaccagttctgtggccctcatccaggaactgactcagcagaagaaaacagctttgactctctgcaatttctggtttttttgtttgtttgttttgtttttttgagaaggaatctcgctctgtcacccaggctggagtgcagtggcgcgatcttggctcactgcaagctccacctcctggggtcacgccattctcttgcctcagcctcccgagtagctgggactacaggcacccgccaccacgcccagctagtttttttgtatttttagtagagatgaggtttcaccgtgttagccaggatggtctccatctcctgacctcgtgatccacccgcctcggcctcccaaagtgctgggattacaggcatgagccaccgcgcccagcgactctctgcaatttcatcccccagccaagcaatcagcactcccaattcattggccccctacccaccaaattatccttaaaaactctgatccttgagttttcgggaggatgatttgagtaataacaaaactctgggctcccgcacagcaggctttgtgtgaattactttctctgtcgcaattcccccttcttgattaatcagctctgtctaggcagcgtgcaaggtgaaccccttgggcagtccagcactttggtaggctgaggcaggcagattgcttgagcccaggagttcaagaccagcctgggcaacatagtgagacctcacttctacaaaaaattaaaaaattagccaggtgtggtggtgtgcacctgtatgtagtcccagctactcaggaggctgaggtgggaggatcccttgagcccgacaggcggaggttgaagtcagcagagactgtgccattgcactccagcctgagtgacagagggacaccctgtctcaaaaaaaaaaaaaaaagccagccacggtggctcacgcctgtaatcccagcactttgggaggccgaggcaggcggatcatgaggtcaggagaccaagaccgtcctggccaacgtggtgaaacaccatctctactaaaaatacaaaaattagccagacgtggcagcgcgctcctgtagtcccagctacttgggaggctgaggcaggagaattgcttaaacccgagaggcagaggctgcagtgagcggagatcacgcccctgcaccccagcctggacgacagagcgagactctgtctcaaacgaaaaaaaaagtctatccttagggaactgaggaaataaattatgatacatccataaaataaaatagattaccgtagcaagaattaagagggaccaaggtagatatagacgtagatacagtttagatacagagctgtcttcaagctgtgtaaccagccagggggtttacctcgcctgctacctagacagagctgacttatcaagacaggggagttgcaacagagaaagagtaattcacacagagccggctgtgtgggagaccggagctttattattgctcaaatcagcctccctgagcatttggggatcagagttttttgtttgtttgtttgtttgttttgagacggagtctgttgcccaggctggagtgcaatggcacaatctccactccctgcagcctctgcctccccagttcaagtgattctcctgcctcagtctccagagtagctgggactacaaggcatgcaccaccatgcctggctaattttttgtattttttttagtacagacgggggtttcaccatattggccaggctggactagaactcctggcctcaagtgatccacccgcctcagcctcccaaggtaccaggattacaggcatgagccaccgctccaggctggggatcagagtttttaaggttaacttggtgggtggggggaagccagtgagcaaggagtgctgattggtcaggtaggagatgaaatcatgggaagctgaagctgtcctcttgcactgagttcctgggtgcgggccacaagatcagatgagccactttatcaatctgtgtggtgccagctgatccatcaagttcagggtctggaaaatatctcaagcgctgatcttagcagaagttcagggagggtcagaatcttgtagcctccagctgcatgactcctaagccataatttctaatcttgtggctaatttgttagtcctacaaaggcagtctagtacccaggcaagaggaaggtttgttttgggaaggggctgttatcatctttgttttaaactataaactaagttcctcccaaagttagttcagcctacacccaggaaggaacaaggacaggttaaaggttagaacgaagatgaagttagatctttttcactgtctccgtcataattttgcaaaggcagtttcagctatgtatacggcaacagtctccgaactagtcccgccattgcttctactataaccctcaaccctaacccatccctgctccagtctttattccaaccagcagccagaatgatccttttgaaaggtaaacacggccgggcgcagtggcttatgcctgtaatcccaacactttgggaggccaaggcacgtggatcacgaggtcaagagtacaagaccatcctggccaacatagtgaaaccatgtctccactaaaaatacaaaaattagctgggcgtggtggcgtgcgcctgtagtccagctactcgggaggctgaggcaggagaattgcttgaacctgggaggccgaggttgcagtgagccgagatcacgccactgcactccagcctggtgacagagtgagactccgtctcaaaacaataaataaaataaaatgtaaacatgattggcgcggtggctgaaggcttttttttgaaactccagcttaaaaaaaaaaaagtaagcatgaccatgtccctcacctgctcaaaagctttcaactgtttccccattacatttagaataagatgtagagttgttgtcaccatcaacaaggctggaagtgaactgccccctgaatacttgtccagcctcatctctcaccattttccctctcagctgtcaccattggagggtgtccaggttcttggcatcttgaacaaagaattggacacaacacacaaagcaagaaggaatgaaggaatttattgaaaatgaaagtatgggctgggcgcggtggttcacgcctgtaatcccagcactttgggaggccgaggcgcgcggatcacgaggtcaggagttcgagaccagcctggccaacatggtgaaaccccgtctccactaaaaatacaaaaagtggctgggcatggtggtgcacacctgtaatcctagctactcaggaggctgaggcaggagaattgcttgaacctgggaggtggaggttgcagtgagccgagtttgagccagtgtactccagcccgggccacagagcaagactccatctcaccaattcactccgcagtgtgggagggggcccaagcataggagctcaagggcccctgttacagaatttttgggagtttaaataccctctacttgggacacgccctatgtaaatgaaaaggatgaagtaaagttacaaagtcatttacttggcctacaccctatggagaggatatttcctgtcatagctgaagtgtgaatcagccttttgttccccgactccagactctgttttcctgccttaaagcatgctttcatctcagggcattttctcctgctcttcctccaggtatctttatggcttgcttcctcggttccctcatgtctgtgctccagtgtcaagccctctaaaagacctgcccagactactcttgaaaatagtagggccgggcgcagtggctcgttcctgtaatcccagcactttgggaggcctaggtgcgcggatcacttgaggtcaggtgttcaagaccagcctggctaacatggcgaaaccctgtctctactaaaaatacaaaaattggccaggcatggtggtatgtgcctgtaattccagctactggggaggctgaagcatgagtattgcttcaacccaagaggctgaggttgcagcgaggtgagatcatgccactgcactccagcctgggtgacagagtgagaccctgtctcaaaaaaaaaaaaataaataaataaaagaaaagaaaataatggacccccaccaactctgtattctcctttctcttttttcacagctcttgtcagtgtctgagtgttatattatatacgtgtgtgtttgctgcttgtcttttttccctacagcataaggtcttttaagggtgggcactttgttttgttctctactattttcttatcactggcaacagtgcctgacacatagtaatagcatggtaaatatttatcgaatgaactaataagttaagtgaaaaaaaagcggcgggtggatcacctgaggtcaggagttcaagacgagcctggccaacatggtgaaaccctgtctctactataaatacaaaaaaaaattagccaggcatggtggtgggcacctgtaatcctagctactcaggaggctgaggcaggagaatcgcttgaactcaggaggcggacgttgcagtgagccaagattgtgccactgcactccagcctgggcgacagagcgagactctgtctcaaaaaaaaaaaaaaaaaaaaaagtgccataatgctggcatatgcatattcctgtaggaactctgaaaggagatctgggagatgggggtgggggaagggtgggaaggacacttcattttcaccgtgtgctcctttatgcagtatgttataaccaagtacatgtgttatcttttcaacaacatatggggggaaataacctaggtttttttactcgcgtccgtgtgaagagaccaccaaacaggctttgtgtgagcaacagggctgtttatttcacctgggtgcaggcgggctgagtccgaaaagagagtcagcgaagggagataggggtggggccgttttataggatttgggtaggtaaaggaaagttacagtcaaagagggttgttctctgatggtcaggggcgggggtcacaaggtgctcagtgggggagcttttgagccaggatgagccaggagaaggaatttcacaaggtaatgtcatcagttaaggcaggaacagggcattttcacttctttcgtggtggaatgtcatcagttaaggcaggaacaggccatctggatgtgtatgtgaaggtcacggggttatgatggcttagcttgggctcagaggcctgacaggtttgacaatggatgtgtaaagatgggaggagctgccttgggtggcagtgagccccctaccctagaagagatgttgctaaggggtttctgcctgaggcgggaaattggagtagatgatcacaaagatctgctgtcctcgctttggccaagtagaagtgacacactcaaccagttagggccagaaacactaagagatggggggatcctacatgtgggaggacaaatgcttacaggtaagaaaatgaaaaactgttcagctgacagctagacctaatgtttctaactgaacaaaaacagtgatcacagaatataaacaaagatcagacaagaccaccatgtagttggatcaagatacagacaaagccactctggtaccgcagataggactcaacatcttccaattctgactaataaatgagtggattttgcttctttttttgtaaccgagcgaattatagagaaacgccacactctgagacgaattcaggagtcctttattagccggcaactgagagatggctagtgcttaaaattctctcggccccgaagaaggggctagattttcttttatactttggtttagaaaggggagggggagcctagctgaggcaatcttacagaagtaaaacaggcaaaaaagttaaaaagacaaatggttacaggaaaacaaatagttccaggtgcaggggctttaaatccatcacaaggtgatagatgtgggggctttgggtaccatcaaccggacaaaaatgcaggggcttagggtactatcaaccgggtgaattcctggaaactgcagctatcgcttgccacagtatcttatcagttaattgcattctttgatgtgctgggagtcagcttgcacaagttaaatccttgaggaagtgggatgggtaaggagcggcaagtgaaggagccaaaatggagtttgtctgtctccctcagctaagagagagtcaattcaggttaagacaaggtagggtatcacacttttccaaggactaatctagccttgttttaatccttcttccttctggataaaaatttgtaagatacctaatcactgaattgcctctactccttgactgtgtccaatccaaaactgttctcctcctccttaaactctccttagatttagttacccagcataaacccaaatcctaaaataagttctccccagtcacctcttaccaagacaccttatattttctctgatatgtgttctccctttctgaacaagctaaataaacctaattctttttgactacaggtatgtttctggtagaattcgatctgtaaaatttatcacagtcagctctcttaagtccagaccagcaatactcagacaggaagaagcaagaatgttaaggactacctggaaagttcagtggtcctgaagcaacttgacttgagctggtatttgtgtatgtgtggtgaggagagggatctgggaaaagagaggtaggaattattaaatgtgagtagttctctttcttctttcatcagcccttttcatggccttgggcaaactttgagcctcattccatttctgtaaaagatgaatttggaatacattttcaaggaatccaggaaataacatccccaaatatgccacactggtatgatgattgcttggggaacagcacatggagagaggggcttttcatgaatttcccttatcagactaaaggctgacaatccagaaggaattcaattatgaatccccttccagagagttttatctatcagggaagattaacacaccacaggagaagatattgaagtgtgacaccttgttgtccggacatcatcattgtttgccacattccacctaaactattatatgtgtaagtaaaaaatgttttcattttcttctttaagtgaactctcaaatttgacatgtattttgaaaggaatatttacatcactgcttaaatgggaaatcagcattgctcggaagaaatgaaaaggttattgctaacacacacctcaaaacaaaacaatattttaaaactgcaggcatggttgcctgtttgagagatctggaaaatgaaggctttactctgttagaaagggagataaatactagaaaaatgttaaataccatactggcctcaaacaactagcctgttggtttgaaatgggacgttctcactctgctgtttaatatcgcttaatgtccttcatgcacccttagagccattcatttttcccaaatggggtgcatcccacattttaggatacgatttccatcgtttctaggttaatttggactcatcctttagttcgcagattaaaaaataaatccttcagagaagccttccaagactactgcccagctaaattactttccccttacaataggaggcactaaatacacctttattgaaagcctattcccccatactacttcatcgtattcattacattggggcacggtgcatttatgttgtcagatctcctattaactagagaataaattctgagcgtactgtgcctctctgtacacttctgtaacttccagatctttgcacaatgaatacaaatgatgtaaggaatgacaccttcacagttcctgcaaccccaggatggtttagccccaccttccccctcagccaatgacaggcgcccccctctgccgctccggtcgcggacggtgggcggggccacgccgtgacgcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggtgagttcggggtcccgagtcctcgccggacctgcggtttgcggggaaaggcctcgagaccagagctgcacgggccttggctccagaggctctcgggatgtcagcaggccctgggctacagagggtctccggggccccagacgcaaatccgcgataccctcaggtccagcttaggcggctcgccctccgggttcctcggggaacggaagaggctaggccgccattgtttacaattcggatggctccgccctgcgaggcttcctgactaggttcctctggagctggagagggaccaaggaatgacagctcccagcgaggggctccggttcctcccgaagcacctcttaaggtgccatcatttagttctaggtggctcaagtaatatttttatcccctagcacgggatttgccaaaactacagagtgtgtggcaaagctggggttttagcggaggcttgtctgcagttcaggtgcaagggaaagaagcccttgtggattgttattcaaaattggaaaccagggcctgaatattttgggactgctgtaagtcatttatccgaggataatcaccccagcattcctctcttcgagaacgattgtgacagtgaagtgaaggtttaatcaccttgtaaactgtaaacattttaaagagaaaattatagggcctataaaagaatatgctgagttccctcatttacccacttcagaggagcgtgattccttgattcctcattctccagctgatttaattgaccaagtgtgtagaaaaagcacactcagtttctcctgctgtactcacaacacacttttgacacctgatgtgtggtgtgtggggattttcccccaaacatcaggcaaacagtcagctctgcaggggatgccaacttggtgccctacaagtcaattccgaagctctctacttggagatagcatcaaatcacacaagtggagggctcagtctcacaagactgtgcccactttctgtgccaatggcaagcctcaggttgttttacctgtgcttctgaccggccacctataaatcaaagttcccgtgacctccctccttggctttgattaatttggtcacaaaactcaaggaaacatgtttactggtttattataaaagtattttattttgtgtatttatgtatttttaattttagattcagagggtacatatgcagttttgttacatgggtatattgccttatcgtgaggtttgggtttctaatgattccgttgcccaaacagtgaacacagtatccaacaggtagtttttcaacccctatccccccaccgtccttccccactcttggactctccagtgtttattgttgccatcttcgtgtctgtgttcccagtgtttagctcccacttgtaagcgagaatatgctgtatttggttttctgtttctgtattaattcacttgggatagtggcctccagctgcatctttgttgctgcaaaggacatgattttcttctttttttatggctactattaatatatttttaaagatacagatgaagtgatatgtaagacaaggtgtagagggaacgggtctggagcttccatgctctgtctggggcagtggcgccatctcggctctcttcaacctccaagggattctcatgtttcagcctcccggagtagctgggattatagtgtatgccaccacgcccagctaatttttgtattttcaataaagacgggatttcgccatgttggccaggctggtctcgaactcctggggtgtgagccaccatgcccagccaaaagttcttctgaactttgtccttctgagcttttatgcaggcttcattatgtagtcagcattcattaaatcattggcttttggttactgacctaaccttcagcccctccttggagggtcaggggtgagactgaaaagtcccaacctcctactatgaccctcacccatcatgaagccacctaggggctgccagtcaccagtcatctcattagcatacaaaaagacgctggttattccaaggattttagaaattgtatgccaggaaatgggaaccaaacatacatatatttgacagtattacaccaaggattctgtttcagctctttctactatttttcttttttttttttggagggggacagagttttgctctgtcacccaggctggagtgcagtggctcagtcatagctcactgcagccttgaactcctggattcaagtgatcctcccacctcagccttcccagtacaggtgtgtgacaccatgcctggcttcattccactatttcttaggaacagaatgtattttaaggttgttggtcctaaatcaaaagagtgttccatttttaagggctttcttgagagcagtggttttctaattattctgaccttgacctaaagaaagattgtacatagttgatctgtgatctgatgcacccatatagagacaaagttttatgaaataatcgtttactgtacaatttttcttttatcttctatcacattagaaaatcctggtgagttgaaggccaggcatggtggctcacgccaggatggtctcaatctcctgacctcgtgatccgccggcctcccagagtgcttggattacaggtgtgagccaccgcgtcttgcccggcttttactcttaagttatatgggaatctattacagagtttgaaaaaaggagtgatgtgatctgggcctgtgttttaacgaggtggtttctggttgctgtgtggagaatagatggtagaaaagtaaaggtaaagcagtgtaggctgggaagaatcttcctccagccttttgggttctgtttctgggggcttgtgaattaaactgacaaaacagattatttagagtttatgcatgcaagacatgtacacacaggagtgctcagtaatagtaactcaaagggggcggttagaacttgaggctttttttttttttttcgtttttgagaaaacaagttccactcttgttgcccaggctggagtgcaatggtgggatcttggctcactgcaatctccacctcccaggttcaagcgattctcctgcctcagcctcccaagtagctgggattacaggcatgtgccaccacgcctggctaattttgtatttttagtagagatggggtttctccatgttggtcaggccggtcttgaactcccgacctcaggtgatctgcccacctcagcttcccaaagtgctgggattacaggtgtgagccactgcacccagccaaggctttctaatttagtaggaaaaaggaagctgggagaaaggcttctatgagaagaacaaataggtttctttaggaaagacaagtttttttaggagaataaataggaaatacgtttgtggtagtacttgtttatgcaggtatggtgggtctttccagcttcttcatgatcttaaaactgccctggagagggactttatggcagcctcgtttcccagaagttgctgcttttagtcagataagagaagctcccagaaggcttttttttttcctctgcatctgttgaagctcagatgcttcagcttaaaagcttaaaataatctttataacaattcagggcttctttttttttttttttttttttgaggctaattttgcatttttagtagagacaggatttcactgtgttggcctggcgggtcttgaactcctgacctcaggtgatctgcctgccttggcttcccaaagtgctgggattacaggcgtgagccactgtgccggccaactcagagcttctgaatgggtcgctacagctgtgagatgggaacttttgcgcttaatccagatgagagatgatagttgtggcttggacaaaggtgatagctaaggatactgtgaaaatggtcagattctggatatattttaagggtagagctgatgtactgacagattggatgaggattttgggaaaagggaaggcattcgggatgactccaggttttgggcccaagcaacaggaagaatggagttgtcatttactgaaatagaaaaatgacataacatatagtaggacagatttgtcccacagatatttactgagtacctgctctgtaaagatacaaaagatataacgttgtaaagatagtctccccttcgagatatttacattcttaagacaactataggtaagtaagtttattagtttgccagggctttataacaaagtaccacagaccgagtggcttaaacccagtgatttcttatctctgaattctagaggctggaagtctgggatgaaggtgtcagcagggttggttccttctaagggtggtgagagagaatctgtatcatgcctctcccctggctttttttttttttggtttgctggcagtctttgatgttccttggcttgtagatctctgccttcacatggcatgtggaattctccctgtgttgtaagcctttgtccaagtttcccctttttataaggacacagttatattgaattagctgctcactctactccatataacctcatcttaacttactacatctgcagtgaccaagtaaggatacattttgaggaattgggcattaggacttcaacataagaatttgtggaggacatgcctctgcagtgtttggcctatactgtagttaagaattggagactgagactggctggtcaatttcccattgctattgcaattacaaataataatggctaccacgatatattgagcctgataaatatgtcaggcattatactaggttctttatattcctgacatcatctcattctttgctcaatcaccctgttcgagtaggtggtattatgctcatttttacagatgagaaaactgaacttttttagaatgttagcaccctgctgcaaaccacacaaaattatcataaagtgcacacaagataccatctataaaaaaatgaagattattcctgggaccatattttaagaccagagttatccattgtttacttctgctaattctgaattagcttgtccttgtaatatgacttgataatgtcaccccctcagagcaatttcaagcagtttcctaatcaagcataatgactcaaattatatcctctcttagctgggcatggtggtgcttgcttgtactcaggaggctgaggccagaggatcgcttgagcccaggagtttgatgctgcagtgagctgtgatcacacaactgtactccagcttgggcaacagagtgacgccttgtctttttaaaacaaaacaaaacaaaggccgggtgcattggctcatgcatgtaatcccagccctttgggaggcggaggcgggcagatcacttgaggtcaggaattcgagaccagcctggccaacatggtgaaaccctgtctttacacaaaaattagctgagcatggtggcacgtgtctgtaatccctgtaatcccagctacttgggaggctgaggtagaattgcttgatcccaggagggtgaggttgcagtgagccgagatggcgttactgcactccagcctgggagacagagtgagaacctgtctcaaaaaaaaagaaagaaaagaaaaaaagaaataaaattatatcttctttcatgtagtgtggtcactaacagattttagcagactaaagatctaggttactctttttttttgagacggagtctcagtctgtcgcccaggctggagtgcagtggcacaatcttggctcactgcaaccttggccacccgggttcaagcagttctcctgcctcagcctcctgagtagctgggattacaggtgcctgccactgcacccggctaatttttgtatttttagtagagatggggtttcaccatcttggccaggctggtcttgaactcctgaccttgtggtccacctgccttggcctcccaaagtgctgggattacaggcgtgagccaccacgcctggccctaggttactctttaaaaaaaaggaggtaaagttgacataaaattaaccatttcaaaatgtttagtgggccgggtgcagtatctcacgcctgtaatccagcactttcggtggccagtgtgggtggattgcctgagctcaggaattcaagaccagcctgggcaacatgacaaaaccctgtctctactaaaaaatacaaaaaaaaatcagctgggggtggcattgcacacctgtagtcccagctacttgggaggctaaagcacaagaattgcttgaactcaggaggtggaggttgccgtgagccgagattgtgccactgcactccagcctgggcaacagagtgagactgtctcaaaaaaaaaaaaataaaaaagcgtatagtggcatttagtacattcacaatgttttgctgccatcacatctgtctagttcgtcgccctaaagggaaatcctttacccattaaaccatcactcccatttcccttcccttcaacccctaatcttctgtctctagattcacttattctggatattttattatataaatgcactaatacagtatgtgacctttcatgtctggctttttaaataactttgcatgatgttttcagggttcacctgtgttctatcatgtatctatctattatgtctgaataagccattgtatagatagaccaagtctcactctgttgcccaggctggagtgcagtggcatgatttcagctcaatgcaacctccacctcctgggttcaagcaattctcctgcctcagcctcctgagtagttggggccacaggcatgagccaccacgcccggataatttttgtatttttagtagagatgggatttcatcatgttggccaggctggtcttgaactcctgacctcaggtgacctgcccacctcagcctcccaaagtgctgggattacaggtgtgagctgccgcacccagccagatataccatatttttacttaggccatatttacttatcaattaatggacagtgggttgtttccacattttggtgattgtaaatagtggtgctgtgaatattcgtgtacaagcttttgttttaatagcagtttcaaacaaaacagctattggggtcgggtatatactttctgggtcatatggtcattctgtatttaactttctgaggaacctggttcctcttgaattgagctaaatggcccttgctgttattatttgtcagagggtttccatgtagtgttgctttatttttttattttattttatttttttgagatggagtctcgctctgtagcccaggctggagtgcagtggcgcaatctcagctcagtgtgagctccgcctcctgggttcatgccattctcctgcctcagcctcctgagtagctgggactacaggcgtccgccaccacacccggctaattttttctgtatttttagtagagacagggtttcaccgtgttagccaggatggtctcgatctcctgaccttgtgatccacccgcctcggcctcccaaagtgctgggattacaggcgtgagccaccacgcccggcatgttgctttatgttgtaatatcagctttggtaacttggattcgcagtaagcagcaagtggagttaggtttatatttttctcatattttaaaacaaatgatgctctcagaatataattaacatttattgaactgttaatgcattttaggtagtgttgagtgctcatttaatacagcagagtctgagggaggaaaattccattattgagctcattttacaaatggtcaaatggggttagagtacgtaacttgctggggtaaaaagcggcagaaataatatttactccagagcccgtacttttaaccacttcctcccagccatgattctctgagttaaaactataaagcctgatttgcctcgctttctcttctgcgacatctgtgtcataaaggagtatactgaaggcggtctcaggtgaccatggtgtgctcattccaggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaaggtaagaagtaacagtgcccttaaggtattggttatttttatttttatattctgcaaaattctagttttatttcgtcgttgttaatcaagttggttgtaatttggagattttttacttatatgggggtgtggtcaaaacacagaaatatgaggacattagtccttttccagaaatacagaatgaacatctgggctccagtcgaacaactgagagaaaacattaaaagggtggctccaaaacattttctttccttatgtgttaaaggtcgaagcatctaaactggactagttcttcacctttggaaggactcagtcgtagctggaaaatctcacaggaaagtggcacacagcctcttcatcctaaaagggcaaagaagagagaccatatttttttgaaactaagactcactctgttgcccaggctggagtgcagtgacatgatcttggctcactgcaacctccgcctccctggttcaagcaattctcctgcctcagcctcccgagtagctgggattataagcatgcaccaccatgcccgggtaattttttgtatttttagtagagatagggttttcaccatgctggccagggtggtctcgaactcctgacctcgtgatccacccacctcggtcccccaaaatactgggattacagatgtgagccaccgtgcccagccgagagagcatttttatttttaaaatgcatgttatttatactgtttggtaacaagattgtaaatgaattggaagacaaagagaaaaattccatagtcagtcttgcagttgttgaagtagttaattttctaaatccaggctttcctgcagtgggttagagtctctgtctaaatgtagatattctcgtaacattgaaattgcttttttccagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggtatgttagatttatgattaactggttacattatggtgtggctcttccttcccttcagcagttaatatagccattctgatgaaatcaatggaatatgtaaatgagtggctcagatgcatttctgatctattatgcatgtgaaattgttttaatgtcattttcagttagattgctgtaacatggaggggatagggggtcttgtctttttattttcttctattaaattcctttgcttcatgttcttagatttttattgaacacctgttaaatagttgaagcactatgctagatactacgtacacacacacttttttctttctgttgtttaaagataaacatgtacctgataaatttaaacagtgtacaaaagtcagtgaatatatatgtgctactgatttacatattctattgcttctgactcctgaccaccttttacctatgtttctaattctctcctttttttttttttttttttgttttgtttttggagatggagtttcactcttgtcacccaggctggagtgtaatggcgtgatctcggctcactgcaacctccccctcccgggttcaagtgattctcctgcctcagcctccctagtagctggcattataggcacctgccaccatgcctggctaatttttgtatttttagtagagatggggtttcaccgtgttggccaggctggtctagaactcgtgacctcaggtggtccgcccgcctttgcctcctgaagtgctgggcttacaggcgtgagccactgtgcccagccgtatttctaattctcaaagactgaatggcgttttataaacttgatgtgtattataatcccctttttacagatgtagtaactgaactgcagagaggttaataaattgtctgagacctgttaaccagttggaggttggagctaagattgaaacttagatctgtccagctccaaagcctggttctttccactctgccatacaaggcagtcattaaagatcatgaactgaaaatcaggtgccagtgatgagctgtgtcattgtgggcaaggtatctgtgccctgtgttgtaaatatttgtgattacttttcatccagaccttaacagttaatggctgtgtgtgtacctaacactgttattttagaactcccagaatgctagaaaaatgcctacctttaagtgctaaaagtagggagactctaaattttcagttttctctggtaataaatgtgagtgatttatcttctaggctaatgttgtcctttaattgtgtgaaatattaaatgaattagcctattaaatgaatagtcaaatgaagaaaatagtccagacaatcatgttgggaaaaaagctattaagttattatttttgcatttcagaaatgaatttttctcagtataagggtgaaacttagcatttcataaatgcatttttatattttaataggttttggttcttcaaaattgctgcccttattggaatcatggttggctctttctacatccctgggggctatttcagctcaggtagggttcaccattgagggggttaattttaaactatataaactctatagatgattgagttaaagctacattttaggccgggtgcagtggctcacacctgtaagctcagcactttgggaggccaagacgggcggatcacctgaggtcaggagtttgagaccaacctggccaatatggtgaagccctgtctctactaaaaatacaaaaattagccaggcgtggtggtgcacgcctgtgattccaggtactcagaaggctgaggcagcaaaattgcctgaacctgggaggcagaggttgcagtgtgccaagatcgtgccactgcactccagcctgggcgacagatcaagactctgtctcaaaaaacaaaacaaaacaaaactaccttttaattactgtttttgtagaactgacaagtaaatgagatggtatccgattaatatgacttagtacctgcaactcactatatatatatatatattttagacagtctcactctgtctcccaggctggagtgccgtggcacgatctcagctcactgcaacctccacctcctgggttcaagcagttctctgcgtcagtctcccgagtagctgggattacaggcgcccaccaccacgcccagctaatttttgtattttaggcagagacggggtttcaccatcttggccaggctggtcttgaactcttgacctcatgatccacctgcctcagcctcctgaagtgctgggattacaggtgtgagccaccacgcccggctgcaactcattattaatatgtggatttaggtcaggaggcattcactgcacctctcagattttctggaaccatatgttaatcttttggcaatatcttaatagtttgtgttctcacttgatggaatacaaagctaatcagagagcctgtcaaaataaggacttacaactcttgtgctcccctatctctgtcttaacctacttcctaagcatggcatcaggtgacatctttagatttctactgtgatttaaaagaaaagacttatagtatcatttggaactcaggtcccaggcttcccttggcacaagctaaaacatattttaaaaggtctgaaacccagtagaaagcttttaagaatgccgttgagtttggaatcttgctgtactgctggagacagaatgtctttaccacctctgtcttgttttaattgaaatccgttcagaatgttggatcttctgaaatgttactctatggtagagaataactttgttctcttggttcttgtagtctggtttgttgttggcatgataggggccgccctcttcatcctcattcagctggtgctgctggtagattttgctcattcttggaatgaatcatgggtaaatcgaatggaagaaggaaacccaaggttgtggtatgctggtaggtatctctactcacctatgttagccatactgctacattaagcacggtgtacaataaaaatcatcattatagtcccagcagctatagtcctcagggacagaagtccaaggtgggagaatggcttgaatccaggagttcaagaccagtctaggcagcatattgagactccatctttacattagaaaaaaaaaatttgccaggcatggtggcatatacctatagtcctagctactcagcacgctaaggcaggagaatctctggaatccaggagttcaaggctgcagtaagctatcatcatgccactgtactgcagcctgggtgacagagcaagaccctgtctctaaaaataataataacattaaataaaaggaaaaaaatccacaatttccagaatttggctctgaattatatgcatcactggaagaaagtagcacagataatataaattgttcgattttcccaatttatgtattttgagagtcataatttaattacatgtgtttagataaggaaaaacagttatatttagtgacttagttctggttttgataaccttgtttccatggagaggaaactcagatgggttcaacatatgggacagctgcccacctactttaggcagataggagtgagtagtccttatggccttattcagagaggggccccatacctgctatgaaaaactttctggtgggaaaggggcacttacaatttctagagtgataatgggatttaacagtagcttgcgaatatattttggctatgttagagcacttactacttcataatatacatttgcacacatttctgattatttccttaggacagattcccagaaatagaagagtcaaagtgtatgaatattttaaaatgctttcagtacatactattgaattgcgcagttttattttcatttgatttagttttttaaaatatttacatgtttttaaaaatactatgtttaccataaagacaaatgatagaactttataaagactaaaacatgcaaatctccacctatctgcaacccattttcctttccagatgtagccactcttgtgaacctttatgtatttatgcattcaccttgcttttgtatttaaatgtaaacaggattgtactgtatgttgttccatgacttgctcttttcacttcctacatgatgaatatccttccttaccagtgagtgtaggtatgtcttactcatttaacctgcattcaagctcctggcatggagtttactgtaagctgcatggtattccattccatacaattccatggcattccatagcggagtataccataatttatttaacctttaccctagtgttggtcatttaaattgtttgtaatgacaattttatttttatctattttttttctttttttttgagattgggtctcactctctcacccaggctggagtacagtggcacaatcatggctcactgcaacctctgccttcctggctcaagctatccacctcagcctcccaagtagctgggactacaggtgcacaccaccacacccacactaccacgcctacaccaccacgaccggctaatttttgtgttttttgtagagacagggttttgccatgttgccggaactcctggactcaatcgatccacctgccttgccctcccaaagtgttaggattgcaggcgtgagccaccacacccggctgttattttctttaattcattttggatcatacaactctagaagaatttattgagttgcaaattggtcatactttacagtaactaagtgtagaaaaatcttgtatattcagaggtgaaaacattaagtgtgctagtaacttaatgtacatcatttaattttagacatgcaaaattcattgagataagtagaaactagttttcttaatctgggctttgacttgaatacaagttagctgagctcatcattcttgcagttggtctgagtgtactgtatgtgctgtttcatgttttctaattttcagagctacacagctaattgttttgtttgttgtttgagatggggttttgttctgttgtccaggctggagtgcagtggcaccatctcggctcactgcaacctctatgtcttgggctcaagcaatccccctgcctcagcttcccaagtagctggggctacagccttatgccaccatgcctggctgatttttgtattttttgtagagacagggtttggccatgttgcctgggctggtctggaactcaggctcaagcaatccagccaccttggcctcccaaagtgctgggattacaggcatgagccaccatgttcagccaacacagctaattgttgatttttagtgtgaatggaaaagaccattactttagatattaaaaaatagcaaatgagccacttttccagttcagggacagtcttattgtttgtgatgggaaatggatttagatagccaatggctgcagaggaaaaaactgtcataaaaagataccagtgtgtgtattctgttttcctctaacaccatcctggcatggagcttgctgtgaactgggtcattttgagggtaaaggaatcatttaggttcctaagaaaagctcacaatacacattaattaacatataggtagcagtaaactctagctggaatgatcaaatgtctggtaatcaacccatgaaatcaaatcaggtaattcaggaagtgaattcagttgcttggtggattttggaatttaacatcaagccaattgaatacaatcttgatactttaaccttgagacctctgtaattttactgtaaattaccccagaaaagtgacataatgtctcctcatttttatatggagtggaagaaaattggccttcattattagtttattatagttgtggtcattcatattggtttccctttctccagctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggtatgattgtttactacttctttctcctgtgaaaggtttttaattctaagcttaaaatctaggtaccctttcttatgaatttatgtctaagtttatccacttgaacatttttccatattataaagtcttcataattctatttcatgcctatatcataattaaatgaatttcactatcattaaaaaaaaacccaggtaacttgaaaatttatagtgcttttttttttttttttttttttttttgagatggagtctcgctctgtcaaccaggctggagtgcagtggcacaatctcggctcactgcaacctctgcctcctgggttcaagcagttctctgcctcagcctcccgagtagctgggatcacaggcagccaccaccgggcctggccagtttttgtatttttggtagagatagggtttcaccatcttggccaggctgaactcttgacctcgtgatccacccgcctcggcctcccaaggtgctgggattacaggcgtgagccaccacgcctggccgggaatgagtctttttttttttttttttttgagacaaagtctcactcttgtcccctaggctggagtgcgatggtgcaatctcagctcactacaacctccacctcctgggttccagtgattctccagccttggccaggcgcctgccaccatgcccggctaatttttgtatttttagttgagacggggtttcaccatgttggcaaggctggtctcgaactcctgacctcaggtgatccacccatctcagcctcccaaagtgctggttttacagttgtgagccaccgcatgtggctgggaatgattcttatgagtcattagccaagatattttaggggaattaaactgaaaaataattgattttaatatttcaaaacaaaactcatgctcttgagttctaaataccatagtttaggctgggtgtggtggcttaacgcctgtaatcccagcactttgggaggccaaggcgggtggatcacttgaggtcaggagttcaagaccagcctgaccaacatggtgaaacgtcatctctactaaaaatacaaaattagctaggcgtgggggcgcacacctgtaatcccagctacttggcaggctgaggggcaggagaatagcctgaaccctggaggcggaggtagcagtgagctgagattgcgccattgcactccagcctgggcaataagagcgaaactccagcttggcgtgatggctcatgcctgtaatcccagcactttgggaggccaaggcgggcagatcacctgaggtcaggagttcaagaccagcttggccaacatgacgaaaccccatctctactaaaagtacaaaaattagccgggtgtggtggcgggcacctgtaatcccagctactcaggaggctgaggcaaggagaaatttgaacccaggaggaggttgcagtgagctgagatcgcaccactgcactccagccggggtgacaaaagcgagactccgtctcagaaaaaaaagaaaaaaaaaccgtttaaaaaaattcatggagttatagatatgaaatatgaaaattctatctagacatcacctttccttttaaaagtgagaaaacagaagtctcaaagaagtgataggcctctcccagctactaattagttgcagagctgatcttagatcttttcactacaccaagggagtggaaaatcaaagtccttgtgtgatgcacaggaatttctaggattgtgaaatgcgttgagaaccagtagtacttgcttggtctttctgggttcttttgcgagctaactgaacagaaggttacttgtcacctttcaactctcaagaagaatccgaaagttctcagttactgatagttgaattaactccagagaagtgcactgcattttggaaagtcagcccttggcagtccctgtgccactgttttccttttgattccataggaacaccagcctcgctccggcctcttgcagtcctccctcatcaccctctacactatgtacctcacctggtcagccatgtccaatgaacctggtaagggaatgtcaataacacattcatttgataaaaagaaagtaggaaatcagcctttacatagttggtacaaaaactagagctagagcaaatgtgaaacaagcaaacaaaacttaaacgtacagtgttcactgtaggtttgtaggtatttacctttcacattttagtccccacatctattgatagctatttataactgacagtctaaagggtcagagtcctttagatggtctaggctttacctaacctaggctgagtcaaactagttaagagctgtggtcaagggctttggccctttgttgtgactgaattttagtttgatgtcacaggctgtagaagaaacagctgtaggaaatctccttttgtagttattataggattgtttctcagtaggatattctatgggcttcttttaaaggaaaacaatgcagaccccccttccaccaatgataacttatattttgttcttaagtaactatgtaaaaaccaaaatagagataaacttctgtgcttaaaaccttgacacttaaagaattaaaaagatttgtcaaactacaaaaccaataaaatcaataatgatgtttatgaaatttgacagattctgttgttgttttctttttttttcctaattctgtcattgattgtgaccaaatgtgttactactgactgctaagtttcagattttttaagtaaagcattcccatgtttcacatcatgactgaatgatatgtagggaactcctcaagttctttcttggaacaagatgagctgtaaccaaggataatacaaattttctcattttcagatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctaggtaagttaaaaggtacttagaacaagattttcatggaggttgataataaagtgaagaagctgttttgctttcaaaaagcagcatgagaaatttaaaaacttcactctctttaatgaaaagttctttacttgcttcagttacagagctgtgtacatatatatttttttgagacagtgtcttgctctgtcacctaggctggagtgcagtggcaggatctcagctcactgcaatctccacctcctgggttcaagcagttcttctgcctcaggctcccaagtagctgagattacaggcacctgccactatgcctggctaatttttgtatttttagtagagacagtgtttcaccatgttggctaggctggtctcgaactcctgacctcaggtgatcctcctttctcagcctcccaaagtgctgggattacaggtgtgagccaccatgcccagcctgtagtaagttttgaaattaggaagtatgagtcctccaaatttgttctttttcaaaattgttttggcagttatgggtcctttgcattcccatgtgaatttcaggatcagcttgtcaatttctgcaaaaaaatatgtagctgggatttttatagggattgagttgaatctgtatagaccaaattggggagtattgtcatctcagcaatattaaggcttccagtctgtgaccatgaagataccttactgaagtcttctttacttaaaccatttatttaggtctttaatttctttcagtggtttatagttagttattagtatacaaatcttaaacttattttgtttttaagtgttttattctaaatacaattctaagtattttattcttttcgatggtattataaatgaatgtatgttttcttagcttaacttttgggttgtttattgctagtgtatagagatatgattggtgacgaggcatggtggctcatgcctgtatttcccacacgttaggaggctgaggtgggaggatcgcttgcatccaggagtttgagaccagtcagagcaagatagtaagagcccgtctctataaaaattagccaggtgtggtggtgcaatctgtagtcccagctacttggggaggtgggaggaccaattgagcccaggaggtcaagtctgcagtgagctgtgattgtactactacagtccacctgggtgacagagtgagacctcatctcaaaaagaaatacaattgatttttgtgtttttttttttttttttttgaagagaagaagtgttgctctgtcatccaggctggaatgcagtggtgtgatcatagctcactacagcctcaagctcctggtctcaagtgatcctcccacctcagcctcctgagtagctgaaactacaggcacacaccatcatgcccagctaatttttaatctttttaggaacagtcttgctgtgttgcactggccagtcttgagctcctgtcctctggcgatcctcccacctcagcctctcaagtagttgggattataggcgtgagccaccacacccagtcctgatttctatatattgatcttgtatcctgcaactttggtgaacttatttattggttctaatagtttgcatgtgtatgtattccataggatttcctataaacaagatgaagtcatctacagatagagatagttttacttcttttctagtctggataccatttatctcttctatttgctctggctagaattttactacattgttggatagaaatggtgagagtaggatccttgtcttgttcctgatctcagggggaaagtttttagtctttcactgttaagtatgatgttagctctgggttttttgttccttttgtcagcctgaggaagttctactttgactgtttttatcatggaaaggtattggatttgtgagatgttttttctgtgtctgttgaaacgagcatgtaatttttgtcctgtttttgtatttacatttttattcagtcatttaacaaacttttagtgaacatctgtagtgctagaattacatagactaaggtcactgttaaggcattctttgaatagcaaggaagataggagtgatatgtgcagtggcagaaggaagcctaggaagctgtgggaagtcggaggagtgtcttgtaacctagccagtgaggggtgatgtcagggaaggccttccagaggacatgacagcaagtcagagaagtgaaggatgagtaagttagttggaaggaggttggcacgtggtaccttccaatcatagaagcggcacttgtgaagtcacggaaacagacacagagagcatagtgtgttttatgaaactcctaagcaattaagccatcacatcaagtagtaactgatgacagtgacgtcagtcttatgatgacaggcagcagttcagaactttaagcaggatcttcagaaagctttcagtctccaaagtaggaacagctcagcagtaagtgtcttgtatacaggccagtggcagcagttcattgtcatggcccctttctgatttgtcttccttgggatcactttccagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacaggtaggagacacagacaaaacagacagaagaccataaaacccttggatggcctataaaatctcatccattgtcctgacctcagaacccttgctcttacccatataatgaagttgggttaaatactcttgactttatcccctctagcatttaaaacccattggaattctttgcaatgcaaatcattgggagctcttacagagttgagttaattgagagagaaaatcatgacataaagcaatctgacccatctttgttcactaattttctgtgtatagagatggccatgtcagagcattctggttcccgtaataatgtactaaggaaggaaagtttcagggaggctatctcaatctagacctttgccagtaactaggaacatttaaagaactttgccctgatagggtctttcatgctggcaagaagaaaagtcatttgagaggcagagtcaatgagctgtttagttcttggtcataagaactaaaaatagcagcttcctctggtccccttcaaccctactggggggtagtgccagccaagtttcactggagaatttcttggccttggctggggggctgcaggaggctgatagaagtcaggtagaccaggcttttctacctgactctctcttgttttcttagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactgatattaatttgaagtaacaaatgctctttaaaagtcgggaggcagtgtccctgctttgcttggtcctaccttaagaagtagtgaagtctgcctcttagtaggaaaaccagtagtctaatcaagactcaagtgaattatacatgtgaatgctgaattatatacaagcatgagtaagacagcattctgaataaggccaggatcatcatttaaagcaggggagtattttgagtcatcagatctcagggtggcctttcattccagatgagtacctttatgtttcatcactatgaaagggcttgcctagccttggggaatgcgggttggggccctggctttcagatcagggacatgctctaggaactcatcaaaggcaatagcagtggctgccacttttacctcgttaaagccgggagaaagcttctaggtccatgctggactcctttattttctaggttggtcttgcgggttatctggttgggaagtaaaactttctcttggtaatcaaagaaactgcctgccaaagagtagccatggacctggttctcagtatagaggttttgttctttttctttttggctagccaagtgaggaatggagaaggaacaaagaaatctgtaactggttcttttttctttttttagacagagttttgctctgttgcccaggctggagtgcagtggtgccatcttggctcactgcaacctccacctcccatgttcaagcaattctcctgcctcagtctcctgagtagctgggactataggtgcgcgccaccacacctggctaatttttgtgtttttagtagagatgggatttcaccatgttggccaggctggtcccgaactcctggcctcaggtgatccacctgcctcagcctcccaaagtgttgggattacaggcgggagccactgcacctggctgtttttacacattcaggctaaagtgagtattcacataatgagttgtgcatttgatctgtgcagattgataacagatagtaggcttatgcttattaatggaagctgctgttcatctctttactcctgttgtgttggtctgtccgtcctgttacctaggcacccaactcagtgatgtcctaattactgctggatgactcaagccacaccatgcctatgttctcaggtgaagaagaataatagaaaccacatagatgggtaggtgtaccaagcattaaacagacagtatccacatgcctgtaaggtggtgattatttccctccctccttccttttacgtatcagtttgaggcttagagaagttcgtgacttgcctatggttactcagtaagaggtgaaacagagaaacccagggcttggcttaagagttcttttttcaattagacctcagtgtctcttgggccataagaatataagagacaggatttattagagacatgtaggggagtcatctggctcactaatgactcatcaccaactcaccagatctaccatgggaacctagtttttgtctactctcaggcacagagtgtttgctcctctacccatcactgacaaagacaagttagtagtcacctgaaggcaagtgactcatgtcttttactaggtcagctatccctagtggctggcacctactcaggaaaaagcatgaatattaggttaaaaacgttttccccagaagagtggtaccctaaagggtcttattacttaccctttaaatgcgataatgtgaaactttattgccattgagtgtatgggtaccaaaccagtactgtgtaaggagggggcagggggcatcaagaaaatactgactcatggaaaagggcctcataagactgctgtgagagaaaaggattttaacagttagcttcatttttctatatgtgagaaacagactgaacttaagttccacaatttcctcaggaaaggctgacctgaaggggtggttatgctgcaatataagtacttaacctgttgcatcatcaaaagtgtacctcctgtgttagagtatttctcaactgactcatcaagtcaccagatctaccatggggacctagtttttgtctactctggggcacagagtaccaaataaacaggggacatagaaacagcttagcaggcctgggaccatagttgggcaagccgtgctccagttacccctcaaggagtctgggcttacttctggaataaaatgttgttacaacttgggtttcagagaggttaacaaccactgcttgtattttcaagaagccagttaaaaagtcaatttctggttctttcttactctatgaaagagtcctgccttctctctctcttctatctggggactcgttatttgtctccagccatcaggagaaaacagtgggcttgtcatacttcctgggtttgaatcccatccttagtatttggctagttgtgtgtcactgggcaagctacattttgccaacaggaacagtaatgcagcttcattaagggtagctgaaggttaaaatacattatttatgagtgtccttaacacatgtgtgcccagcccacatgcgcacattgaggaaatcgctggctatcactggaaagactcaaggccagtccaagaagtatagctgggcctcaagaatgtaaaaatttgcatatcacctctactgctctgtgtagctagctgcattctcctctccatactgcagcagtctaattgtgtatgatcttcagaggcagccagcgcatctacagaatgcactgtcctatcacagtgcccctccctccctcacctgcagaggaggtggtctacccgggctgtgaataatgaaccttggaacctttatccaaactgtcatcatcacaaaagaaccccatgcacatttttcagagatttttattgtttcagactgagtcatgcatactaaaattattacatattttcaccactttgacttagaaaatgcactagaaaaataaactttggtcaaaacaaacactgaagtacatgaatccaccatgtatccctatactcaaagccaaactgaatttcagtttgaagcaaggaatgtgaccagtggctgaaacagtgccctaagctggtcagagaattagctcacctcccactccatcagaggctcttggtcagagaggtttcaagtatttcacttgtaacaggttcctacctgatatgccaagaagccgaggcatagctacaagaatccacagcagcagcatctcactgcctcactaaacctgctgcccagtgagatgaaaagaaaaacagccccatgaaacaggaatttcatcactatcatctccatccacaaatcacattgatccttcgcatgaagcaagctcctgttgactgtgatgtttgttactagcattttaagcaaaccatttctctaagtcaggagagcagaagaatgaatttatttatttgacacagaatattgctttgtcacccaggcgggagtgcagtggcatagtcttggcttactgcaaccgctgcctcccaggttcaagcgattctcctgcctcagcctcccaagtagttgggattacaggcacgcaccaccacacccagctaatttttgtactttttagtagagatggggtttcaccatgttggccaggctggtctcaaactcctgacctcaaatgatccgcccccccttcagcctcccaaagttctaggattacagggcatgaactactgcacctggccaagagcagaagaatttagatttacaaaattaacagatcccaatacagagaggtgttaccagaactgacatctttcctgaacagtaggcatgtttctgttcggtatagccacacctctcatggccacaggagatacagtgtatagtatatagtatataattggtttagctaacattttactccctaaattaaaggaggcttcaaaggaaaaccttaattaaatgttggcaactttaaaatggtaaaactttttaaaagtattataatcgccacagcaatactctagcttttgctacccaaatgaaaaaaattcccaggattgatctgagggtcaaatactatttaaagaaattgcccacccagggagaattctgaaaggctcaatataaaggaattcagagaaaagcctcttattgtcttatttcgggaaaaatggtgttttgtaacctgatttttcaatttttatttttgagatggagtttcactcgtcacccaggctggagtgcaatggcgcgatgtcggctcactgcaacctccgccacctgggtttaagtgattctcctgcttcagcttcccaagtagctgggattacaggcacccaccaccatgcccagccaattttttgtatttttagtagagacggggtttcaccatgttggccaggctggtctcaaactccggacttcaggtgatacacccacctcagccgctcaaagtgttgggattacaggtgtgagccaccgctcccggccttgtaacctgacttacagacctcctaagataagtgactccttgtgaaaccaggatgaaatatgaaagatcgaaagctacttttgccttaatttttgcagcagcaatagaataaaaaagaaaatgcaaggaaaaaaattaaaaaataaagcgacctttgccaagagcaagttagaaattcaagacatgaagccagggtggcacttttggctgtttttgtagatttcatccagtctctcccccatgaaggcagaacaggggaagaggcacagttttccagaattccatgttgggatatgggggaagaagaggaagaaaattcccatattctgaaatgtatagatttggaagcttttaggtaccaattcattcagacctaaatttactaaataagccaattgagggggaaaaaaaaggaaaaaaacttctaaaaagagagagtacagtgtctgtggcagtgaagccaactagataccaggaataaagtttggagtatagatctctatcatggaatcactcagggatgttaagccagctcatcaaaggccacgtagtaaggtaaaggtggagcccgcgtctcctaatttactgtcccatttccttccgacaccacactatcttgaatttagggaaaagttaatttccaagtgtttgtgcaatgggccagaacttctccctgaaggaacatactcccagttcttgaggttcatgggtttgcctcaccagtgcgctccccagtgctgagtaaggctcactgtgctccctggctggtcattccccaccctgctgagacagcctgacacaaacatcctggtgaagccacaaggagaccaccttgattttcacgcagggaggtcttggtttcacagcttggttcaagtttcctgaggtgtcaaaactatctgatacctcttcggagccaaaacaaagcaagcagctcccggaggcagataaacttaggctccaactccttctagaagctgagtgaaaccactccttccttgtccaactggaaaaacctaagaaataggcctctccaggtcccttctggtctttgagataattctctaggagagctgtggccatgcctgcattaaaacaaatgcgactggccaggaatgcagtgtagaattgaaacatcagggctgagtgattcattcctctttacccagtttttgttttgttttgtttatctgtcttccctcttggggaagcctccacccagttctcccatccaggccagtgggttctgaaccccctccttccctccttcagccatcccacttgccctgcttgggccttttcagcagtgtgtgtcacatcatcatcagatggaaccagaagcagccaggagtgctttttggcacttccagctcagccagtaccgtagaggatccagggttactatccatggtgaaaagaactttctctagaattggtattaatgaggttaagtaacttaatttccaccaacaacttatccagacatttaaaaaggcaatagagataaacagcttagtaacaacagattggccttcaaatttcagagtattgttttctccctaactgagctgtctgcttgactggttagtctaataaatgcacggagaaggtgcacacacaacacagtacttttcactatttaacaccatgatcatgtggaatacattagaaaggaaataggtcaaaaaccatcatgtgaaccgtctaatttgatgtttgggctaaggctaaaatcttcacagggaggttctaaagtgctgaaatgcagaacattcaggctgactggttcacccacaccagagagagaaactcaagtggggctgggagggcaggggggcccagaagtgacccaggaataacctgcccttgtgttcatttccagagaccaaaaaaaaaaaaattttttttttttttttttttttttgaggcagagtcttgctctgtcgcccaggctggagtgcagtggtgcgatcttggctcactgccacttctgcctcctgggttcacgtgattcttctgcctcagcctcccgagtagctgggactacaggagcccgccaccacgcccagctaatttttgtatttttagtagagatggggtttcaccatcttggccaggcgggtctcgaactcctgaccttgtgatccgcacaccttggcctcccaaagtgctgggattacaggcatgaaccaccacgcccagctcagagaccaaaattaaagaatctcaagtaattaactactgtagccaggtttacaatatagtaccagagtctcagggatggaaggaattcatcatacaagatcctggtcaccttaacctggcctcacaaaagccatcttttcaaaattgaaccatcactataaaaagaaaattggtgtcagtgagtcccaggaatacacataatagtttctttaaaggcagggctaattggtgacacatctctcttggaaagacacatgtaccacaaacaaaaacaggatccaaccacttgtatctagatagttatctttctaggcagaaaatctaacattcagtaactaaaccaaatcccagagcctcagcagccaaaatggccctagctgacatttcatccagcctcattttatagaggagaaagtagaggcccatatcttgtccatagttgtacacctgggatccaggccagaattcttatagctacacgggcctgggatccagcattttaggttgagtaaaatcatttcctgctaggtccctgattctattgagaaccagggctaaggctttatggatttgggaaaacttaagtttctattgcaaacttcaaccagtgggtcccagaggtgctttgaagtctccggcttccacatttgaccacaaagtgctgcttatgtcctgatgcttacatgattcagttaaggtgctttccaaacccggtgacaacagctggggccttcatctccagtaagtttcctgatgagcagcagaggtctatacttagggttcctgtgaaaaacacaaactcccagtctcacatttggtcacactgaaggtttggccaaattatttcatacaagtagttctcactggccaaacaggtggtttttctcctgga

SEQ ID NO: 1589 - DNA, 1889 bp, Homo sapiens
gtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaa

SEQ ID NO: 1590 - protein, 473 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 1591 - DNA, 22419 bp, Mus musculus
caactaaattatctcaagctagatgtgggatataaatgccccagagctgcctctatctaaacacacagactaagacatttaatgtgaaacccttcacttcttcatatagtcactttactgtgtgagccataaatgagttagaaagagccaggcatagcggtgcatgcctatagttccagcatgcagagagctgagacaggaggatttccaggagttcaaaaccacccgaggttatgtaagtgagtaacaggttagccatggctacatagagagaccctgacttagaaacactgaaaacagagcaaaacaggaagagggggaggaggaggaataggagaggtagttgtcccaggaaaatggcttagaccctgagaattactggccggcatggctcacaatgatcttttggtgagctgtttcggtggaccgatgtggagaaagtgaggtgaacatcagggtttttattattcatttcctattctattcttttctgtcctccagacgatttcccaaccccttgcttatctgcttatctcctgtccaagttctaaattcagacagccatctgccagatgaagcccagcgttcaaatgaacttgacttggatgtcaggcactagacacaaacacacatatcctatctgcagcaaaagcaaagaccgttaacccacagactgcccctgggcatgtatcccaggacttattccaaaccacctgatgggtctggaaagagggctagaagggccatgcctttgtggtacacatatgtgaaccaggcaggagcacaaggtggtgtttacagcagcagcagagagcagcccagccccacggagctgatgtacctgatacatctggggcctcagtgattctgatgtgtggattttattctgtgtagttcaaacaagtcgatgtacagtcagtcccccttgagtgtgctaagtcatagccaaattgctcctagaagtcagtagctggagcaggggatagggctattcacccagaaacaagagacacgtgggtcctttttgtgttaggtgctgttcctggtactggggaagcaactctccttcctcctctggggaactcaatgtcctggcacgatctcagcatactgtaaagtgtgtgtgtgtgtgtgtgtgtgtgtgtgtgtgtgtgtgtgtgtatttgaatagggtttcacatatcccagactgtttttgaactggatatatatagtccagggtagccttaaacttctaatcttcttgactccaaatcttatgtgctatggttacagttttgtaaattcactttttaaaaaagtaaaaatactttctcagttcaacattgtctttattttgaattactggggagagataactagtcattttagtattagggtaatcaaagtttatttttttttatgtttctgctgtactggagattaaacccagggctttgcccatgctaagctaatgcttgaccactgagctgcactccaagtcctgttcattttttacgttgggatggggcctcactctgctgccttcaccttatgctgcttctgtctcagacttctgggtagctgggattatagcaccagcaggtccagcctgtgtaaattttgttgttgttgttgtcttgaaacaaggtctccctatgtagaccaggctggccttgaactcacagagatctgtctgcctttgcctccagagcactagtattaaaaggtatgtaccactgtgcctggttttaccatgcctctgttgccggagtcttgctattatcccaggctggcctcaaactcccaatcctcttgtttcctcctccctggtgctgggattacaaatgtcgcctggtatgcctgaggaatactttcaaatttaaacgtttgttacattttttaatgcgccaatattttcttaaatgttacttacagagttacaattaaatttgtgaacctgggctataacccaagacaaccctgccccgtgtgtgtgtgtgtgtgtgtgtgtgtgtgtgtgtgtgcgcacatgtgtgtgttataaggttcccaggtatgctaggtttcactgattattcatgggtggcgtggttatggctttaaaatgaaagtaccccagatcttcctttctgtggacgggatgctagaaacatcaagagcacagggatgctgggtatgtacagttctaagaacaggtgtgtgtatgccttgagtggataagtctttgaactacattgatcatgaatatgctaaccagggtcttggttttgctgaggagggttgtggtaaaaggtaatgcccattacaactctttgtactaattccagcatttaagaggcagaggcaggaggatcaccatgagtttgagaccaacctgaactaaccagtaaaaccttgtcccccaaaaccaaacaacagtttcaaataaggaaatccatgctgttttcttagttaaaggcccactagccttctgtctaacatccttccatttcacaagccgtcaccaaatgcctagtgagggctgatactcagaaaaccaggtaagctcccccacagtcttggggagcttagggtctacttggcgaagacagtgaaaaagtgtatggacaaacggacggtgtcagcatcttagtgctaaacgctcaggaaaaggaaacccaagggacatgagagaaagtgacagaagtcgaggagtgcaacactggaggagggcttcctggagaaggtgacatttgagcattgttagaggaagagtcaacagctcagtgtctgggaggcaaaaggaagcaaggagatggatggtccagcaacagaaccagttgggggcattcaggaaaggaaaaaaaaaaacccacagcagcatggctggagtgtcagaagggcaagtgctacaagctaaggtcaaaggctggccaagggctgggcagagaggatgtaaagactccaggaagagtggcattttgcttgtatgtttgctttttaaaaaccaaattttaagcagggtgcgttgggttggacagcaggtctgttcagagtcctgatttaattcacccttaaatggggaagcggaatctgctggtggaagatctgtctctacttgccctgtcttaactgatgactccatacccagagtagcccaaaatccaaagatacaaattggttctgacgttaggtcttgaacccatggccttttgtactctaggcaagtgaggaaccaccccaccccccacctccatctccagcctcgaggatgaaattcttaggccagtcccttttagaatctcaccagtgatctctaactctttaacactgcaggtaaacagggcagcaaaagaacgtgagaccccagctggcagtaagctaccgctggaagttttcttacaagacataaatcaaagactaagatgaaaaaaaaaattgccacatgtaagctgaagctctgatggacaggtcagggagcagagtcacccctcatccccaaagagtgcgttggagtttcccagcgggagaggatgtctttggcactacagtgatcaatgcctctttcagcttctgttaagtaagacgatggataagatgtctcaatgctttgaagcacgtcatgtgccagccctttctagccgcccttggccctgcccatgctgatggtgagatttttctcgttggatgggagccctgcagttgaggtttctcagggtgtgttgctgtcctataggtttggtgacgtatgtgaggctcctttggaataccagcagctaagctgaccagagagccacacaaggtcagctcaggacacttgagcagctgagaatccaaagaagacctcccttgttgtctgacggtgtgttcttgtttccgaagcgtggctcggcatggcagacagacgggcgtgggattctgccgctggtggtggataacatggcgagcctgggctgaagtgagttggtcttcagcacccgagctgtcccgtttcctcagctccagatggatctgcttctggcattacacagccttgtttaagtgcttgcattagcagcaggatggggttcctactgaagcatcatctcttgtcagaaagccaagagttgctctgaatgaaaacagaattcttcccaaagaggctaaatcacttgcactaattagtcgcggtggtggcgggtgcgtggggtggtgctagtggtaaatctgtgcctgtgctcttctaaataaggacaacttgggctctgttcacaagcagaggcatacgatgatgagccttgatcccactaagaccctgtgttgggctcacaatcgtgtgagtctcgcagagcatgtgagatacttcttgtcaaatccagacatttagaacggacacatttagaatactttcaacagttactgtcattgtagactatgcgctgtctgtgtgtgggcactgtggcccttctcgtggggtagcatagcagccggaggctggtcctctgatctcccacccaccatgaactactgcatgttacaccacctagactgcaacagctgaaggatagctcaagcgtgttacgtattttatctttcccagtttttgactattcatacccaagaacgttaagtcttgtccttctcccttgtcctttggctttttgagatagagtctgaacttagccttgtctcaaaaaggaggtggggaagcataaaaatgaccaaagaagtgaaaaaaaaaaggctttcccaagtcactaagagagttgattctggtgtgcacatcttcctgactactggtctcgtgctccgaccacagcccttcaccactagaccacacttccctaaataaataactgcttctgcatgctggggacaaggcatgtgcggcagcacttacgtaggcggtgcagacgggcagcctttcacttaatgttgcaataacacaggctaaacaatgcacactcaacttcaaaaagtcaccgaccgccttgacgctggtcaggtttctctaccatcccaccacgcaacagagcgaaatcagtagagcacgcatgggccaagaaaaaactgctgggaaaaaaatgtttcctatcttcctccttttcgcctctctctcttccttccttcctttcatttcttcctttagctcaagataaccccacattccctgtatagccaagagtgactttaaacttttgattctcctacatccacaactaagcacacgcattgcagggatgggatgccatgcccagcgccccagcttctgtttttggtttggccgtttcttttcattttgcttttataagtcaaggccagtctcacgttgtaaccaaggctggcctggaactccctgtgtagcccagatccgaagcagtcctccttcctcagctcgctgagtactggggctacaggcaggagctactatacccactttgaatctgtttttaattggggctaaaatcagactggagattctgtagccttttggctcttgatttccagggagaggaactcagcacacagataagcatttgttgccaaagttgtgctgcttcatgctcaggcttgtccaagtcacagaatccctgccttactggggcaagcactaggcaatttggaggacacacacctgtctcaacgttgctctgacctttgcaaatggcaaagataatttcacatgcaggcgatgaattgtctttattattaggctacattgtgtgagctccattttaaaaaaaaactttatttttaattggcagatcattgtacagatttaggggggtcttttaatacatttatctattttgtaatgatcaaaacagagtaattagcatccttaccatctcgagtgcttctaatttctttgtggataaaagtatcggaaatcctttcttctgtttatcgaaattttgagatatctgttactagccaggtttagtggcaatgtacctgaaatcctagcacctgggaggtggaggtcagaggtcaggagatcaaggtcatactcagctacattgtgaatgttggcctgatgtgagggccggtctacaaacgtgaaaatgtgtatgcttgtgcatgtgtgcatgtgtgtacatgtgtgcatgtgtgtacatgtatgcatgtgtgcatgtgtgtgcagtgtgtgcatgtatgtgtgagctatttaatagaagaccacaacctacccttccagcctaactgtgtctttgtctaccaactttctctccttctggcaactggtcacctgttttcttctctctactcccaagagttccgcactgcgaattcaaatgtaagtgcggtcacgtgctacatgtcttttggtgtctggcttattacacccagcgtgatatgttgtaggttcctccatacaccacaaatgacagatttttctctattttttaaaaagactgaaatgcgggggacttttgggatagcattggaaatgtaattgaggaaaatacctaattaaaaaaaaagagaaagaaaaggaaacatttttgtgcccagcattaaaaaaaaaaaaaaaaaagactgaaacgctatttcactgtacgtgtacaccatattttaaaaatcaatgtttctgttgatggatgtgactgtttctatgttctggctgctgtgatgaacactgctataaatacctgtgccaacacacccggcatcatttcttctttctgcttgctctcaggttttgtagtggtgggattaactcagggccttgtgtacatcaggggtcactgtaccactgagccatacccccaagtctgccctgtctcttaagatgtgttgtttacccaggcggtggtggctcatgcctttaatcccagcacttgggaggcagaggcaggcagatttctgagttcgaggccagcctggtctacaaagtgagttccaggacagccagagctacacagagaaaccctgtctctgaaagaaaaaaaaaagatgtgatgtttatactaatgaatgggtgctatgaacagactgagatgtaagagtgtcttgtcagatgatcactcgtgcaggaggacacaggagggtctgagtagtgggcttggaccctatatgatgcgctgacccttttcagtcctggtcttatccagaggacagatgatctaggccccactctatattgcagtcacttctcctgagtcctgtcttgaaccctcactgtgcccccttgctactccatccttagatctgtcaagccgcttactgcagccccgtaatactctctctttttttgtttttgttttttttcgagacagggtttctctgtatagccctggctgtcctagaactcattctgtagaccaggctgggctcgaactcagaaatccacttgcctctgcctcccaagtgctgggattaaaggtgttcgccaccacgcctggctgcgcagccagtgttcttaaccactgaaccatctctccagtctctggcttgtccttttcagaggacagatgtattagatgttcaactctctggccataatgttgccaagaagggggggggggaactctttggaggaggaaggatcatccaaagacctctctttttttactgccaaagtaagtgatgtatgagataaatcctggatataaaatcttgacacatctttgaggtgttggccagagctgcttcaaacctgaaaaggaaataaatcaaatctctgcagtttttctctaagagtccctgagacgcagttatgagtggaaggcaaggccagacagacccaggaactcaaaggttgacctactttgtcgaaattaacaagagggaagacgtctgcataatttttctgtctctccctttcacagtaaagaacggtgggagcacatgacagacgagctgcaggccacgaaatcccttcaggattgagcagctacacgaagcctgtgtttctatatcgtgttgttctctttccctcccccctcttccgagtgagaaaaaaaaggggggcctaaattcccaccaacataaactaatgacatacaatgatgaaattctgttttcacctctgcctgtgacagggaatgcaaaaatagcaagtggcctatttccacgaatccccgcctccctgccctccccgctcccgctgggtttggatctctaagaatggaggctaacgcagaggcaggagccagccgggatcagccccccgaacccgagggtgatgtcagtcggcgggagcggacgcagcctggccagggaggcagaggttcctagggagcagggagggcgggtggcctggatgggcggaccgtgcgcccggccgctccgtcgcctggagacggccctggcggcgctgtgttgctgtaaacagccgcttcgctgttactatctatagaaagatcgcctagctcccgggtgcggcggcccgaggcaggtttgtggttctgcaccccttgcgcccctaaagatccatccgctgtcctaatcctctctagtccgtcttggaatgcccaccgtttggcttgacccttgggaccctcagaatggagacgagggggacacatgagttctgcgaggatctgcggtttcctatcccagaggtgaccggcccagtcagtctaacccggcttgtcctctgcggaaggacaggaggccgagggcaagtaggggtgtgtttgttctacactgaagcacctgacctcttcaaagttccatcttccaagactcaaagctgttctcaggtcccagacgccaaaatctcggcacagctgggaacctttcttcccgtcccctctgcgcccccaccccccttcccaagtccgatctggaaaatcacccgctgcaggcgggttccttgtaagcgcagtttccaggctgcacgtattcagacccccatctccccagcaccgacttgctttctcctccccccccccccccgagctcacctcactttgtaattctgagctccccccctgccccgactcgccctctggtctcagctcaaaactaaacatacgaccccttcaggcatacttgtagggtggttttgcacaatgtttatccgtcagtgtcaacggggactgtcgccttgatagctctaagtggctaagggtcggggagtaggtgctgccgtcctttaaaacacgaatttatgaatgaacccagtactgtagttaaatcaggttattgtacacttatttacaatccttcacttgctgcttccaacctcagtcctaaagtttctccaggcaaggagctggagagaggggctgagaagctgaccccccctttttcttctctgcactgatttgggatggggggctgatgtgggcaagctttcctttaggaacagaggcttcgagcctttaaggctgcgtacttgcttctcctaataccagagactcaaaaaaaaaaaaaaagttccagattgctggacaatgacccgggtctcatcccttgaccctgggaaccgggtccacattgaatcaggtgcgaatgttcgctcgccttctctgcctttcccgcctcccctcccccggccgcggccccggttccccccctgcgctgcaccctcagagttggctgcagccggcgagctgttcccgtcaatccctccctcctttacacaggatgtccatattaggacatctgcgtcagcaggtttccacggccggtccctgttgttctgggggggggaccatctccgaaatcctacacgcggaaggtctaggagaccccctaagatcccaaatgtgaacactcataggtgaaagatgtatgccaagacgggggttgaaagcctggggcgtagagttgacgacagagcgcccgcagagggccttggggcgcgcttccccccccttccagttccgcccagtgacgtaggaagtccatccattcacagcgcttctataaaggcgccagctgaggcgcctactactccaaccgcgactgcagcgagcaactgagaagactggatagagccggcggttccgcgaacgagcagtgaccgcgctcccacccagctctgctctgcagctcccaccagtgtctacccctggaccccttgccgggctttccccaaacttcgaccatgatgttctcgggtttcaacgccgactacgaggcgtcatcctcccgctgcagtagcgcctccccggccggggacagcctttcctactaccattccccagccgactccttctccagcatgggctctcctgtcaacacacaggtgagtttggctttgtgtagccgccaggtccgcgctgagggtcgccgtggaggagacactggggtgtgactcgcaggggcgggggggtcttcctttttcgctctggagggagactggcgcggtcagagcagccttagcctgggaacccaggacttgtctgagcgcgtgcacacttgtcatagtaagacttagtgaccccttcccgcgcggcaggtttattctgagtggcctgcctgcattcttctctcggccgacttgtttctgagatcagccggggccaacaagtctcgagcaaagagtcgctaactagagtttgggaggcggcaaaccgcggcaatcccccctcccggggcagcctggagcagggaggagggaggagggaggagggtgctgcgggcgggtgtgtaaggcagtttcattgataaaaagcgagttcattctggagactccggagcagcgcctgcgtcagcgcagacgtcagggatatttataacaaaccccctttcgagcgagtgatgccgaagggataacgggaacgcagcagtaggatggaggagaaaggctgcgctgcggaattcaagggaggatattgggagagcttttatctccgatgaggtgcatacaggaagacataagcagtctctgaccggaatgcttctctctccctgcttcatgcgacactagggccacttgctccacctgtgtctggaacctcctcgctcacctccgctttcctctttttgttttgtttcaggacttttgcgcagatctgtccgtctctagtgccaactttatccccacggtgacagccatctccaccagcccagacctgcagtggctggtgcagcccactctggtctcctccgtggccccatcgcagaccagagcgccccatccttacggactccccacccagtctgctggggcttacgccagagcgggaatggtgaagaccgtgtcaggaggcagagcgcagagcatcggcagaaggggcaaagtagagcaggtgagcagcgattctggacctttgtgggctgggggggggggggggggcggagactgacgcacagaccacacaacagagaagggacgctactgactgcacttcctgaccaggagctgtggctgctagccctttccctcccttgtcagattttgacagttggacccaagacaaactctagacagtttccctgacagcttcctacttcattctctagccggggagcttctttgttcccctgctaaagatctcactttaaatgcaaatcacactctgcctgccaactgcaggttagaaaaactgcttcaccgagaggtgcgggtgctgtaggagccagtttcactggggtgactgaatggaggtgacactagacaaccttaactgaatgttggtccttttcttctatagctatctcctgaagaggaagagaaacggagaatccgaagggaacggaataagatggctgcagccaagtgccggaatcggaggagggagctgacagatacactccaagcggtaggttgaaccagctgctgctcctgaaactttattaaagttggagcttgggactatgggcgcagggtccttgagcatgcccgtgtcttatgctttcttatatctctccctatgcaggagacagatcaacttgaagatgagaagtctgcgttgcagactgagattgccaatctgctgaaagagaaggaaaaactggagtttattttggcagcccaccgacctgcctgcaagatccccgatgaccttggcttcccagaggagatgtctgtggcctccctggatttgactggaggtctgcctgaggcttccaccccagagtctgaggaggccttcaccctgccccttctcaacgaccctgagcccaagccatccttggagccagtcaagagcatcagcaacgtggagctgaaggcagaaccctttgatgacttcttgtttccggcatcatctaggcccagtggctcagagacctcccgctctgtgccagatgtggacctgtccggttccttctatgcagcagactgggagcctctgcacagcaattccttggggatggggcccatggtcacagagctggagcccctgtgtactcccgtggtcacctgtactccgggctgcactacttacacgtcttcctttgtcttcacctaccctgaagctgactccttcccaagctgtgccgctgcccaccgaaagggcagcagcagcaacgagccctcctccgactccctgagctcacccacgctgctggccctgtgagcagtcagagaaggcaaggcagccggcatccagacgtgccactgcccgagctggtgcattacagagaggagaaacacgtcttccctcgaaggttcccgtcgacctagggaggaccttacctgttcgtgaaacacaccaggctgtgggcctcaaggacttgcaagcatccacatctggcctccagtcctcacctcttccagagatgtagcaaaaacaaaacaaaacaaaacaaaaaaccgcatggagtgtgttgttcctagtgacacctgagagctggtagttagtagagcatgtgagtcaaggcctggtctgtgtctcttttctctttctccttagttttctcatagcactaactaatctgttgggttcattattggaattaacctggtgctggattgtatctagtgcagctgattttaacaatacctactgtgttcctggcaatagcgtgttccaattagaaacgaccaatattaaactaagaaaagataggactttattttccagtagatagaaatcaatagctatatccatgtactgtagtccttcagcgtcaatgttcattgtcatgttactgatcatgcattgtcgaggtggtctgaatgttctgacattaacagttttccatgaaaacgtttttattgtgttttcaatttatttattaagatggattctcagatatttatatttttattttatttttttctaccctgaggtctttcgacatgtggaaagtgaatttgaatgaaaaattttaagcattgtttgcttattgttccaagacattgtcaataaaagcatttaagttgaatgcgaccaccttcttgctctctttattctcagttttgtatggtttcaggaaggcctctgaggagaccagtttgtcaagatgggtgggtcctggaggggaacacgccctctgtccccttatcactcagaggacacgctagttcagggtattttacagagatgtgtgttcatattgcattgcctgccttggggctgaaggctgcctgtaacagcttgtgcaaggatgtgcttttctgcatgcttatcttcgccttagtgattttcatgggaaaggaatcctttgaacagagcctagctctacacaaacttttttgttgttgttgttttgtgaactgaagaagagttgaaataagcgaccttccacactgcaaaccagatcgccacttccccctcctgtccattattaggctgaactgcctctttaaaaaaaaagtatatatatatatatatatatatatatatacacacacatatatatatataactaaaatatgtatttatttatgtggggagggcattcatgtacttgaggtcatgcacttgaggtcatgggacaacttccagactttttctcaagaacacgacctttgggaattgaactcaggttagcaggcacctagacccaccaagcagccaatcttgccagtccccctccccctttaaagatgtatttatttctattttctgtgtaagggtgtttcgctggcatgtgtgtctatgcaccaggtgcatatgcagtgtccatagaggccagaagagggcaagggatcctgtgggactggagttctgagacaatggcagctacccaagcaagcaccaggaatctaaatctgggctctctgcaagtctaacaactgcttttaactgctcatccgtcttcctagccctcctgaactaccttccacaccttagccttaaaaggtttcccttggttaaaacacacacacacacacacacacacacacacacacacacacacgagtgcgcgcacatgcacgcaaacaaattttcaattgtttgtttacttttaagatgggtctaacttagcctagtctgacctcaaacttgctatgtagctgaggctggccctgtattcctgatctttctgtttatatctcccaagtgctggctttacaggtatgcaccgtcattcggttccttactcaaacatatgttcatttagtcaaccctttttattctccaaagagagcaggctatctattatcctgtgccaccatgaaaaacaaatcccaacttccgaagctactttaacacttgggtgtaattcacagtacagtaggggaaaaggaatggacatttaaattatcttgagcagcataaataatggctgatcaaccagtctgtaaataagaagttacataatagctcagtagggaagggtcagaagacttcgggtgagcttagcttagaaagtttatcatctcaaagaagaacatgacctttgcctgggacacctcaggtaatgactgctgctctctctcttgcttacatgcaaaccaaaaggaaagaaaaatgagccactccctacccttgctctctggtacctaaaaaccatagactgtttccacgcatgctgggtggaaggggagccttcaggtcattagtggtaatgacaatcacgctgtggtcacagtgggcctcgtactctgtcgagctgtgtttcaatttcaaacgacagttccattacacgtgagctgttaacctatgatctacctgctcctaccacagtgattgacacttccaagcaatttacccaagtctctctagaacgttctttacagcacattccacttgcacacactgctttggccagtcctgagttatggagaggccttgttggtacaccaataatcccagagctgaggagagaggcttgagttctgggctacactgtgagatcctatataaattaaatgaaatgtaaaaaaaaaacaaaaaaaaaccaaaacccaaaaacctttagaattaatgtaacatttacaaggactcggtgagctcttttaaatgtgtggtggtaatgagctgagaggaatgttccagattggaaagaacagcaaggaaagcagcttgcccctccccccactcccgggggcctccctaatggccctggcagttgtaaactagctgtggaagaagagcatccccttttctttgacaggtctgacacaaagcctttctccaggtcaccacagcccaggccatggtccatccacaggcaaacactgaaactctaggaagacagaatctctgaaaggtttctccaagttcctgggattcccccgaaggactaacaccttctgagctccctgccagctacttccgtggtctagagtatcttccctgtctggccaaaggactccttccaaatccccccttaccagggactctggatttaaaaattcctgaggaagactggcactaggaatgtcacctttcttttggggacacttccatcccttctcagaagacaaagcctcaaactagtttcaggggaacaattacctgcctggcttcagcgtcactaacattgatacaagtcctgaccatacaacagaaagggctaaagaccagggaccatttcccttagggaccatgtcaagcctgacccgccaatggactctaagacccagttcagagctatagtacaggattaacaaacattttgctcagtgggtgaatgaataagttccaaactctttctacgatcagaaactggtctgtgtatgttctgtagtttctgttccagtccccctttccgatgttaggcaataggaatgttacatcttttacctctggctgcagacacacaggccacttctgtccttcattcctggaattccttcattgcctcccctgggttccatctgccatttcagcaaagcgaatgactgactgtgcaatgactgaaattaatttcagatactagaagaaaaaatactcatctttgcagaacagtggataacaggctcccaacacctttgcatacccctagagctcatgcgattatcaaaactagagaggagtactttgtgctctatttaaaccaatcatgttctgtttaattagtctcaggcacagtaaaaacgctaagatggttaccttaagcaaatgatcccaagtttcaatgtgtctgaagtaaaagaagaaacaaaagcaaaagcaacctttaaactgtgcacacgtttcctctgaagcagtccctcggagggcaagggatagagtggcatctggatagagtggcatctggatagagtggcatctggatagagtggcatctggatagagtggcatctggatagagtgacatctgaatgctgaacagtgctcatgctttaaatcgtgctggctttctgttaacattaagaagttgacccttgattcttctggtgccctcaagtccccataaacacacagggcatgggactcccttgcattctgcacacatctagtactcattccttgaagagggtgtttgtttgtttgtttgtttgtattgtgctgataagcctctacctgggcctctttgcccaaactggcaaagacatccaggtcccagctcaaagcaagtctccttctagacaccttccctggccactctatctagggtgtcttctgggcacactccctgaatgacgttttcctgattggatctcatagcattcatttctcgctagctgcgacatccaatcttggttttctttcacttaaaataataaatgtctcgtcccatgagaacaatgatcttttgtatcttgatcacaaccgtgtctctcagggttgttgactgagtgcaaatagatgaatgaatgaacacagatgacaattatgaaagtgtcgtaagagagccagaccttagaagggaatattaacctcaaagatgtctccaagggtagaagaccatggccctttattaaatacaaactccaggctggagaggtagctcagctgttagcacctgccattcctccagaggacccaaattcagttcctagaatccatgatgagtggcttataactgcctaccactcctgctatgggggagggagagccaacatccctggctttggtgggctccatcactcactcatgcatacacatacatctaagtgaaaagtaaaataaataaaatgtaagcaacaacaaacggcaagctctccagacgtctcagtagacgagggagcctgatgacccgagtccatccctggagatcctgtgaaggtggaaggaaagaatcgatgccacagagttgtcctctgacccctgacatttgtgcacccacactcgttttaaagaaattcatgttgctctaaggatggctattcacacctacagttccaacactggggagactaaagcaagaacgttgccatgaatttgaggatagcatagtctacagagtgaattctaagccagcctgggctacagagtaagaccctgttttgtttgtttttgctttgtttttaaacaagacaaacaaataatcaaaatgtattcaccttggtacaaaacactcagagtctaatacaagtctgttttgagttcattcagtgtgcaacctttaatttagtctgcattagaatggaaggaagagtaagggttacctagttcccattatccatatcactatcgttagccaagagaaggtccacacctgctgtagataagatgtactagatgctggtgaatgactttggtctctggaaggagccagttgggtaggtttcccttgtctttgcaagcaggaaaaagcaacagaaatctaaaccagtttagttgcaatacaatccatttcaatggttccacagacccactcatggactaagctgaaatgcatttcctttgtccaaaacacattgtcctgttactcaagaggacgaaagtagaaagtgttctggctactgtcccaagcaggctgcctagtctggtcattagctttcccccacaatccctaactttcagccctggtgtttgggtttggttaaagcaaatgattagaagtctggggacccacaggtgtctaattgttggttatgttagaaactctttgttctagaaccaggcccagaggctacagggatgtagtggtattgggcttgctagcctgtgtgaggccctgggttggctccataacactatgaaatgaacaaatattagcaggaggcctgtgtggaaaggacctagtttaaaaggcctgggacaaaaagcaactttatcctgactgttagtggcccagggtctacttgccatgtttatttaggggagaaattaactgggttaaccgatcatatgacaggtaaatttatcaagacaatgtgataacgtagtctggatccaatattgcaaagtgttccagaatatagacttagttctgaatcctggctcctcgaccttaggcaaatcaagcagtctgtactcagcttcctcagtggtaaaatggagatggtaattgtgggtggctattgagactgctatgggcactcagagaagcaaatcagtattacagctcctaagtgtgaaaaatatggtagaatagttggctgttattatgccttttgggagatgacggtcagtcagagaagcacatagggattgcattatataggataaccagttggaggtaagcagaggggagggtggggaatctaacatttacatcaatatcgaagcatcaaaagtgaaggaagttaaaggtagggcaagaatagataactgtggccagattgctccgagcctggtatttaatttagatcagtctgtttgaagacttagttacagcagtggtggcaggaatggagaggaacaagtggtaattaggaggaagacgtcccaggcttggtgacagggtagatgtgggttttgatggagagggaggaatctatgcccattgctaggtttaccgagcttgacacacagtgaggcttatggctcccccagggacttggtgtccatagaaagaagcatgggtttcggggatgtggattagcttcgtgtggaacatgttagcttgcaatgcctagaggatccatctagggggagatggaggttagtcccagtaacctagtagaaaatggaaagagttgatggggtttattcagagcacaaggttggcacagaacctgtggccctggggtaaggtttcacatgaacctgttcgtgccaggatctgctctatactgtagaggaagttcagggtcagggattgctctactaatcagtgtgcctctcacaactggcacttgataggcacacaatcattatcatgttgtcaaatggttgcctcatttggtcttgtcaacacaacagttcaacgagacagctgttagtgccttcatttcataggaatggagcatggcccaggaaacagtaagtgtcttggccaagggcccacagctgataagtagcagacctgagatttgaatacacactttgtgaatctaaagagccccaattgcttaaccacattaccggatcattagaatttgactctaggtatatgatctgctcctctgagatgatctttatgcccatcaggggtggtgggattaaagtatctcttaagccggagctggagagagagcacagcaagcaaagtgctgctgccaaacctgacaacctgagatccatcccaaagacccacaggatagagaggaaaaagtaactgtacggctcgtcctctgactgctccatacacacaatgtcaataaacaagcaggcaaatacatgcattcttgtggctgaaacaggcagatctctgtatttcccatttatttatttatttatttatctatttatttatttttattttgtgtgtgtgtatgtgtgtgtgtgtgtgtgtgcgcacacacacttgtgtcatggtgatatggagggcaacttttgggagtcagtcttctttttccatttctacatggcttctaagggaccaaactcaagtcaccagcattgatctacaagagctttactggctgagcagtcatcatcctaaaaaaaaataaagatgtattatttacgtatataggtactttgtctgcatgtccatctgcccagcagaaggtggcatcagacaagcctgagctgtcatgtggatgctgggacttgaactcaggaccttcagaagagcagtgtgttcttgaccattgagcccccagctgaactatcttgctggcccctttaaaccaattttgtttgtttgttgacaaagggtcttatcatttaatcttggctggtctggaaattggtagcagaccagactggccttgaactatagagatcctactgcctctacctcctgagtgctaccatgtgccctatcccccaaacagatttgacagaaagtatctagttatggtgtcccatacccgtaacccccaaattgaggagtgggtataggaaggtcacctctgaaaggtagttcaaggctacctttggctgtagagctagtttgagatcagcatgaatggttcaaaccctttctggaaaaaaaaaaaaacaggcaaaagccaactgatataacacagtgactgtgaaaggcaaactgaacttgagtctcttcagttagctctgtcactgtgtctgagcacctgtgtgctggtgtgtgtttacacattcttgtgaagcgatgtaacattttgtcatgcttcctggcaaatgcattgtggtgaacacgtttagtatttttattatatgttaccttcctagtgtgttctttaaaatgggagatttctctaaaattgtttgctttgaaactgaaggacaatcaggaaaacatgacactggatgtatgatatagtcatggtacaattaagctacttgcctgcttccaagggataggcagtcagcagcactaacttgggctcacagcgtgctaaacactgctctaaactatacaacttttaatgtctttttggggggtaggggctgttgagatggcccagcagtgaatgtgtacgctgttgttgcagctgacctgaacctggttctcagcatctacctacatctggcacatctgtacaaacgtgcacagacacatacataaaaattaatatagatttttattaaaaatagtcgcagggctggggctgtgcttttgtggctagaatgctcgcctaacattaaagaagtgctgggtctgagcgccagggcggtttgcttgtacagggtatggtggtgattcgttacctgtcatgtcaccacttgggaaaaggaagcaaatggatcagaagcgaaaggcccttttctcagctacatagtgaaggcctgatccacatgagatacgcgagactacgtcatatatatacaaaatagtcacaggtaccctctaaggtaggcctcgctattatgcttactttatagatgatagtctagggcacaggaagactgtggcctgtacttcattatccacctggagtggcggccctggaatctgagcccagggtaaagtgtccccaacgactgcatgctcagcggctggtaaggaaaaccaagtcctctacaaccttgcaagccgaagaaagcttcgatgggtagaaaagctcctctctgccggcttcccaagctcctcccaggggtctcggcgtccctgcaccctccctctccgcactctcccgatgccctcaccctgctctgccaaggccaaggtgtcacctaacccttcccagcttccggccctttgctccaggtcagctcgctcctgcagacagcaccaggagccggccagtcctctatttactgtttggtttccacggtgacacgtaggcgccgtcagcgcctcccgtcagcggcccccacccggcgccgtgacgtctgcccgccgcttccgttctgcccatatttggaaaggcgccgcgggcagggaggggttgggagccggactcccgcggcgccccgccccctgcccggctccgcccccgcaccgacccgaggagccatgggctgtgcacccctcctcctaccccgaccctgcggaggcgggcgggggctcgggtcgccagcatcactgggctagtggaggctgcagtcaaagcttagggcctggctcctctgttcccggtggacgatccgggatcacgattttcgctttctgtgcccggaaatcctggaaacaatcccggtctaaccctccctctctttgatacacttgatttcagattctcgtctttggcgcagtgaa

SEQ ID NO: 1592 - DNA, 1143 bp, Mus musculus
atgatgttctcgggtttcaacgccgactacgaggcgtcatcctcccgctgcagtagcgcctccccggccggggacagcctttcctactaccattccccagccgactccttctccagcatgggctctcctgtcaacacacaggacttttgcgcagatctgtccgtctctagtgccaactttatccccacggtgacagccatctccaccagcccagacctgcagtggctggtgcagcccactctggtctcctccgtggccccatcgcagaccagagcgccccatccttacggactccccacccagtctgctggggcttacgccagagcgggaatggtgaagaccgtgtcaggaggcagagcgcagagcatcggcagaaggggcaaagtagagcagctatctcctgaagaggaagagaaacggagaatccgaagggaacggaataagatggctgcagccaagtgccggaatcggaggagggagctgacagatacactccaagcggagacagatcaacttgaagatgagaagtctgcgttgcagactgagattgccaatctgctgaaagagaaggaaaaactggagtttattttggcagcccaccgacctgcctgcaagatccccgatgaccttggcttcccagaggagatgtctgtggcctccctggatttgactggaggtctgcctgaggcttccaccccagagtctgaggaggccttcaccctgccccttctcaacgaccctgagcccaagccatccttggagccagtcaagagcatcagcaacgtggagctgaaggcagaaccctttgatgacttcttgtttccggcatcatctaggcccagtggctcagagacctcccgctctgtgccagatgtggacctgtccggttccttctatgcagcagactgggagcctctgcacagcaattccttggggatggggcccatggtcacagagctggagcccctgtgtactcccgtggtcacctgtactccgggctgcactacttacacgtcttcctttgtcttcacctaccctgaagctgactccttcccaagctgtgccgctgcccaccgaaagggcagcagcagcaacgagccctcctccgactccctgagctcacccacgctgctggccctgtga

SEQ ID NO: 1593 - protein, 380 aa, Mus musculus
MMFSGFNADYEASSSRCSSASPAGDSLSYYHSPADSFSSMGSPVNTQDFCADLSVSSANFIPTVTAISTSPDLQWLVQPTLVSSVAPSQTRAPHPYGLPTQSAGAYARAGMVKTVSGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEASTPESEEAFTLPLLNDPEPKPSLEPVKSISNVELKAEPFDDFLFPASSRPSGSETSRSVPDVDLSGSFYAADWEPLHSNSLGMGPMVTELEPLCTPVVTCTPGCTTYTSSFVFTYPEADSFPSCAAAHRKGSSSNEPSSDSLSSPTLLAL

SEQ ID NO: 1594 - DNA, 22477 bp, Homo sapiens
gtgggccaatgagtagagtgctagttgaagaactttttttttttttcttccatttccccagcctatttcataacctcttacttccttcttttccaaattctaagctcagacagacatcagctggatgaagccccaggttcaaacaaacttgccttggatatcaaagtactagtagcaaaggaactcccaattcctcacctgctgtgaagtttcccattcactgcaagcaaagtccaggtgaaagcaaagattcttcacccgcagaaaccctctgggcaggtaactcatgatgtattcccagccacctgatgaatctggagaaaggaatagaatggttctgccaaatgatttaaatgaagaatcctgtgggcccagcccagccctctatgctaaccaatctgaagccggcaggtgtgtggtgttctgtttatagctgccagatcagctcctgttgtaggttctatatgctggcctcagctgagcctgtggtatgtgagcacagttctgtgcgatccaaacaattgacaaatactgacctggccccagccacgtgcccagtcattgctgggctgcccaagaaaccaactaagcacattctggggcaggggtggggggcattcaagaaagaaatcagaaagctgtattcattattctattgactgaaggcttagtattgtgtcaggcactgatctggcaacggggaaacagtaatgtctctttccctcatggaacttacatccgggcattatttcagcatacttatgagttttccttatttattatttatttatttacttacttacttattgagacagttttgctctgtcgcccaggctggagtacagtggcgcgatctcagctcactgcaacctctgcctcctgggttcaaacgattctcctgcctcagcctcccaagtagctggaattacaggtgcccaccatcacactgggctaattttttatgtttttagtagagacgggggtttcaccatgttggccaggctggtcttgaactcctgacctccagtgatctgcctccctcagcctcccaaagtgctgggattacaggcgtgagccactgcacccggatgagttttacttttttaaataaaaatgtattttacaacgcagtgttgcttttgtttttaattacttgaaaggacaccataatcatttcactattagggccataaatgtttactgtggccctgtggccagcacttttaaactaaaaattggttagatttttacttttatgcacacatattttctaaaaagtttcttggccgggcatggtggctcatgcctgtaatcccagcattttgggaggctgaggtgggtggatcacctgaggtcaggagttcaagaacagcctggccaacatggcgaaatctcttctctataaaaatacaaaaaattagcaggacgtggtggtgtgctcctgtaatcccagctacttgggaggctgaggcaggagaattgcttgaacccaggagacggaggtttcagcgagccgagatcgcgccattgcactccagcctaggtgatagagtgagactctgacaaaaaaaaaaaaaaaaaaaaaaaaaaaaaaaattcattttgaattaggctaaatttgtgtaaaagaaaggatctggggtgtaaccaacctcaggtaaagtttctcattgtgctaatcattgttttggggtggggtggttgtggatttaaaactaaagcatcccgtacgatcttgtgcggtaggtagtggaaacatttactacacttgatcttagccaaaaggccaagaagtgattatgtggaaacatttagacagcaggtgtgatgggtctttgtagttctaaggatgggtataccccttgggtttataagcatctaaattatgcccgataagaaaattgctgactaggggctgggcatagtggctcacgcctgtaatcccagcactttgggaggcccaggcaggcggatcacctgaggtcaggagttcgagaccagcctgaccaacatggaaaaaccctgtctctactaaaaatacaaaattaggccaggcgcggtggctcacgcctgtaatccagcactttgggaggctgaggcgtgtggatcacctgaggttaggagtttgagaccagcttgaccaacatggtgaaactccgtctctactaaaaatacaaaaaattagccaggcgtggtggtgcctgtctgtaatcccagctactcaggaggctgagacaggataattgcttgaacccaggagtcggaggttgcagtgagccaagctggtgccactgcactccagcctcggcaacggagcaagactctgtctcaaaaaaaaaaaaaaaaaaaaattagctgggcatagtggcacatgcctataatcccagctactcgggaggctgaggcaagagaatcgcttgaacctgggaggcagaggttgcagactgcattccagcctgggcgacagagcgagactctgtctcaaaaaaaaaaaaaaaaaaagaaattgctgactaggattttggtttcctaacctgagaaggatagaggtaataaaccacccatcaaagctctctgtccagaaagggaatccatgctgccttctccgtcacaaggacaataactgatgaacctctgtttaacatttattcataggccaggcacggtggctcacgcccagaatcccaatactttgggaggccaaagtgggaggattgcttgagcccaggagttcgagaccagcctggacaatatagtgagaccccatctctacaaataataaaaaaaagtagccgggcttggtggcccatgcctgtggtcccagctacttgggaggctgaggcaagatgatcgcctgagcccaggaggtcgaggctgcagtgagcgaccgcatcctagcctgggtgacagagtgagaccctgtctcaaaaaaataaataaacaaaaataaaaatatacgtttattctacaaggatttgagtgccttggtgtcaggaagcatggtactgaggatagataactgctaaataagacagataaggtccctgctcttgtggagcttacggactagttgacgatggcaatgaaacagtacataaatggacagggtaatgtagtgataagtgctagatagaaaagaaaaccaggtaacatgacagaaagtgactgaagggcaaaggagtttgcaacaatggatggggaagacaggaggggcttcctggagaaggtgacatttgagcagatgttggtcaggaggaagagtcaacttgtcaaggtctgtgaggaagagggaagagtgggtacagaggcccagaggcagaagcagcttggcatatttgagggagagaaaggccaatgtagctggagtggagtgcaggaaagtggttcaaggtaaggttggaaggcaaggcagaggctgaagcctgtggactgggaatcctcataagaagtgtagatttttatctaagtgtcattctgtaaactgacctctaaacaggtttggggggataacagttctgtttggtgttctgatttaattcagagccccccgaggtgggagagtagactctgccagtgtataatctgcccttgtcctaactgattacctcacagtctgggatgggccagagtttaaagatggaattcttcagaagagtcattttgggaatttcaccatcaatctctaactcagtactccagagtaataaaacatccgtggagaaatcagacctcacctgggagttacaatagaaagttttcttttggaacacaatcatgtactaaactaagacaaaaagttgtcacatctgaggatgaaattacgagttctagatcagagggcagcctaaatgaattcatacatactagtcagtattttcctggtttgggaaaggggaatttctttggcattacaatggccaatgtctcttttaaagatctgtcctttgtggccgggtggtgtggctcatgcctgtaatcccagcactttgggaggccaagtccggcagatcacctgaggtcaggagttcgagaccagtctggccaacacggtgaaaccccatctctactaaaaatacaaaaattagccaggcgtggtggtgggcgcctgtaatcccagctacttgggaggctgaggcacaagaatcgcttgaactggggaggtggaggttgcagtgagccgagatcatgctactgcaatccagcctgggcgacagagtgagactcagtctcaaaaaataaataaataaataaaatctgtcctttgcaacttttcagtatagggagagagagagaaaaaaaagatttgtcttgttgagtaagagtaaggtcatggatgacatggtgtgacctctgctgaagatgtcttaacacctcgaatcgcgtcatgtggcagcttcttctagccacccctggccctgcacatggtgattatgagatttttctcattggatgggagccctggaattgaggtttcttggggtgtgtttttgtcctgtaggtttagtgacgtcgacggggttcctttggaatttcagcagctaagtccgccggagctgcagaaggtcagctcaggacatcggaggagctgacagcctggagaagctgtgcttgtctgctggtagggagcacttgtttctaaagcaagattctgcaacactgacagaaccagtttcccatactgctggtggctgcaaaagatgtttcaggcttgggctgcagtgtgcctgtctttggcactgccactgttccccagtttcctcagctccagatggagcatgtctcagggaccacacagagctttgtttaaatgctcacattagcagaaggacggggatcccattgaatcatcctctcctgtcaaaaagccaagagttgttcagaaggaaaaaacagtttttctcaaagaggctaaatctctagtactaattagttgcagtagtggcatgtgtgtgtgtgtggggggggggtggcatggtaatcttgtgcctccagtgttctaaataggggcaatctttttgctcacggtctgagccatcgaatgagtaacctcgacctcctaagacccttcactgggctcacgtgtgtgtgagtcccacaggaattgtggaatgcctctttctcttgttgggtccagacatttagaatgaataaattaaagggtagtggtaacatggtcattgtcattgcagacaatgtggtatttatatatgggcactagctgtctttctcatggggctcaggaacaagggtaagtttgatctttcatcatgaaccactggggtgttctttatacacagaggctgtaccagctgaaaatagcccaaacatcttgtaattttgtctttcccaatttttgcctattcatatcccagaataaaagagcctgttcagcctttccaaagatttaaagaacattatctatttgctttctaagtacccaaaaagcacaaccgtctacattcaccttggctggatgaggacatgcattcattcatccattcaagagatatttattgccagacctggtggctcacgcctgtaatctcggcactttgggaggcagaggtgggaggatcacttgaggccaggagcttaaggctagcctgggcaacatagcgagaccccatctctacaaaaaataaaaaattagctgggcatggtggtatgtgcctgtggtcctagctacttgggaggctgaggtaggggcattgagcctaggagttcaaggctgcagtgagctataatcacaccactgcactccagcctgggtaacagagtgagaccctgtctcaaaaaaaagaaagaaaaagaaaaagaaaaggggtatttattgaacacctactatgtttcaggcactgtgctagatcctaagtgaatatcagcacatgaacaagacaaaggcgaaaagttaccaaacaagtctaagttgatttcggtatatgcatcttcctgacttctggtcccgtgctttgaccacaacccttcaccactagaccagacttccccaaataaacaactacttctgcatgctggggatgggctgtgtgcggcagcatttacgtaggcggtacagacagcagcctttcacttaatgttgcaataacaccaggctaaacaatgtgcactgacttcaaaagtgtggggtcaggtctccttcaagtgccacagggagagtgcaaagtaggaaaagtctatcggatgaggaaacactgtagagggaaagtgaattttttttcaatttgggttaaaattcagatgtggaattctaccctccttttcacttttggatccccagataggaggaactcagcacatagataatcatgaactacacacattttggttttatatgctcagacttgtccagagcatgaaatccctgccctgttggaaggcagcgccgtgctcacggaggcacacaagcacctgtctcaaagtcaccctgacctgcagatctgcaaatggcaaaaataatttcacatgtttgttctgatttgtcttcatttttaggctaccttgtgtgagctccactttttagaatgtgattttgcagtcctgaaatggataccatgagcagattgagatgtgagaatatgttagaatgatcacaggttcggatgttagtggggcaggagagggagtctgagattgtattggcctatactgtggcttctggttgagcacttggtttgcctggatgatgctctggccttactcaatctttatcattccattatccagaggacagaggatctgagccccatctctgtattgcagtcacctcctctgggacctgtttccaagccttcttctgtgttgcctggcacccctttcttacctctttcaaaccacttactgctaccctgtaagctcgattgacttgttggtcttcctatgagactggaatctctctgagggtcgggacaggcctaccctcttcattacagtgagcaccagcctccagcccagtcaatagttttgttaaataaataattgaacaaaattatttgttaaataatggtttgtcctttccagaggatggacttagtttgtcctttccagaggatggatttagtaagtctccaactctggtcataatggtgccagaaggaaagagttaagctatctggaggaaataggctcactcaaagacccttcttcttttttttttttttaattggcaaaggcaggataagtgtatttgagataaatcctggatataaaatcttgacacatcttttaggtattggccgagatgctttggacctgaaagggaagtaaatcaaatcattctaggttttcttttcttttcttttggagacagaatcttgctctgttgcccaggctggagtgcggtggcacgatctcggctcacaggaacctctgcctcccgggttcaagcaattctcctgcctcagcctcctgagtagctgggactacaggcgtgcgccaccacacccggctgttttgtatttttagcagggacagagtttcaccatgatggccaagctggtctcgaactcctggcctcaagtgatccacccgcctcgggctcccaaagtgcaggaattacaggagtgagccaccgcacccagtcaggtttcctgttaagtggcctgagatctagttgtgaatggcagtcatggccagactcaggaattcaaagcttgacctattttgtctgaagctaatattaataataagagagatgtatttggcttcataacccctttccctcccgtccccctctttctttctgtaatcaaggatagaattagaagtaccgaaggccgcagaattgctttaggattcagagcagctccaaggaatctgtgtttacgtattatgtgtgtttttccgtttccctccctttttatgagtgagaaaaaaaagcgcctaaattcccaccaacataaaccaatgacatacaatgatgaaattctgttttcacctctgcctgtgacagggaatgcaaaaatagcaagtggcccagttccacgaatccccgcctcctgccctccccgctcctgccgggttggatctctaagaatggaggttagcgcacagcctcgcgcgggccgctcagcccccggacccggcggatgatgtcaggcgacgggagcggccgcggccgggccggggaggccgcggcccaggggagctgggagggagggtggcctcgccaggccgacggcgcgcccggccgcgcggcgttgcctggagacggccctggcggcgctgtgttgctgtaaacagccgcttccctgttactatctatagcaggatctcctggctcccgggcgcggcggctggaggcaggtctgcggtccggctccccgcgcgccccgaactatccgcccgccggcctcatcctgcctcgcccctctccaggtgcccaccgcgggccccgacccccgggcccgaagagtggagaagggaagaccggggctgtgcggggacatgcgtcttcgcgccctggaggtggccagcgcgctggggctgagccccggcagcgtgaccccggctgtcctacgcagcagggcaggagattggggggcgtggcacactctggagcaccttgcctccccaaagccccgtgttccaggacgtggagccgctcctggggtcccagcagtcgaggtattccgcccaggcgcagctggacactgtccttccagcccccgtcctccaccctccaagtccgcgctggaaaatcacccgctgcgggctcccgtaagcacagcttcctggcgggaccgaaccagccctcagcgcagatttgagttccccgcaggaagcacaccccgccttgtcatcccgaactgaccaccctgcccacataaccacacctcgcactccctacccctggggcccagctcagaaccgggcagacacccccttcaaatgtcttcgcacgtaggttttgcacagtgtttatctgctggtgtctcagggatttgacagtttccttaatattcccacacatggccgagaaaaataaataaataaatgcgctgtcttctttaaaaaaataaataaataaagtacccagtatcgtaaagtaggttatcgtattctcttattttggatcctccactttctgcttccaaacgcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcttgtaagtttctgaaaggtattattggagaccagtttgtcaagaagggtagctgctggagggggacacaccctctgtctgatcccttatcaaagaggacaaggaaactatagagctgattttagaatattttacaaatacatgccttccattggaatgctaagattttctactgcttctggggacgggaaaccgctgtgtaacagcttttgtgggaatacattttttctgtttcagtactcgcagggggaaatatttaaattttgttgtgctaatattaaattcagatgttttgatcttaaaggaaccctttaagcaaacagaacctagctttgtacagactattttaactttttattctcacaaaatcacgtggagggttattctacttcaaagatgagcaaattgaagaatggttagaataaacaactttcttgatattccgttatcggcattagaatcttcctgctcgttatcgtatccagcaggctgaactgcctcttgatacttggttaaaaaaaattttcaggccgggcgcggtggcccatgcctgtaatcctagcactttgggaggccgaggcaggcggatcacctgaggtcgggagttcgagaccagcctgaccaacatggagaaaccccgtctttactaaaaatacaaaattagcctggtgtggtggtgcatgcctgtaatcctagctacttgagaggctgagacaggaaaatcacttgaactcgggaggcggatgttgcagcgaactgagattgcgccattgcactccagcctgggcaacaagattgaaactctgtttaaaaaaaaaagttttcactaatgtgtacatttttttgtactcttttattctcgaaagggaaggagggctattgccctatcccttattaataaatgcattgtggtttctggtttctctaataccatatgcccttcattcagtttatagtgggcggaagtgggggagaaaaagttgctcagaaatcaaaagatatctcaaacagcacaaataatggctgatcgttctgcaaacaaaaagttacataatagctcaagaaggagaagtcaacatgactctgaacaagctttaacttagaaactttatcatcttaaggaagaacgtgacctttgtccaggacgtctctggtaatggggcacttacacacacatgcacacgtacaaaccacagggaaaggagaccgcccttctgcctctgctcgcgagtatcacgcaggcaccatgcactatgttttcacacacactgggtggaagaagagcttcagcgccagtcttctaatgctttggtgataatgaaaatcactgggtgcttatggggtgtcatattcaatcgagttaaaagttttaattcaaaatgacagttttactgaggttgatgttctcgtctatgatatctctgcccctcccataaaaatggacatttaaaagcaacttaccgctctttagatcactcctatatcacacaccacttggggtgctgtttctgctagacttgtgatgacagtggccttaggatccctgtttgctgttcaaagggcaaatattttatagcctttaaatatacctaaactaaatacagaattaatataactaacaaacacctggtctgaaataacaaggtgatctaccctgtaaggaacccagctggtgggccaggagcggtggctcacacctgtaattccagcactttgggaggctgagacaggaggatcactggagtccaggagtttgagaccagcctgggcaacatggcaaaacccagtgtgcttctgttgtcccagctacactactcaggaggctgaggcaggagtatgacttgagcctgggagggggaggttgcagagaactgatattgcaccaccactgcactccagcctgggtgacacagcaaaaccctatctcaaaaaaaaaaaaaaaaaaaaaggaacccagctggttcctgtaggtgtgcaataataacaaccagaggaagaaaaggaagacgatttcccagatgaagaagggcagctggaccttcggacattgacctgctcctggggacctcaatcatggtccctgtcagccccatgcttactctagagggtgagcattgctttccctttgacagccctggccaaggcccagacacagacccttgctctagcttattgcacagcccagtggagaccaggctgctacatcaagatggcgttaaaggtccagaaagaggaaatcagagaccatcggatccccagggttgacatcccaccaagcttcctgctgaccactttcatgggcttgagagaagaaattccttcctcctttctccagctaaatggctccttccaaatcccttttactcactcaggactggacaactctcagggattattaactctgggaaattttttgtttttgttttttgtttattttttttgttttttaggcagggtctcgctctgctgccatctcggctcacttcaacgtccgcctcccggcttcaagtgattctcctgcctcagcctcctgagtagctggaattacaggcaactgccaccactcctggctaatttttgtatttttagtagagacagggtttcaccatgttggccaggctggcctcgaactcctgacctcaagtgatccccccaaccttggtccccaaagtgctgggattacagatgtgagccaccatacctggccttcaactttcttttgaaaaagactttgtcggattcctacccacaagctatggcctcatgctaatctcaataaaacaactacctgccaggcgcggtggctcacacctgtaatcccaacactttgggaggccaaggtgggtggatcgcctgaggtcaggagttcgaaaccagcctggccaacatagtgaaaccccgtctttactaaaaatacaaaaaaattagctgggtgtggtggcgggcacctgtaatcccagctactcgggaggctgaggtaggagaatggcatgaacctgggaggcggagcttgcagtgagctgagatcatgccattgcactccagcctgggtgacaagcgtgaaactctgtctcaaaaaaacaaaaaacaaacaaaaaagaaaacaactaccagagagcaccactattcaacattgctaaagacatatacatataattgaaggggatagaggcagaagtcatttcctcatggggattatgtccagtttagctcaccaggatccccagaactggctcagtgcctggcacatggtacaaggttaattaatattttgcccagtggatgaataaattctgtgctatttccatacacagaaatatattccacacatattctttaacttctcctctcctggtccctgttagtatattaagcaatgggaattttacatcttttatgtctggctgcaaaaatataccccattcccatccttgcctcctggaattccttcactgtcttcctggatgacctctgccaattcaacttcaaagctgccattgggcttctggctccaaattaattttcaatgggaagagggaagaggaaaaatatttatctctgtagaatagtggattgtagattctgcatcatctttgcacatcactgcatcttgtgtaattatcaaaattaaagggtaggatttaacaatttgttctaataacagtaattttgtatcaacagcaattcccatgtgtgaatgaaagtaaatcaattatgctatctttaattaacggacaaaaaaaaattgaggcacagtaaaagttctcagttgattatcttgaggtaatcgtctaaagtttcaatgtttttacagttgaaaaaaagctaaaacaaaattgatctctaaatggtgtatgagactcattccaaacagagtaaccaaactcctcaaaaaaaaaaaaaaaaaaaagagatatgagcctcacttgaatgctgaatagcagaatgctttaaattgtgctgttttcctattaatattaaagagttgacttttaggaagtctcactcagggtcccctgtctctctactgaagagagagttattctcctttctctttcttttgcttattaaacctctactcctaaacaccacccctccaccaaaaaaaaaaaaaaaagttgacttttaattcctctcccactctatctcttttccttcttccctacaggcactctgctcacgagccttccttccactcctggcacatagaacacgtactcctgcagcagggcctctgcacttgcagtccctctgccggggcctcttgccccaggctggcggcatcctgtcatttgggactctgctcaaaggacatgtcctccaaggggctttccctggtcattctatctagggtgacttcgggacatacttgctccctaggactctctatttagttatcctgctttgttttttcacagcctgtatccctacttgcaatatctaatttatgtgttattttccttttaaaaaattgtctgtctcatcgggtgcagtagctcacgcctgtaatcccagcactttgggagacctaggtgggcggattacctgaggtcaagagttcaagaccagcctggccaacatggcaaaaccctgtctctactaaaaatgcaaaaattagctgggggtgggtggtgtgcacctgtaatcccagctactcaggaggcttaggcaggagaatcgcttgaacccaggaggtgtaggttgcagtgagccaagatcgtgccaatgcactctaacctgggtgacagagcaagaccctgtctcaaaaaaaaaagaaaattgtctgtctcttatccctgaactgtaagttccatgtgagcaggaaccttttctgtcttgatcacatttgtatctctagtgtctattaggccctcaagtgcatgttgaataaagaagatgaatgagtgaatgaatgcagatgaaaattacaaaaatattgacagggacatagctagaacttaaagtgaagataaactatatacttcacagatttttttcagggtagaagagtatgcccatttgtttaaaaaaattgccttcgaggattctacaatattaagatgaggagctagctagcttgggaaagaattttaaggggtacaaaaaatacaagtaagctgtaggtcagtgacacttctaggctaattataggttgagaaattgtttcgctattaaatgcagaatgaatgcatatataaatttagatataatcattttcaaagaaacaaacaaaattatgtttttcactcttactgctataaaactttcagactatcacaaaaatcccatttgagttcaatggttcctagcaatcagtgtgctaaatggtaaaacctataatttagtctgcattaaaatagaagaataagggttagctactatcattattatcacatcaacatcatcatcataattatcatttgccaagaatatgcccagacctgaggagaagcaggtagaaatagggtacattgaatcctgaggaatcagtgcaaagtctctgaagggggatggttggatagatttccatttcctttgcatgcgggagaaagcaacagaaacgtaaaccagttccgttgcaacacaatttattttcgtggttccacacatctatttttggactaaactaagttgcctttcctttgcccaagcattcttcagttgcttaagaggacacagagcagtaagggctctggagcctgcctggccttatggccatcagctctccatttttttttttctgagacggagtctcactctgtcacccaggctggctcactgcaacctctgcctcctgagttcaagcgattgtcctgcctcactcccgtctcagccaccagagtagctgggattccaggcaactgctatcatgcctggctaatttttgtattgttgtagagatggggtttcaccatgttgcccaggttggtctccaactgctgacctcaggtgatccgcccgtctcagcctcccaaagtgctgggattacaggcatgagccaccgagcccagccagctcttcttaataagcccttttccctttcagctcaaggtgattgggtttggtacagtcaggtgactgggagggctgggaacccgcaggggtttaattgttggttatgttagaagcagacccatacaaaggggcccctattaaagggtctagactgagcaaaacgaaataccttcgtgctaaatgtaagtgacccagtctccagttgctgccatgcttactttggggaacaatttttggtcaaatctatggaagcaatgatttgtttttaggctttttgtcagtgatgtgactatcatcacagctaaatttatcaaaacaatataatatattgatctaaatttggggaattggatccaatgtatgtatgtatgtatgtatttatgtattgagacagtatctcattctgtcatccaggctggagtgcagtggcacaatctcggctcattgcaacctctgcctcctggattcaagcggttctcctgcctcagcctcctgagtagctggtattacaggcgcatgccaccatgcctggtgactttttgtaattttagtagagatggggtttcaccatgtttcccaggctggtctcgaactcctgacctcaaatgatccgtctgccttgggctcccaaagtgctgggattacaggcgtgagccaccgcacccaggcaagaattggatccaatttagcagagtggtccaaagcatagacttagccctgaatcctcactcctagactttgggtaagttatttaacctctctgctccttagttttccctcctgtaagatggggataataattgtatccacttcttggggttgttgtggacattaaataagttggtatgtatagactgaatatcacagcatctgggcacacagaagtatgatagaagggttagttgtttttggctgggcacagtggctcacgccggtaatcccagcactttgggacgccgaggtgggtggatcacctgaggtcaggagttcaagaccggcctggccaacatgttgaaactccatctctactaaaaatacaaaaattagctgggcgtggtggtgggacctgtaatcccagctacttgggaggctgaggcaggagagttgcttgcgcctgggaggcagaggttgcagtgagctgagatggcgccattgcactccagcctgggcaacaagagcgaaactccatctcagaaaaaaaaaaataaaaaaaagaagaaatgttagctgcttttattatctttatagtttagggagatgggggtcaggggaacatgtatgggcttcatttcatttaataaaaagtttctgggtgtctgctatgtatcaggtattgaattcagtgtgaggaagagacaatcctgtcctcaaagagctcaagtaagggagaaagacaggtaaacacaaaccttataatacactgtaacaatggaaattaacaccaggttcaggagttacatggaagaggtagtgacaaactctctctgggggagtctctgaggaaggtgacctttcagctaggcttcgaaggtgtatggagcttgctagatgagcaagtggcagggtagagagcttctgggctgaggattagcactgcaagggcacagactcataaaacactgaatttggttttgctcaactacaaagtgtatgagggggcagtgagggggagatgatgaggaggagatgtaaattacagaacatcacgcaagtgcatttaatttcacttatatcaatattgcatcatcaaatagatggggctgaagatcagccaagaagagatcactgtgaccagatcatgaaaagcctggtgcttacttagctcagttacgtgtaggctgaaccaaggcagtggtggtgggaatggagagggaacaagaggtaattagggggtcaggacctggtgattgagtaggtggtggaggtgagggagagggaggaacccaagctcaccgtcaggtttaccaggcttgaaacacgggaggcttgtgtttccaccaatggctttgtgactataggaagaggaacaggtttgggggttaaaaaggtaaattctatgttggacatgttgagtttgcaatgcctggggagtatctatggggagatgtgggcagttggaaccacagcagaggttctatgatatgagtttatagagcttgtctggaggcaaatggttgggatagaacctggagccttaagagaaaatattgataatgcccagtatttcacatgtgcttgctctgtgccaggttgtgctatgcactttataggccatgctaaatcaatgactttggtttgctaatcattgtacctctagcaactggcacgtaatgggcatacaataattattttgtttaataaatgctctcatttagtcctcacaacaatcctatgaggcagatatgattagtgtcattttacagataaggaaaacaatttaggaaaggttaaataagctgaccaaggtcacacaactggtaagtagcagatctaagatttgaatccagctctttgtgactctaaaacccaaagtgcttaactgcattgctagaatgtgaacatctgctcttaaagatgtgcttatgtgacctggggtgagatttcaacccctctgagactatttcctatgccagattaggggtgggattcaaaaatctctaagctccctttccatcttcaaaactctgatgacatcaggagactgctacgaaaatgccctaaagtgcccgcaccacatcattcttagatgcttgatgttctagtagcaacactggggcatgctctgcagttgacactccttgtaatcctctcacggaacctttttaagatgggaggcctgagcagtgtgtacagagccacagaagtgtaccaagcatggggaggtgggagcagtctgttctagggataggcaatgagaatgtatttggttctatttctgtataacaatttaccacaaacttagcagcttaaagcaacacacatttattatctcacagtttctgaacatcaggagtccaggtatagccagttgcttatctagcaaactccatccatcttctgaacagaacagtgttgtgttcaaggtctcgcgaggctgcaatcaaggtgtcagctgagctgtgttttcagctggatgtttgagtggggaagagtccacctccaagctcactcaggttgttcacag

SEQ ID NO: 1595 - DNA, 1178 bp, Homo sapiens
atgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaa

SEQ ID NO: 1596 - protein, 380 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 1597 - DNA, 23951 bp, Mus musculus
  misc_feature (1)...(23951): n = A,T,C or G
acatataggcctgagctaacctggtactcgctatgtagaccaggatggtctgcctctgcctcctacatgttgagactaaaggcttgccttgtttcatttgcagggttctgggatagatgcttaagggagctgaattaaaggacagtgatcctttggtgtctgagggggactggtttcaagcctcccacccccagctaccagattacttccaggttctagaacaatatgaacaccacgtgaagagttgttaaacagtactgtttagaggacagtgagaagaaaaaactttacatgttcaatacagaagcagtttatcttgagaccgggtctcttgtagcccaggctaccttcagcgtcactagggacctgaggctagactctagctccttagtttcctgcctccatgtcccaagtactaggattgccgatgtgagcctcctctcctggccttgaatgctttttacatttttattatttctaattgggtgcgtgtgtatgcatatgagaccatgtttgtggttatgcgctcatgagcgcaggtccccatggcgatttggagctcacattataagtgtttgtgagccagctgatatgggtgctgggaaccaaactcaggttctttgcaagagcaggactctcaagtcctgagttagctctctaggccctgacagatgacttcttaaaaggaaaatttcaatccaggtgattgaatctatggatgtgggacatgaggattttcagagccacaactgagaagatgaagagattgataaaatcaagtctacagaacaatgcactcagctgatcagccaatatccatttgacaaaaactggcaaccaggccctcgtggaggccacaaagagggagctcgcaacccatatggaagagagctgatgtttttagagatgagatttgtgttgtacgtttctaaaaggccagggaaaagggtagaagcagaaggacccattcacacaaagacaaggaaggtgacagatgtgactgctcaagagcacagaggccaactctctggagctgtgctcacagggagctgagacagctgacggtcggtcagtgcagccagggaagctctgattccatggacagacataagcagacccacgttttagaaatttaatgtcatggctaatatcattgagaaagcagcatcaaccacacttacaacatccacaacacacacctgactacatgatgtccccgtgggctgtgagggtgtgctaagccattcgctccacatcttctcttactgcccaagaaggtgactcttgccagcattcatacacatttcaagtaaaaattattattttgggggcgtgagacacaactgcctgtaactctagctccagggggtcgaaagccctctcctgacctgtgcatgaatatgcatgcatgtgtatgcacacaagaggagcacacaccttcacacaaacacacacacactcacaaacatataggcactcctcacacacacaagcatataggcactcatgcacaaatgcaacatgtacacacacacataactagaaaggaggtaaatatttagaatattttcatatatacattataatattcatgatcaaattgtcaaattatcacaagaaggaacatttctctcttcaacaggggcaaaccattattattacagatgtaacaataatgaagttttcagtctgtcttaatttttcaagtcaatttatttatttatttagagacagtttctccgtgtagctctgcctgtcctagtacttgctctgtagatcaggctagcttcaaactcacagagatctgccagcctctgcctcccaagtgctgagatcaaaggtgtgcaccaccatacctggctattttaaattttttttcatttgaatgtccaatctttatttaactccaactccaaaaaaaagactgataaagcgtttcttagagtaaggttctgggtgtttgtttgtttgtttgtttgtttgtttgtttgtttcgagacagggattctctgtgtagccctggctgtcctggaactcactttgtagaccaacctggcctggaactcagaaatctgcctgcctctgcctcccaagtgctgggattaaaggcgtgcaccaccatgcccagctatttaattagatattttcttcatttacatttcaaatgctatcctgaaggtcctctatatcctcccccctatttttaattttttaattagggctggagagatggctcagtggttaagagcactgactgctcttccagaggtcctcttccagaggtcctgagttcaattcccagcaaccacatggtggctcacaaccacctgtaataggatctgatgccctcttctggtgtgtctgaagacagtgatggtgtactcacatacataaataaatctttaacttttttaattaaaaatatttttgagacagggtcttacttgtagctcctgggtaacctggaactcactacatagtgggactaaaggcttgagctaccgttcctggctctttattttaataatttacaaatgtcttattcaaactgaaaatcccctaattcgtctgacccaccaccccaactttctcccagtagtatatttccctacgaaggtactgcagatgtcactgccctctggtcctttgcagagcatgggaacttgagtgtctctgcctggggtggaggctgatgccaagggcagatatcactggcaggcctacaaacatcagaagagcaaggctcagggtaataggaagcagaaataagtcagctctcccagtcaagtagtgtgtgtgtgtgtgtgtgtgtgtgtgtgtgtgtgcatgtgtgtatgtgtgtgtgcgtgtttgtgtgtttttgtgtgtgtttgtgtgtttcttattgcacctgtaactcactgattcagctagactggccagccaggccctccaaatcctcctgtctctgcatccccactgggattacaggtacacaccaccatagctgggttttctgcggctgctggggggcatcacgcttgtgtgtcaagccctttgctgctcacacctcttcagccccttctggttcaagaggagcaaacagaggtggaaatctgtagaagggaaattgatagaaaatggtgaatctgcttaatggacagagaaaccaatcagaggcagctggggtgtggctggggttagaagattctggtaactaggagctgctcttgacatcacaaagcccaagtttacttgtctacaaaagtgggaaaagaaaccagagtcaagactgtcgtgagacacagtgagtggccatgtgggacagcttggtggttctgagaactttgtgctctcatctgtcctgcctctgttagaaccctccccagcggactctgggtgggtagaatacttccaagacacttttgctaaaacagctccctttttatatcttctcccagtttccccgctttacctgatttcttcatagcagacctcagaacaggtttctgcttcccctcctagccccacagtttcctgagagcagacttccggtcttaatcaatgcagcccttccacggcagaggcctggcccaagcaggtgttccataagcagctgctgaataggcagttaagctagcaatgcctcatctggtttcaaggatgcagggcagcactgcagtaaaatagcaatgactctcaaacttgtttcaaataagattcttgggttcaggtgggtggtagctctcaattcttgggcacccaaaacctaaacaaatctggggatgtagcctagttggtagagtacgcacatgtaatctctgcatgcaggaggcagaggcagggggatcagaagttcaggttcactctgagctacatagtaagttcaaggctaccttgggctacatgagacccagtctggggtggggagttcctggtccactaccagggtcctatttattctaattaaatcaatggactttgctatttttaaaaaagatttattttacatacatgagtaccattgctcacttcagacacaccagaagagggcatcattggatcccattacagatggttgagagccaccatgtagttactgggaattgagctcaggacctgtggaagagcagtcggtgctcttacctgctgagccatctctccagccctggactttgctattttaaaggagcccccaggtgactctgttgctctcactctggatctgactgaccaggcttagtttgacttcagcctgtcgcttaccagttgtgtacggatggtgtagccaagtatccccctcgatggctccgagcccagggatgttggataagctgttcagttggtcctatcatcttttgttattgttttgacgcagggtctccctatgtggcactctctggctgtcctggaactcattatgtagcccagactgtcctctaactcacagagatccatctactctccctcatgagggcagcgatttaatgtgtgcaccactacaccctgctatcattatttattattctgctcagatattcttccctgagaggttctcttctgggagcttctcataggcctcaatgaacatggtgtggtagctagttgggaatgcagaatctctgctctggtccaggttggctgaatagaaacccacactttatcaagctcccaaggtgatccctttgcccattcgtttgaaaagcatagctctaattggtatgcatagttttcttcttgtctttggcttcaggagtctgtcccaggggttccatcactctggccttcctgaaccccaggagcagttgatgttcactctctgcgtgtgaagaagacccttcagcacgctctggcccacctctcgctgctcaatttagcagggctctcaaaggccctgggctcctcctgggagctctgcatgagcatccggagaggcaggacatggatccacctgctgctgtcttgcttcctcctcagtctcggacctgcacccacctggcagaagaaacctgcatggaccaggagagaagcccagccaccgcagaggcaggcagagactcgtttcccagtggtcagctgcccagctccagcctcactgaagctgactggttttgggacgagcacatccaggctaagagggccagagtagagaccattgtccgaggcatgtgtctctctcctagctcgtcggtgtcaggcagagccagggagagcttgcgctgtccagaaaagggtcgggagcggaagagaaagcagagccttcccatgcaccaaggtcccctgaaatctagccctgcctgggagcgagggcccaagaagggggggacccgggtgaaagaacagcttcatctactgaagcaacagctaagacatttgcaggagcatgtcctacaggccacagagcccagagcaccagcacagagcccaggaggaactgagccaagaagctccccgagggcaaggccgaggaacagctgctcattctggtgcctggaccgtggagaacgagcctcaccagagttctagcaaggacctctgtggagcagtaaagcccggagcagctgaggtcctacagtactcagaggagccgatgctctgtccttctggcccacgggccttggtggagactctgaggaaagaactgagcagggccgtgtcccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggttcccttgggcaattcaacactggcaaggcctctagattctcctatgtgtcctgtctctccaagaggagtccctagatcatatcagagtcccctaccaaattgtcccttgacaaatgtaccttcccacacctgggaaaatcagatgcttaggcagcttctgggtcgtgggcccgatggccaatggagtggcagccctccccaggacgcagctttccaaagtcatacctccccagagtctgcccagcaaccgtgggggctgagccagcagcagctccccctgtctctcaccccggtccatctggaaagccggcccctcccaccgcctgtgaagatggagcagggcgtgctgcggggcgtggctgactcacttcctttttcttccatccacatatcctttactggtcatggatgtgtcatggtccccacccagagaaacaggaaaccagaatgtgaggagcgagcgggaatattggagttatacaaggaatggctttaatttccccgtgcgtggttttgttgttttgttaacagagtctcactctttagaccaggttggcaagaaactatgtactccagctagccttgaatcttggcagttcgactacaacctccaaagtggtgggcttataagcatgagctacgatgcctggcttttttaagttctacttaatatgcttctggcctaccttcctcgagcctcaaagcctactaatttcataactaagtggaaaccgtagtctaggattgaagtattttgggaagatacgtttacttaacgacccatcagagtctgctgtaaccgagtgctcctttgggtcggaaatagttttgttttgcttaaactcatatgggcttccaaaaataagagaaacaccccatgggtggaagaactctgcatataattgggctagcagctgcccattctcccaggcagagaaggccaaaggagcaacctcatctgaggtctgacctccccaacctcatgttcctcaacgcagaaggtctgcacagtcctggaagtcatggtgaatatgtaagggaccaaaaacgaagggctgaaagggtagtttccctcagagaatttgatccccccaactcaagcagctgggaagggtggggaagtcttcaggtaccggtggtggcacacgcctttgatcccagtacttggaaggcagaggcaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgcctctgcctcctgtctaagtgctggcattaagggcattcccctcccaccccccaccccccaccccacccccagaaattaaattagaaaaatatgtagcttggttagtttcttaactgtgagacttctggggcctttactgtgttcaagtcagaggtgaagcttcaagacaatataggaagtctgacctcttaaagagctaaagaaccttccaaccagcatcttttagaattagtgtacctgaaagcttttttgtttttgttttgttcttttttaagcaagctgagggttgagagcttctcactggccttgtgaagccttcagattcacacctctgaagttcaggtgtaaacaaacctgtatacctagcagctagctagctacaaggctctaagccctggggggccagcgccagtcactgtctcttaagttctatgagcgccccctgctggtttacggcagtagattgaacacccccaagctcagacttccctggaaggctatggaatcctaaaagcaaagctaaaaatcactttattctctaccattccctcaatgggattaagaatatcctgttatacagactgggtctaaggaaatgttatctgtctgggcctttgagcctgggtagatggctctctgggtaagagtgttcactcctcaagcatggaggcctaagctggaatctccagcacccacatagcaaagctgcacatgcctgtaacccaatgacaagtcaggctgctcttgcttgagagcgtgctggccagctagcctagcagagtttctgatccaatgagagatctccaaccccacggaagactgccgtcaatctgccaacattggtaggcccctgtgtgtgtttgcccctgcctggtcaaagaggatgagcttcaggtttggggatctatcctaagacagccctagcccaggcctggttccaaatattccttccctgaatcctgctgcctgtggtatgcactttgctttctatgggccatgggagccacacgaagtacaagtgtgcatagccccatgcatccctaacaccaggcaggatggtgatgatggcagtgtttagtgggtcacaaacacatctgccaccacaccataccacaccacaccacactctagaagccccaggggcaatacaaatatcttgggtggtgtgacttactggaggcaatttatagactttctcccacttagcccccatccccctggaccacattagccctttataaaataacagaaattctgaacccaactccatttggcccagtgtctcagataagggtgtgatggaggaccaggtatctgagaggcaggggcaaggagcagacgaacttgtccaggtcacaacacaggcgaataaggatgcagctttcaaacccaggatctggtggccaagcacaagggtttgtctgtttgagacagtgcttatctctgtagccctggctggcctgtaacgttaatagaccaggctggctttgaactcacagataaacttaactctgcctcccaagggccaccactgcccagcccaagttttacccattacaccacattttagaaagaagccccagagaagtgacttgcccccagctcacacagctaacaggtggccaaatcagtaccctaacttaggaaatttgggttccccaatctagattttcagtttttatgaaccaaggggggcagggttttccacacaagagactagtcacctgagccagctatattctgtggattttcttacagggaccactgtcctacagctccagtgaacggatgtgatacccacacattccctgtgttactctgtggaatggtccttagcagccttaggaccacccatgcttactctagacattcacatgcagagggcagccccacagaactcctgctagagttaagaagcaaatctgttttagggggaggggtggcctgaagtataactttttatatgtatatgtggcttagtgttggccatccactcactctaacgtgcatctattgaacgtctactatgttcctggcactggaaagggtatgtggaatacacagaggttaagctcgagcccttgtctgcagggagctcacagtctaagctggggagacaacacctgtagtgattgagtttaatgtcacaacagaggtttgtacagggagcctgtgagctctggctgagcaaaacctaactctgtaaggaaaggtagggatcacaggagacccaacttcggagctgtggctcagcagacaaggggaagttcagtctacctgtgactgtggcagagctgtcttctcctagtccattccgaaaaagcactcaggttacagaagctgcgccagtgccatacaagccacgaggtgtgacttctgcacaccaagatacttgagaatggtgggggatggcttccggcttatctcatcagctcccagaggaacaagtgacagcaaatgcaccagtcaagaaagaaagacaacagacagacagacagaagccacagagatacttggataatctagtaaaaaattatttgatgatctggttattattattttattaactttttttggagacagagattcatgaattctaaggctagatgcccttgaacttctgatctgtctgcctctacctcctaattactgggattacaggtgtgcatcaccacaaggtttaaaacttaaaaaaaacttcatgattttattgtcttaataacaaaactggcttaggctggatcgcttcccccttttattgtctcctcattcaaaatgcccacgtctcctaacaccagggctggcttggctctgcagctaggctgggcagtcactaacaccagggctggctcggctctgcagctaggctgggcagtcaggcctcagcaggcttctgggtagctctcgtggaagggcttaggctgcttcctgtcataaaggctgcttgccttgggcagatgggatccctgcttcctctacagtgtcgctttgtagggctggcgcgcgcgctgcatgtcttgcagaaatggtccccatgtttgcggagatgccgttggcacaggatgcaaactcctgttttaaaaattcttttttccttgacaccaaaacacatccaggaaggcctgagccctggtcacctgaagaaggccaaactaatgtttttcttcacgcggtaccccagctccagcctcctgaaagcttatttccctgatgttcaggtaaagtcacacaatgcactgcagccttggtctaactcctcagttgctgtgtgtggtgcccactgtgaggcaagtcctaggtcttcacgcacccgttatgttaatgacagaacagatgcaaccccgagttctaagactgcctgaaacaaacaaccaaccaaccaaccctgggatctccttaccctaggagtgagtgggtttcagggtgctcaggcctgggggcagctgaccatcccagaaggaaatgggaagtttaggtcgaggaggaaagtgacggcagcaagaggactttagttggggaattactttttggtacaatccttatgaaaaagaatggaggaggctggagggatggctcagtggttaagagcacttgctgctgctcctggggaggccccagatacggttcctagcacccacatggtagtttacaaccatctctaactccagcccaggggatctgatgccctcttctggcctttgtaggcaatacatacatgtggagcacatacatacatgcaggtttactcatacacataaataaaacttttttttttttaaactgggagttgaacccagggccttgggcatagtatgcaagagctctaccacctataggctcagtccaaatctttttttttttaaaagaaaaaaatgtgaaccaggcagtggtggcacatgcctttaatcccagcactcaggaagcagaggcaggcagatctctgagtttgaggccagcatggtctacagagcaagttccaggacagcctgggctatacagagaaaccctgccccgggggggggggggggagggagggagagagagagagaaagagagagagaagaggagaggtgggggtaaggaaaatacattaaatgtaaggggctaaggctgtaactcagtggcacagcacgtgtctagtgtgcacagagacatgggtttgatccctactcaaaatataagacatcatcaaacttacatccgactgctgtgtctcagaactgagtggaaataaatacagattatgtgcaactgtaaggaaaatcaaacaatgttagaaccaaaaccctgcatgcatctacaggcagtttctgaaatccactactctaggttgtgaggtaagggcacttaatactttgggcatacctcagacccatctctgtgattcccacagtaaatactgattcacatttccattcgttctgaaactccagttgtcaggggactgctccctggcccacatccttaccacaccccttggccagttacccctccgggctgtaagtcatgcttagacatatggacaaaagcctaaaagtcttttatagacataacatcttattttccagtaaacaccggattttgtagtctaactgcatgggattggccagtacctgtggttttctttttctgaaggaaaaatggttagtgcttgagccaatttacatcaatctcacactgaagtgggcactgacagttctgacaccgagcacctcgcagcaaatgtctgacttgatggaccatttgttcacacagttcaaccgctgcatcacctcccagatgatcaagtggttcagcaacttccgtgaattttattacatccagatggaaaagtatgcccggcaagcactttcagacggtatcacgaacgcccaagcactggctgtcctccgagactcggagcttttccgagttctcaatacacactataacaaggggaatgactttgaggtaagacatgcactgggtcccatgagatctaagatgtgcattctcagaatggttggccgatggcagtcgtaaggttgaggacagcctttctcacaagaggtctaaggaaaagaaagctcaaccctctcatttcccacactcattaaaacatacccagctggtagaaccgacaagtcctggaaggctctaatacccaagactgctctctggatggtgtttcactagggaacagggtagtcttgggctgcagaacccagggcagcggggcagcagggcagcagggcaacaccagccaatgggctctctatggtgcctcatttcttccttttcttggggggtgtctttggggctgcaggtcccagactgcttcttggagattgccgccctgacactgaaggagttcttcagggctgtcttggcagggaaagattcagatccttcctggaagaaacccatttacaaggttatctcaaaactcgacagtgacgtcccagagatgctcaaatcacccagcttcctcccgggactgttcccgagttaacattgaacagaatgagggcaagtatgatggcacaggcctgggagtccaaggtgagaggtggaggcaggtggatcaggaacttagggacagccttggccacaaagacaaagatcaaacaaaatgagtagaacggcccagggtggctcaagctttgtcataaatggcagtttagctgtagtcacatcaaagcacaagaggaacccctcccatagatgcaactgccgttctgaatactcgttttcttgtccagaattatcagagacttaaccttaaccacagtccatcagctaaatctagcagtgtgtttgtagactattgggaaaggaacacaagtttgcaatcagaagacttaaaagtcattaagtgctgtggcagtgataatttcctggtattcctttaactctggaaggagattcatagccaagtggtggtggtaaacaggtttaatccctgcacggagaggcagagataggtggatctgtgaattggaggccagcctggtctacaaagtgagttccaggacagccagagctacacagagaaaccatgtctcggaaaacaaaaacaaacaaaacaaaacaaaaaatcaaaaaagccccaagaaattttgaagtgtgggtacctcgttgattcttacgccagggcacaggatcagtcaggactatgaaggaaccgatggctgtgtacgctggactcatgctgtcacttgggatctccaacaggaaaaatccatgctagcagggcacccgtggattggcactgccatctgatcaggttggcactcaggagcgcttcatcatccaagacgttcactgatggcttcggcaaacttcctaaagaacctcggtcggcactgctgtggcttgcatctgtctgctggaacactgggtctgctaacagtcctaacagtcctacttgacctatatactggtgccccaactgcccatgcatacaaaaatatatataaataaaaaatggaacttcataatgagaaagccagaggggcctcgaggacgatctggtccaccttgtttaacctgtggaggaaactgagactagcatacactctacagggctcacaggccatgaatggcaagggctgggacaaaggcagagattttcctacttcaaaatggttacagtctatgattgaatttgcacagatgaacaaatgacatccaagttttcccccttgggtccaacacagttgtgactgacgctgagcaccattaggcgaggaacccatatagtggaacaactgtcttctagtcagaaccaagcctgtaagcactgctgaaggtgggcaggacgaagtagacttcaggttttacagtgttaaatgaggggcaaccgtgcctacagtagctcccttccctgccttcaacctccaacaagctccacatctagctcctctaccttcataacttgatgggtggtggtgttggctattgctagacatgtcagactacaccaatacaaacaaagtctttcctctcaagtttctgttcaaatagtggagaacagtaacaaaacataattaaatctaatcgattacttaaggttttggggtgcttgttttactggatactaatcctagtgcctagttctatcactgaactccattcccagctatgaattgtgtatgtgtggtcttttgagacagggtctatgtagccctggctgtcttggaaatatgtagaactggctgtcctcaaattcccagagatctgcttgtctctgcctccagagtgctgggattaaggttatatgccaccacacccagggcaagtcttattttaaatgcccctcaatatacctaattatatacaagtatttctctaatttgttactatgctcacaaggccccctttcatcaaaaccaaggaatttgccaagcctaagttttgagtattcacaagcagagtagcctgtgcaagggcatcagttgtttgggaacaaggtaactctccagagcaatgttacacagctagtgggacagtcataggaacaactccacagatccatatgactgtcccgtctcaaacctgagggctgtgaactttatcctgaatgctaattagatgggaaaaaaagtgctagctcaaattgaaaacatttgtatactgcagccatgccaggaagcattctctaaccactgagctcgacacagaagaatgtataaatatgtgtgccctgccagttgaagaattctgtcttattccagtttcctgtgtctaccaagtacgcttttgtcagtgttgggaacttattgtgagcatgagtggagccagttatgttccttcagaagtcacaacgctgccaaaggtctggtcaatttttccattaaggtatatgtgagtgccagatctctctccagtcagacatactcaagtactgtataatgctatactccttcagtggcagacaatagtcataggctagggtaggctcaatcacctatcaaaagcaggcagttctctgatggtctcctgtagagcagatacactaggaactttttgttgaggcaagtctgtctaggtaaccctaactgcctagaatgaaccatataaagcaagctggcctaagataagcagggattcttctacctccccagggcaggattacaggcacgcagcacccagccgaagataccttccaagtgctgggattaaagatgtgcaacaccaggcccctcttggaggtctattttaaactagtctcagggatggggatttagttcagttggagtgcttgtctagcctgctcaaggccctgggttctagctccacataaccctagtgtggtggcacaaagctggaaattcaagcatgtgggaggtcagaggattataaactcaaggccactcttgagttcgagacaagtctgggcaagttccagactggcttaggctatataagatcttatctcaaaaatagaatccaactaactgaaatttcactggtttcccgagtagttatcttctctctccactatctgtctgtctgtctgcctgcctaccagccttccttccttcctatctatctacctatagtatgaattttcataattatccactctagtccccatccccttttgaggtgcaagaactggttctgtaaagtagcttaaagtttcatgatatgtacatccccaaatgaaactcaaaatcttttgatggattcatacaagctgtaaagtatttgcatagacctcacatgttgcaacatttctcaacactgagaagttaggaactctgaggactatagtgatgggttggcgataaagaacactctaccaggctgactgaatgatgtacactcacgtttgaagtactttctacttctctcctccgtccctcttttttgagaggagtttcagcagctgaacccagggaatccatcatgtgtgctaagcacacaccccaccactgagctattctctgaagtttctaactgcctttagattagtgcttagggaaaagcttacaatatagcaaacatggtatttctcacaatattctcagtctgatatacagtaagttacaggcactaatacaaagagcttctgtgtcctacattagtaactagtaatacacaccacagtcttagtttcttttgctgtaataccctcacaaagcaatgtaagaaagaaaggatttattctggctcacaatacaagggtatagttcatcatcactaaagtcaaggcagcaggacatacctcatttatgattggaagcagagaacaatggacgctaatacccggctgtttctccatttaacagtcctgggatccctgcccagagatgggtgcagtccaaactaagatggaccttcacagacattcacagaggctaactttaatctagataacttctcacatgtctgcccaaggatgggtctcctaggtgattctgggtctaatcaagttgaccaccaagaccaaggatcataatccctgcagtaaacctgcacctgacacatatctataaaatgttcacctatagaagttgattcattacaaagtattttccagggttagacaatttctatattagatgatactgacctgaagagaataagcaagtgcttaggacagttgttctcaacttgtgggttgtggcccctttgggaggaggggagtgtcaaatgaccctttcacagggatctttctaagaccaccgtgcatatcagatacttatgattcataacaggagcaaaattacagttatgaagtagcaatgaaaatagttttatgccaggcgtggtggcacaggcctttaatcccagcactcgggaggcagaggcaggcagatttctgagtttgaggccagcctggtctacaaagtgagtcccaggacagccagggctacacagagaaaccctgtctcgaaaaaccacacacacacacacacacacacacacacaatagttttatggctggggggtcaccacaagatggataactgtattcaaggattacagcattagaaaggttgagaaccactggtctagacattgaaagcagaagggaaacacccactagggaaacacaagaggtagattgccccaaacagcacaggctttacaggaccacctacttgtagtctggtttctcttggaccaagtcttcactatctggcttcttgatgcctacaactgttttttaccatgtctaaatgctttttactctcagataccagttctttctcttggaacgtgttttctccctgtttcctggcctccgtggttcaccctctttcaccttatgcaagaacaccatctctccctgccagttgctccactcctcaggcaggggtgacctaatgccattccagcatctttcctaagaagcctgtgcccagggacctcccagctatggccctgtgtgggttaccttctgttctggcctcagctttgccatttttaaagagcacctatctcctagtactgtcctaggtttggggaagagagtacatgtgagatgtttagcactcctggtgcatggtatgttccctggcaatgttagccgtgtgcagctgtcaaactgagcaaagacatcccagtgggaaagacttgagagaatgactatgtggcactattgataagacatacttggatctcagttttagcaactatgagattgaacatatactaatgtgttctatgcagaacacaatttggctttgaacagaagttaatacattgtgaggaagactttagtgaagaagctccactaacgccatgcactgtagactttgaatgtctttgcttttccttaggacacgcctatgctgctgtgcttggcatgctgtttgctagtttatttctaaagcttgcttttatagggcaatagactccatttctgacatccttctaatcataggtaattagtctatttctacaattatataattttctatctttaacagatccattgaatagactgtttttaacttgaatattttcctaattaacttctgtaggttttctttttttttttttttttggttttcaagacacggtttctctgtgtagccctggctgtcctggctcactctgtagaccaggctggcctcgaactcagaaatctgcctgcctctgcctcttaagtgctgggattaaaggcgtgcggtacccccggccggcaacttctgtatgttttcaaagcaagtatacagtttcacttataacaagaagttgagtcttttttttccttctcttttctttgagacagggtctcaccagtgaaggcctagatgactagaaacttgttttgtttttggagacagggtctctttatgtagtccttactggcctggctggtttcaaactcagagatccttctgcctcagctttcctagcactgggaatacagttgtgtgccaccacactcagctaacgggagacattttaatcttggttttatgtgtttgtcctaagcctgtttctcccagtatgttcttttgtggcatgaagtatctttggaaactaactctctgaggctaggtgaattgtaaacatttctaaatttctattctattctattctattctattctattctattctattctattctattctattctattctattctattctatttctattcttccctcccttccttcccccctttcttttcttcctcccttcctccctccctcccattccctcaattctttccccactccttccctactccttcctttctggttgaaactggatctcatatcgcctgaaccagccacaaatttactatgtactagagctggccttcaactccatgtcttccagtattggcctctcatgtactgagattgtaggcaaaacacacacatatagcttatcttctacatttggaatttgtggtgttcttccaacagatctgggacatcagcaattgtttttaatgaatgaattgtaacctggagacaaacaaacagaaccctctttaaggtctcaaggtcaaccacagttgagtactaccttgggatctttaaaaaaactgccaatgggccaggcatggtaacgtaaacctacagtcctagtcctctgggactgaggtgcgatggctgtgaatttgaggccagcctgaactgcaaagttaaattcttaacaaaacaaaaccccacaactacaacactgaggctgaggaatgggcgtctgccacccagcctgacaccacagtctgatcctcagaacccacacggtggagaacactgatgcctgcaagctgtcctctgacctcacacatccactgtggcatatctgcgccacatacacaataagtaaatataagattataaagttattttttaaaattaccaaaggccacatgtgtaatgcaaggcagttaagtttaaggccggctgagtccacattgagacgatctaaaaaaacaaacaagtaaaaaaaaataaaaatatctgagtcctaccctaaattctgatatgcaaatatgagttttacctaatcttaggagttttaaatgttccctgggagtttggaggaaaccaaaaccaatttctttcacatgacttcacatagcacacacttcctacatcactatccttccaaatatgtacacacaatgaaaggggtaaacgtagttaagtttactgactctaagaaagcatcccaccatgacctaatggattctcaaccctgaatcttcatttatcagtaactttccaactaacagcaagaccggtagagagaaaattctcaggtcatgttctcttaataaaaagtttagtaatgagctgggcagtggtggcgcacacctttaattccagcactagggagaaagaggcaagcaggtctctgtgagttcgaggtcagcctgctctacagagagttcctggacagccagaggcacacaaaaagactgtctcgtaataaaaaaggttccatgcctaactaaatgaatagttctcatgtaaagtattccagtattcactacatgaggtagaaagtgcctagaggcagtcccattttaaagccattcgatgcctattttaaaaacttaattttgaactagaacctattctgtttacatatatatgtgtgtgtatatatatatgtatatatacatatatatacatttttttaaaaaaagatttattttatttattatatgtaagtacactgtagctgtctttagacgccagaagagggactcaggtcttgttacagatggttgtgagccaccatgtggttgctgggatttgaactcaggacctccagaagagcagtcagtgctcttaactgctgagccatctctccaggccctgtttacctatattaattccaaacatatattaaaccttagatttaaataagggtatcttaaaaactggcttttttttgtttttcgtttgttttgagacaaggtcttactgtgtagtactggctggcctggaacttactcatgtccatgaggtataccctgaactcagagatcagagtgctagactaacagggaacatcaccatgtctagctgtacctgtacttttaacttatgtgcatttgtaagtgtgggcttgtgcatgagtgcagtgcctggagaagaccaggcgttgcatcttctgcagctgtagctcaggggagctaagaactgccgggtgctggaactcaacccgttcctctgcaagagcaccagacacttttccatgacgactcatggcttgagccccaaactggcattccaaaatgtcaagagtgctgggatggtgagagaacctggcgaataaatgtgcttgctgccaagtctgacgacttcattttggctcctaggatccatggaagaacaacagattcctgagcaggtttacacaaggatgaaaggggtgttcgaagctaactatcgaccaccaaaaaataaataggtgccattgtagggtaaaaatccattaaaaaaatgtatctcaaacattgttaattttcaatttctaaaacagtaattactaggaataagtaaaagagaaattatttccccatggcccagggtttagagtcttctcgactttcactggaaaaatgagagcatatgcacataaggagcacctgcaaggatgtgagatgatgcaacaggagggcagagactcagtggggggaaatgtgtgtgtgtgtgtgtgtgtgtgcgtgcgtgtgcgtgtccgtgcaatggcacacacctttacctttaatcctgaaaggaaggcagaggcaggcagctctctgtgagtctgaggccagcctggtcaacacagtgagtttgaggacagccaggcccacagtgagaccctctctcaaaaaacaaacaaacaaacaaacaaacaaacaaaaatctgaatgcatacacaggaatttatgtgcatccaagatagtgatgtacagaaagtgtgagggctctcacaaatgttaaacagactatatatttaatgtacctgtctgtacatttgtacaaacaagaacatatggaaaaccaaccttcaaatgaaatggcatcactaaatacttcctaaagggggatggtgagtgttgataagttttggctgtaatatttaaccttaataatgaaaataaattcatatattgtgtctggaataaatacatcaatttaaaacaagagagagataatgcccaatactcttaagaaacatcaaattatacctaccttgatggtaacaggcgctgagaaagcagctttcatggcactcatctttctccagtggcaacagaaagcatgtttacagcaggcattctggtcaaattcaccagctcagcacagccgctcagctgctggctccactgaacccaagggcaggctcgctggttcctttttctgtgtaaacggctcatgtctaccttcaggagccggggaaggggaagcccactgcaaattcactgagtgtattgtattgccttgctcagggaaaacaactgcctttccaaaatatcagatacaaagtgatcatacatttatatatgcaacttaatcacataagccttcctaacaatgcctttcagaattattaccagccctcaggatatacatcagaagccctcagattatggcaggtagtttgtaacctccaaatgtagcttctagtagtctccgcagtattttgtaaaaaccacttcacataaaaatccagatttccaattacctttatcagggaatgctggtactttccttgaaggcagttaccattccatgggtcaggcactttgtagcagtcccgtcctcaccaagctctcttccctcccggctaccccgcatcactgtactttaggtatacacagtaaaaagacaatacttgcctttgtaactctccccagggggaaaagtaaggcagtctatatatactgtttcaacggggggagggggagcatttttccatgagaatattcctatatggctaatttgaaaactatcctgttgtattggccaagcctcttatttgtattagcttcctctgctctgaagacatttgaattcgtgatgcctggtttatataacatatgagtgggtatgcaatcagtggcaagacacagccaatgaaaaggcaagcacaaaacctggctgtgtaaactgcacatatggtgacctacatgaacgtttaccatatttaaattttctaggtaccagtgtaagcgtcaactgtaaagaatagagaccagatctgaggccaataccagaacagaggaggagtaaaagttcctcccttctaagagtttgttcttaggactcagagaagatgcaaatgacaagtgtccagctactcaacttataaaggcaagccaaaggcagaggcaggcggatttctgagttcgaggccagcctggtctacagagtgagttccaggacagccagggctatacagagaagccctgccttaaaaaacaaaacaaaacaaaacaaaacaccaaagcccaaaaaccaaagccaagccaacaaagacaggggtacaaatccgtgagagcgtggaggagggccaagacgaggatcagcttcagggaggagggaacgtgtggatcagataactatacgtcataaagaggggacacagggaagccagagggaatactcagggagccgaggcccagtgtccctgcagtaagcttggaggacgctggagccagtgctgggagccaggctgctagcagaccaccatttgaagtggatgaccttgtccttaattagtaaggtgcttaatggggaattacaaattgaagtagataagatgctgattactagaggtaaagaaacaggcactgccaggcggtggtggtccatgcctttaggctcagcactggggagctgaggcaggcagagctctatgagcttgacgccagcttgaaacacacacacacacacacacacacacacacacacacacacacacacacacacacagaaaaaggaaaaaaaaaagaagaaaaatcatgattaatcatgatctcccctaccctgagagaaaactccattatttttgcaccataacaac

SEQ ID NO: 1598 - DNA, 1358 bp, Mus musculus
atttgatgatctggttattattattttattaactttttttggagacagagattcatgaattctaaggctagatgcccttgaacttctgatctgtctgcctctacctcctaattactgggattacaggtgtgcatcaccacaaggtttaaaacttaaaaaaaacttcatgattttattgtcttaataacaaaactggcttaggctggatcgcttcccccttttattgtctcctcattcaaaatgcccacgtctcctaacaccagggctggcttggctctgcagctaggctgggcagtcactaacaccagggctggctcggctctgcagctaggctgggcagtcaggcctcagcaggcttctgggtagctctcgtggaagggcttaggctgcttcctgtcataaaggctgcttgccttgggcagatgggatccctgcttcctctacagtgtcgctttgtagggctggcgcgcgcgctgcatgtcttgcagaaatggtccccatgtttgcggagatgccgttggcacaggatgcaaactcctgttttaaaaattcttttttccttgacaccaaaacacatccaggaaggcctgagccctggtcacctgaagaaggccaaactaatgtttttcttcacgcggtaccccagctccagcctcctgaaagcttatttccctgatgttcagttcaaccgctgcatcacctcccagatgatcaagtggttcagcaacttccgtgaattttattacatccagatggaaaagtatgcccggcaagcactttcagacggtatcacgaacgcccaagcactggctgtcctccgagactcggagcttttccgagttctcaatacacactataacaaggggaatgactttgaggtcccagactgcttcttggagattgccgccctgacactgaaggagttcttcagggctgtcttggcagggaaagattcagatccttcctggaagaaacccatttacaaggttatctcaaaactcgacagtgacgtcccagagatgctcaaatcacccagcttcctcccgggactgttcccgagttaacattgaacagaatgagggcaagaaaaatccatgctagcagggcacccgtggattggcactgccatctgatcaggttggcactcaggagcgcttcatcatccaagacgttcactgatggcttcggcaaacttcctaaagaacctcggtcggcactgctgtggcttgcatctgtctgctggaacactgggtctgctaacagtcctaacagtcctacttgacctatatactggtgccccaactgcccatgcatacaaaaatatatataaataaaaaatggaacttcataatgagaaa

SEQ ID NO: 1599 - protein, 253 aa, Mus musculus
HQGWLGSAARLGSQASAGFWVALVEGLRLLPVIKAACLGQMGSLLPLQCRFVGLARALHVLQKWSPCLRRCRWHRMQTPVLKILFSLTPKHIQEGLSPGHLKKAKLMFFFTRYPSSSLLKAYFPDVQFNRCITSQMIKWFSNFREFYYIQMEKYARQALSDGITNAQALAVLRDSELFRVLNTHYNKGNDFEVPDCFLEIAALTLKEFFRAVLAGKDSDPSWKKPIYKVISKLDSDVPEMLKSPSFLPGLFPS

SEQ ID NO: 1600 - DNA, 27003 bp, Homo sapiens
gcatacatgctgcaatgtgaagcttggtgggatactgttctagaagtagcttggccttttcgaatccatccacttattgcaggtgactctctagttccttaagccttaattccttcattttgtttttttaaaaatatggactctcagggtttgaaggcacaggatctcaggaggcgactggcaccttggccggggccagaagacctcttcattttattaatggttgacatctaaaaatataaaaatctggagaccagccactgtaccagatgctcctaagccctttccagctctggagttctatggctgtgggggctcctgaaccccccctaggaggaaaggaaaccagtttaaggagtgcctatttcccgcaccagagaatgcaaggcccaccacatgtgatcctcaccacaatcctaagagagtgactgttatcaaccccattttacagccagagaaactgaaggggaaaaggcagagttaatttgtgtaagttcacataagagctaacaaagggctgggcgcggtggctcacgactgactgtaattccagcattttgggaggccaaggcgggcagatcatgagatcaggagattgagaccatcctggctaacatggtgaaaccccgcctctactaaaaatacaaaaaattagctgggcatggtggcacgtgcctgtagtcccagctactcgggaggctgaggcaggagaatcacttgaaccaaggaggtggaggttgcagtgagccaagatcgccactgcactccagcctgggtgacacagcgagactccatctcaaaagaaaaaaaaaatagctaacgattccccccaggtctaatacctggtagatcattccatagttcacagccatgcagtggttgatgcagaccaccagggcttctgactccattgtgtctgtgtctgtggatggacagggctgtgtggcctgggcctgtcagtctgaccccctctcctcatttctgtcattagccagtgcagtgaagagagcctgttcagggctggaccagagatggatgggtggcctccgacctgtagcagagtggggacagtgcagggggcctctcatcatagagaataaaacaggacaaggctgtatatgaaaatgcctttgaaaagcataaaaacgctatgtgactttgagatgtgctaccctgaacaagtcttcatcagtagcaaaagttagctctgtctggcaagtatttggatgggcggctgttcaggagtacaatgggtaaggcaaaaatgtattcatatacagatgtgattaagtcatcattattatgaaatgccagtggtgggcccttagatcccataatgagtgttgatgaaggtaaaagcagctgtttcaggataaggcattttcctccatacctttccaatcacgttgggtggtcatctactaagcacaaggctggtccagttggaatccaactgaatctaggaaatgaatgaacaaaatactgcaaagaaaaacatgttttcccaacaaaaaccaggcaggaattttatcaaggaaataacaataaaactgcttgtataaatctgatttgagcttcaatgacagtgatgagaatgagttagcatctcttgggcttcacgaggtaccttttacctaaggactctccatagcccaccttgctttattgattggttctcttgtgacccagctgaagcgcatcaaaggtgtttgctgttccctaaatgtgtacacatcacagaaggggagacatggcctgtgagctgccagtctcacctcagctggcctcataggcagcccttcccctttgtcccacttgggcagagcttcgggagctctccagggatattccatggaaggacatagacccacagggagaaaggctgccatgtaggaggtgatctgtgcaggtgatgatgccacagacactggctgttccttttcagctcatgccccggtgctctaacacaaagctgaaaggagacaacacacaacttctctcgtatgttcttgtttgtttgtttgtttgtttgagacagggtcttgctctgttgcccaggctgagtgcagcggtgctatcatggctcactatagcctcgacctcctgggttcgaggtcctcccacctcagcctcccaagtagctggaaccacagacaggtgccaccacatctggttaattttttctattttttgcagagattggatctgatatgttgcccaggctggtctcgaactcctgggctcaggtgatccttgagccttggcctcccaaagcactgggattacaggcgtgagctaccacatctagccttatgtcgtccattatatacttgaaattcaaactcaccctcattttacattttccagctataaaatcctatgtgccttcgcagttatcttataagccctgtgttctatgcttgtgtttgtagctaaatttgcttctccagtggggttttttatttctggtaccgaggaatatgtatctgggaaagagttaatgagaaaaaagtgcagtttttttaaaaaaaatagactttatttattttactttatgtttttagagacagggtcttactttgttgcccaggctggaatgcagtggctattcattggcatgatcgtagcacactacagctttgaactcctgggctcaagcagtcttcccacctcagcttcctgagtagctgagactacaggtaagcaccaccacatctgtctagactttatttatttatctatctatttatttatttttttgagatggagtctcgctctgttgcccaggctggactgcagtggcttgatctcggctcactgcaacctccacccccgtggttcaagcaattcccctgcctcagcctcccaagtagctgggattacagatgcatgccaccacgcccagctaatttttttgtatttttagtagagacagggtttcaccatgttggccagactggtctcgaactcctgacctcaggcaatccactccccttggcctcccaaagtgctgggattacaggcgtgagcccctgcgcccggcctagactttattttttagagtggttttaggttcacagcaaaattgaatggaaagtacagagatttcgcatatatcccctgccttcaacatgcatagctttctccatacatgcaaatgtttaattaacaaaggcaagattgccttttttcattacaaaactgaaaacatatccattaaaaatttagaaaattcagaaaaataaaaagaaaaaatagagaaaaaaattacctgtggttctattacccataaacaacattttgatgtatttatttctctataatgtatgggcgtgtgtgtgtgtgtgtgtgtgtgtgtgtattttttttttttttttgaggcaggctttccctctgttgcccaggctagagtgcagtggcgcaatcagagctcactgcagcctcaacttcttggtctcagtgatcctcctgcctcagcctccctagtagctgagactactggcacaagccaccacaatgcccaggtgattttttttttggagaaacagggtttcgccatgttgcctgggctactctcaaactcctgagctcaagcaatcctcccaccttagcctcccaaagtgctaggattacaggcatgagccaccatacctggcctcatatttttctttgtatttttaatatctaattttctcttacccccccactccagttttataaaataatgttacataaactttacttaaacactatttttcaaaacggttgcataatatggcatcatgtagattataccataccttaactagtgcctactcttattaataatacttggatggccatctttgacataaatttatgagtctagccatcattttcttggcttaacttcatagacatagactcactgattcaaatggtataaacatttttaagtttcttaatatacaatccatgaatatttccaaaaaatatatgaaaactgagcaagattactgagaatcaaagaaatacacataatgaggtaacattgtcacctaccataacggcaaagatttaaaagacaatgcccagcgttgataaagataaggagatgtatgttcttttatagatacattggtaggagcataaattggctatttaaaagtatatatatacaagtaacacacgaatatattcttgtaaaaattcaattaatatagaaatacacagagtaaaagttgagatcaggcatggtggctcatgcttgtaatcccagcactttgggaggccaaggtgggtggatcacctgaggtcgggagttagagaccagcctgaccaccatgcagaaaccctgtctctactaaaaatacaaaattagccgggtgtggtggtgcatgcttgtaataccagctacttgggaggctaaggcaggagaatcgcttgaacgtgggaggcagaggttgcagtgagccgagatcacgccactgcacttcagcctgggcaacaagagctaaactccatctcaaaaaaaaaaaaaaagttgaaggttctgcttcagtccctcctctctacccccagtcagttggtacatttctggaggacagttggaaaagaagtagaacagtttaacgtagtctcagcctttgatgcaatattttcacttctagaaatgtagtccccaaagaaatatgtaggagtgttaatcccaatattattcataataacaatagctacaacttatcagcaataagtaagtgccaggaactgttctaaaaatataacatgtgttaacttattggatccagatgtgaattccacaataaccatagatattatggttatgcccattttactgatgagaaaactgaggtacggagaggtcacaaacttagctaagtggctctagggattcaagtctaggcagtctgatttgtgggtctatgttctccatctatctccatactatcttattttttttttttttgagacggagtctcgctgtcgcccaggttggagtgcagtggcgtgatctcggctcactgcaggctccgcccccctgggttcacgccattcttctgcctcagcctcccgagtagctgggactacaggcgcccgccaccatgcccagctaattttttgtattttttttagtagagacggggtttcactgtgttagccaggatggtctcgatctcctgacctcgtgatccgcctgcctcagcctcccaaagtgctgggattacaggtgtgagccaccgcgcccggcctgtctatgcttctataatagtgaaaatataagaaggaatctatcaaaggagaacttgttaagtaaattagggtacatctatacaatggaatattatcagctttcacaacgttgctgtagattgatattcatccacatgaaagatttaaaaatggaggcataaaactatatatctataataccatttttgtttatatatatatatatatatatatatatatatatatatatatatatataattacgagaaattataaacttctctgtacatggagaaaagagcttggcaaaaatgatgaacaccaaaattttaactgattttctctgggagtggcattagagtgtctttcttttcctcttaatacatttctatatttgggaagtaaaatgatcctacattactttcatcgtctaagagatgcaataaagctatttttaaaggattatgacaattgctacctccatcagtgaatatgagagtgctagtagctaattttcaaacagaaagcatcactgcttcatgcagacttacccagataaagggctgtgggcagcacgccggcctcagcacagaggtttcctgtttctcagcagcccagaggcagagtttccatgattgcatgggcgtaaacatctctgggtacccagccacagtggagtctggctggatttccagtttctggcctcaagatatttctgttcattgttgcttcattaaacacactggtcccatctgttaccctagtagatctgtcttctggagcacacagactacacggaacctcagaaacaataccttgaataacccacaagggagattcagcagctttagtggttctatgctcttctcctcaatgactctatctacccgtctgtctttctgtctgcattgattttgttccatgcacaagcctccatgctaggtgctagagagatctgaaataaagtattgtctattgaggagacaaaaatcaatataaatgaagtatttatggacaatttattcaatggagttagcaaacatctggtaacatctggcagtcaggcactacttgggaacacaaagagggagctcacagaccaaaggggaagatgcattgatcacttcagagaggaagtgacatttcagttggattttgaaagaggaataagagtttgtccgtggaaaagtgggagaagggctggtcgggccaagagaatgtaaatgcaaagacacggaggctggaaggagcctggcctgttcagtgaacacaaagtccaggacagctggacacaggcaattgttgagggtagtggctccaaaggagttagatcgagaccatgtttgtgaagagctgagacatctgaaccttctagtccacaggaagctagcaaagactttgattccatagaggggcataagcagagctagctacattttagaagattaataccagtggcaatgtcatggggaaaatggaaacaatcaaaagaaaatttccaccagttcccatcacatttatccacctgcctgtactggtgtgcctccactgctcttccttttgctgcatggatgaactgagcattcccctgtctaaagtcaatccctccttgtgtgcactagatctcttcccctccttcctactcaagcacatggctccagaaattctccccctcttgcctacattaacatatttcatctttctgcagcaacattgttatcagcctacaaatatgctgttattctgcctatcttgaaaaactctctcttgaccccattttctctttcagcactgtctcatttctgtcctctttacaaaactccttgaaagagttgtcagattcaatgtcacctactcctcttcttgtcctctcccttaaatccacgtcaatcaggcttttttctccctgtactccaccaaaactgttgatcaagattcccagtgactccacattactaattcaaatggccaatttactatccctttgtgacttggcctctccctcctcctagaaacatttacttcacttggttgccaggacctcgcacacccctaggtttccccctgcctctctgactgctccttctcagttgccttggttgatgccagctcatgcccccagcctcttcatgtccctgtgtcccaggacttggaccttggccctcctcccttctctgtctacatttactcccttcgtgacctcatccagccacatgctgaccaccctcaattttacatttctagcccagatctccctgactgaaccccaggcttatttctacaattgctttctggttttttgttttttgtttttcgagacggagtcttgctgtgtcacccaggctggagtgcagtggtgtgatcttggctcactgcaacctccacctcctggattcaaacaattctcctgcctcagcctcccaagtagctgggactacaggtgcccgccaccacactcggctaatttttgtattttttaaagtagagacaaggtttcactatgttggccagtctggtcttgaactcctgacctcgtgatccacccgcctctgcctcccaaagtgctgggattacaggcatgagccactgcacccagtctccaattgctttcttgacatcttgacatttagatgtctgtctagtacttatatcaaatttaacatatccagggtatcgttgtagtgtccctgttggttaaaatatcagttctgccagtttaattactatgattatgattttttttagacagagtctcgctctgttgcccaggctggagggcagtggtgtgatctcggctcactgcaacctctgccccccagattcatgccattctcctgcctcagcctcccgagtagctgggactataggcgcccgccaccacgcctggctaattttttgtatttttagtagagacggggtttcatgaatgttagccaggatggtgacctgtgatccacccgcctcagcctcccaaagtgctgggattacaggcgtgagccaccgcgcccggcccagttcaatgattattattagttagaaagcaagtgacgtggttggagtatagtgtactttgatgctttgtgggaataaaacagctttaggcagtctttcctgaaatagctccctccttctccccaaccgctctctccagtttccaaccctttgttgtgctttctcttcacagcaggtatcacacactgaaaatatatttgtttgtttattctctgctttccctgctagactgcctgttccaggagggcagactatgctgatcttgctcactccatgagcccagaagaaggcccgacacacagcaggtgctcaataaatagttgttcaataaatagttgaacagtgaatgcgtaatctgatttttccaagagttaggacggcagtgtttttttttttttctttttcttttttttcttaagacagagtttcactctgtcgcccaggctggagtgcaatggaacaatctcggctcactgcaacctccgcctcctgggttcaagtgattctcctgccccagcctcccaagtagctgggattacaggcgcatgctaccacactcagctaattttttttatttttagtagagatggggtttcaccatgttggccaggctggtctcaaactcttgacctcaggtgatccactcgccctggcctcccaaagtgctgggattacaggtgtgagctaccttgcccggcctgaatttgctttttttttttgagatggagtctcgctctgtcacccaggctggagtgcaacggggcaatcttggctcatggcaacctccacctcgcaggatcaagtgattttcctgcctcagcctcccaagtagctgggattaacaggcgcccgccatcacgcccagctaattttgtacttttggtagagacagggtttctccatgttggttaggctggtctccaactcccaacctcaggtgatccgcctgcctcggcctcccaaagtgctgggattacaggcgtgagccaccgcaccctgccgaatttgctatttctagaagtgccttgggtgattctgttgcccttagtcactagaaaagtcactccgaatcagacaacgcttggtttgaccccagtctgtcacttacgagctgcatgaccatagggaagtagcttcttctctgatcttgttttcttatctgtagacaataggcatgaccacattctcatggagctgttatgacacattaattaaattaatggatgtagagttcttggcataatgccagttgttcaggcggctgccactacgatattattattattattattattttattgttatgcccaagcaggagaagatttttctccctgtaagatcactctcggagtctcctcaaagtggggttctgagaccagcagcatcagcattacctgggagctggcttaaaatggagaatctctgccccaccccacatctactgaattgaaatctacactttaacgagaccgcgttgaatgtttgcacattcacattttaaaaggactgttcaaagtcacacgtactcttttcttcctgtctctaatttcaggagtctgcccaggaggttcatgagccctggcatcccagaatctgaatccttcctcagtgacagtggctctttacccttctaagtgcagaggaggaagcccagcgcattctgggtgcacttccagctgaggaaataaggaggaggaattcctgaagccctgaacaagtgcctgggatggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaaggtactattggatccaccaggccacctgactcagctgggcagaagcttccaggggcaggtggcagagggtagaagcgagccctcacctcctgtgggaggggcctgtaaagatccacttgctttggctgccttgcccaggagggtccagctacaagctggggtcccagtaggaaatttatcactggccaagcgtctagattctcctaggtaccctatccctccaagaatgacccccaaaccctgtcaggatcccccagcaaactttcccttgactgcaccttcccacatccaggaaaatcagattcttagccagctactgggtcatagatacaacaatggccattggagtagcagtcctccccaggactcatcttcccagaggcacccctcctcagagcctgccctacgaccttggagaactactaagccgcaaccattggtcctgagccagcagcagtgtcccttgcctttcacctctgcccatctggaaagtctaccccttcttccctcggtgaagatggaacagagaggcctgcatgctgtcatggaggcactgcctttctctttggtccacatatcctttaatagcaattgaagttctcattgttggccaggtgcagtgtggctcatgcttgtaatcccagtgctttgggaggccaaggtgggaggattacttgaggacaggtgttcaagactagcctgcacaacatagctagaccccatctctaaaaataaaaaattatctgcacatgatggcccatgcctgtagtcctactcaggaggctgaggcaggaggattgcttgagcccgggagttcgaggttacagtgagctatgattgcaccactgcactccagctgggcaacagagagagacaatgtttcaataaataatttaaaataccattgacactgtgcagagaaacaagaaaactaaaagttgaagaggagctggggacagatcactcagggtcttcttaatgttgctctgggccttcagcttatagtggtgaccacattctggaatttaaggacctgggaaggttcacttagcttcttctatgacccatcgggttctgccacttgacttattcctttgggtctaaaagggttttgttttgagactcaaataggcttctgaaatacaatgaataccctaaggaagaaagaatccataatttggttgtcagccacccataaacttaggaggagagggtcaaaggaatgacgtcatctaaggtatggcctccccaaccccatagctctacaagcaaaaatcctatattgtgtagataattcctggggagcagatgaggaacaagaaacttctgggccaaatggaaaaggagttttcctcggggattaaacccagagaggtggctggaaacggccagaggtctccagtttaaggaacaacttccaaggtgcaatggagtgcctggagactaggggctgggcatatgaagggagaggaggctccccatgaggaggcctgagtggcccaggctgatctgcagggctctggatcttattgcatcatctttgcaacccttaagtagacactactctcttaatgtatttcccagagtaaccctcgggatattaataattgttgagttagaagaaaaagtaccttggggaaatactgagatagtttcttttctgcaggaattctcagagcctttaacatgagtaaatggaagctctaagaggagaatgtacacagccccaaacccatatgaccacttctaacaagcatcttgcagaacttaagttcttgagaatatattttggatgttgctttttaagctagctgtgctcacgctgctgcttcttgtgtgcagctttgaggggaatctccagaagctgatgagtctatggagttgcatatccaggtgggaacagtcgtgtcctttgcctggcaactactgtgagggcagcaggatggggtgggaccagctcattaccatgccagaacctgcctttgtgtcctaaatgccatgagcgccccctgccggtcaaaagtgttggaaacaccccaaagctttcctggaagttagcgagcaactgtaaaaccaatgctgagaacacttcacttgccaccactcttggaggcagagattccaccatagacagattttctttataagaaaggctacctgtctgggcctttgataaccactagttgactctccattaaattcagacagctgcaaaaacacctcagtctcccagaatttgctatttgttgagcacctacatgtgcctgttcctgccccctaaattggggattgggctcagagagcttctggaggtttggggcctatcctaagaaatacctaagccaggactggctgcatgggtgaagtacttgactatctttggaatgacttgggaccccctagcagcaccctggcccctcaactcttccctcattcctgctgcctatattccaagagatttattcctgtgggccatgaaagccacctgagagcaagctgctttacagcataaaaagaacgttcacattcacatgacatcctgtgacataggtagggcagatgtgaagatcacgaggggagcattgacagaacaccttctcggtggcaggcattgctaccagcacttcacacatatgtgcccaccaccacttagctacaattctgaaacccataaagctttgacaggccctatgattttccccccctaagaatgatgcaatcttttttttttggtagcaaaacctggcttgcactgattggaggctattaatagattttatcccacttagtatagtcatacgttctgctgcagaaatgttaatgtattggattatacactgtctcagctgtggatgttaattaatgtgtggtacacacatcgtattatctttataagctaacaaattctgaaatccaaactccatttggctcagcatttcagataacgggtttagacctgtattatctcaccgttctcaagcatccactctaagatcgggtatccgagaagcagagacagagaagggagctaactcgtccaaagtcccaagacacactaatgagcaaccaggatttaaacccgggatctgatggccaagtacaagctttaaccactatactccacatcttagcaatgaggctcagagcagttaagtggcttgcccaaggtcacacagctaatagatggcaaaatcagtgtctgaaactgggtctttggaatcccaatccaggattctctccacagcatttgtggatctgtaggaagggtaagtaggggctgatggggcagcagggagggatctcctgtgcagcaactaggtgcctgggccacctataaccatagtcagttggtctggtttcttttggttaaacagattcatcctatgtggaagtcttcactgtcttaagctacagctctcggatctgagatcccaggttactctgtgtaatgcttctcacccagcctaaggactgtccctaaaaatgcaaagcgtatttgtgtaaatctttttttcatttccgtcctgccctagtgctaggcagtcacatcacaattctccgactcttgttaaaggggaaggaatctgtctgttcccagagtgaggtatagtttggaatctaatttccatatatgtgtatggattaaggttgaccgttcactcacttactccttcacacaacaaatatttattgagcacctgctatgttcctagcactgggctaggcacaaagatgaaaagataaggtcctcactctcaaggagctcacagtctagacgagacaaacatacagtaaaaattccaataaggtcatcgctgcaacagtttgtacaaagagtcttcatagcccagggtaaggaaggcctaatttggcaaggaagggtttaacagaggtgggagcttctgagctgagacctgaaagatgagggatagttctgccaggcaaatggagagtgggtaccacccaaccattcaagcttcttgagcaagagcaaaatatgagctggtattcagcctgcttagatgtttgctggttataaaggcaacactgtgaaggcaatgataagagtgacagccagaatggggaccacctagtttactcttctcgttttacagctgaggaaactgaggcagagaggggaagtaaatctctgcttggggttttgaaatggtttatctgggatagaattgccatctcttcccatcccacttggacaccacacacacacacacacacacacacacacacacacacacacacaatacaccaacctgtatttgacatctaagaccacacacacacacacacacacacacacacacacacaaaatacaccaacctgtatttgacatcatctatgctacataacttttccacatcgagatgatttttacattctgtgacttaactgtgcacatatgtcatccagcttatttgaccagagtttccagagacagaaaaatggagcaaatacacaattccaatcagaaaaacaaaatgaaatcaaatagaaaccacaggaacaaggaattcactagttaattgataaactggcattttaaagtgttcattttccttgacactgagataaatccaggagggtctaaaccctggtcacttgaagaaggccaaactaatgtttttcttcacacgatatcccagctccaacctcctgaaggtttattttcctgatgttcaggtaaagtcactcaactaaatggcagcttctgcagaactcccaagaggcagtgtgttttgcctggtgtgaggcaagtcctaggtcatcatatgtgcacttcaagctccccttagtgttgctgatggaagcaatgtccagttctgggctgagactctacccaaataaccgtgaataactttaggctagaaaggctggctgtctaaattcttaagctactgagctgtagataatccccaaaacagaaacacatgggcaggaaaagtagagggaaacagaaacactagttagtggcctttttggctagttttctgccttggctggggacactatgaaaaataaaatataggccaggcacagtggctcatgcctctaatcccagcactttgggaggccgaggtgggcagatgacctgaggtcaggagttcgagaccagcctgaccaacatggtaaaaccccatgtctactaaaaatacaaaaactagctggcgtggtggcgtgcgcctgtaatcccagctactcggaggctgaggcaggagaatcacttgaacccaggaggtggatgttgcagtgaacagagatcacgccactgcactccagcctgggcgacaaagcgagactacatctcaaaaaaaaaaaaacacacaaaaacaaacaaacaaacaacaaaaaatatatatagagagggagagagagacagagtgtcagacactgtcaaatttatgttcaaattgctatagttcaaaactgagtgaaagtacatacagatgaagtgtgacaataaggaaaatcaaactaattgttgggaccagacctcccctgttcccataaaaggtttctgagggcctcttttactttgggtgttgggttaggggctgttaatacttttggtctacatcattcaagcttttctttccctcatattcagttggttggttgatccctgaagcaacctctgattttgatttcaattcattccacaattcaaagttgctaataaactgctccctgacctacatcttgcccttcccttggccctttatccaagtggaaggccccaggcctgccatgcagtccacctgggtgcagcaaaatctggcaccacactggtcgtgacccctaagtcccactcaaacaccacaaaaagcttttcatgggtaaaacaacccccataaatctagcatatcaaaaaaaagttatgttctaatgggcactgtagctaatttagatttttctgagtataactaaataggcttggaaaatagcggtggcttcgcttctttttttaaaggaagcccctgttaatgctggttaaagccgtatatgaacccctatactgagctggaagcagacagttctaattctgagcacctcgtggcaaatgtctgactggatggacctcttgtttgtacagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgaggtaagaccatgtactgggttcccatgagatctgatgagtgtcttccctatatgattcgagttttaggaaagatccctcttctgtgtctccttaagttactgagagccagggcagcctgggccaatctctgtatcatccacaaagattacagcctcaacatcttcacttgggcaacaggtggaagcagcaaactgagtcaacagccagtcttcattctgaagcttagtgagagggctgccaggtgttacaccatcttagactgaataccctgtcattatcaagttacataacttcctgacctttttgccttagtgccaggaggctcaggactgaatgctgagctcagttgtggcacctagtcttggcctaggttttctcaacaatttctatgcttttcatgatttgattcttatctgtattttcccttgaaaatgtatcagtgggccttccatagcaagtcacctcaaatcctttctggaaataacaataaacaacactcaagctcagtccctcggggatccctatgaaggcacactggtggcacctcagaggtaaagcgtcagtgaaaggtgagcctaggtgtcactggcgcacattcctaatcaagagatgcatgttgcctcatgcacagctgacagctgttaggctggcatctgattctgcaggtgccgggtatatctggtcacagattacacttccctcttcttgacttctcccttgactgtgatcacaaagagtggtttattgatacctccaaaaaatacaagaactgtggtcatccactggttgactggtgagtcagagtatgtttggaaagctaagactacctgtggggaaaattgtccatgtctccctttctgaggctcaaggggtcacggccagtatgggacaggcagcactgctgcatctttccacatagggtggtcatttgacctgcagtggcagcaagccccaagccaagctgggtctggagcttggcagtggggcaacccatcattcatggtgccagtctgggttaggattctagaacagcacccccgtcaaccagctctgaaagcaggagtgtaagctcttcagacccagccctaaaaggcagtggaatgaggtatgacagtcagaagcttgggggcactcctttccacagttagtactagggaaaagaataccgaagtctctttgagccacagatttactttcagtaagattttctgacctgcttagttaaaaagtcgcccattagcgagatcagctcctcctacaaaggaagtgtccttaattcaccttctcccagggctttctcactggagctgtcttatcaaggtttgtgtctgatgaggaagcagaggagtcctagggttgcagaatcaggggccactagagcagggatgctcctagcccactacccaagaaacaggcagcacccgctagtgagggctctggcaccagtgcttcccaacctcacgtcttttctttcttgtgggtctctttggaaatgcaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtagctgtttcggggttaagatcccacaacgtgaggagtgactggctagggtttcctgggtttgtcttaaagggcaatttagctgtagtcatataaaaagggcacaaggaaatctcctctatcaaaacaggtactattaccattttgatcatttatttccctttccagaatcatcagaaatttaactataaaatgtactaactatattggtgtattggtagtatattgtaaaaggaacacaagtttccaatcagaagacttgaagctcaactccattgtttccaggtgttgtgaccctgggaacttcctggtatctctgtatctgtaaaatgaggttgttaaggattaaaggacagtatgtcctatgcaatgtcattcacacacaaatgtcagttttttgagcccctctttcagataaggttatcttatttggggtttttacaaattgctgtttttagtcacctaattataaagcgccatctatttgctagatactttcacatactttaagcttttcaccctgaaaagtagttattatcatcatttaaaagatgaccaaacagaagctttagaactgcaaggtaactcgccaaagcctatgaggctaggacatctgggttgatagggacagtcaggagcctggaggaaccaagactttctgatgcccaactgcatgctggacccatctcctgcagctaactcaggatctcaagcaggaccccacccctagtaagcatccagcgctgacagggcaccgtcacctgacaactcctgcccagcacttaggagcacttcaccgcccaagatttctgctgatcatttcagcaaactcaagacaaactttatgcaggacttgagtgttgctgtttattcacatttgtctgctggaagagtttatcagctggataatgcaaatagtctccagctgaccattgcaattggtgccccaacctcatatatgcagaagaagctgaacttcagactgtgaaaggtagaaagggccttaggagatcatctggcccatgctgcttaaattgggaaggaagaaccgcagtccagacaggaggcttgcacaggctgtgcacagccttgcagatgataaatggcataactgggacaaatgcagcatcacacagaaatggaaattctcccactccataacaaaattacagtccatggctgaccttccactgatgaaggaattcatgaaatcaacatttccccctgctgctggcccagcacaattgtgacccactcttgagtatataggcaaggcatgtacaaagctgagtaactgcatctgtcttctaagctagtcaggatcaagtctttgtaagcactgccaaaggtacgccgggtggggtggggtgggggtaatacacagctcgggctttgtactcctgataaggggtgtctgtgagttcattagcttctttcctgtctatataaaacaagtttcatattcggctactcaacttccataatttttctggtggggtgttgctggagcagatgagataaaatccctaaactattactagaactatcagcataaaaagtatgaaagatgaattttcctttgaattttctcttcaaacagctgaaaggaaaaacaaaacagacttagcccaaacccatctttacaggctaaaggttaagtgccctccagtacatccaattgcactcagaagatctttgccctattttcacaaaaatgaaggaatctgccaaacctaagttttaaacacaggcaagcatggagtgctctgagcaagggcaatcagttttctgtgtccggacatagtagaagaaccctctatccagagtgacattacatacctaagttagacatacaggggaaacaagttcacatgactgtccaatagagagcagcccttcttctgtcccaaacctgaaattcattagtgtgtgtttaaagactgagccaagtcacctccagggcagtgaaccttgtctcagggaccaatgagatgaaatgtacaagctcaaattgaaaacatttgtgtactgcagtctttccaggaagtgttctctaaccactgagctaaacacagaagaatgtataaatatgtatgctctgccaacagaagaattctatttgattataattttctgtttctatcaagtgcgtatccctctctgttggaaacacatggagtgtaagctgagtgggttattattttagcaatcatactttgccaaagatctggtcattttttccactaaggtatatgagggcactattcttttatttttttgagacagggtctcactctctcactcaggctggagcacagtgccacgatcacagtagccttgatctcccaggttcaagtgatactcccacctctgcctctcgagtagctaggactacaggcacatgtcaccatgcccagctaagtttttaaaatttttctgtagcaatggggttctcactatgttgcccaggctggtctcgaactgctgggctcaagcaattctcccacctcagcctcccaaagtgctagaattataggcatgagccactgtgcccggccttgggtgctactctctcctagattagacatgttcaaatactgcataattgtcttaatttttcaatggtggactatagggtctgcactgtggtttatgatgatggcactactgaggagttaatgcccaattatcaattaaaagcaggcagttgattggtatcccatggaggaaaatgttcattaggaacctttatttcaaacactgtttcatatagtatacaaaacccaaaccagactcaaacggtgagaggctgaaggacatgtaaggggtacctaaacaatttattttccatcagagaatgagcaaagtataaacagcaaacagcacagcactctttaataaagctctacacccagccctcttacgtaggtccacttttaaaatgttgtctttgctttcaatgacaaaatagagagaatcctcagaaaaaaaaaatttaaaattgcacttccctaattttacaagtgtcttttgaaaatatatctttggctgggcacgatagctcatgcctgtaatcccagcacctcggaaggctgaggtgggaggatcgcttgagcccaggggtttgagaccagcctgggcaatgtggtgaggccccgtctctaccaaaaaagaaaatacaaaaattagccagcgtaatggcgtgtgcctgtagtcccaggtacttgggaggctaaggtgaggatcacttgagcccaggaggttgaggctgcagtgagccggcaatcatgctactgcacagccctgggcgatagagtgagaccttgtctaaaaaaaaaaaaaaaaaaaaaaaagaaaaagaaagaaagaaaaagataaaaattatttattttaaaagtcctaaaggccggacgcggtggctcacgcctgtaatcccagaactttgggaggccgaggcgggcagatcacctgacgttgggagttcgagaccagcctaagcaacatggagaaaccccatctctactaaaaatacaaaattagccgggcatggtggcacatgcctgtaaatcccagctacttgggatgctgagacaggagaatcacctaagcccaggaggcggaggttgtggtgagctgagatcgcgccattgcactccagctgggcaacaagagcgaaactccgtctcaaaaaaagaaaaaagtccttacaaaattagccaaaattttggtaaccagttttctgaagtcctatatagtccagattttcataataattgattctagtcctttgatttacagttttgatcctctgctctgtaaagcagatcacagtttgataatatatacaatcaaaacaaaacagaaattttaaaaatcctttgatgtttttacacaaactgttaagtattgcacagatttcacataaagcaagatcatcagacaagataatgaaacagtggtgggcacgaaagagatactgaatactttagctagaacaatatagctctatcaggctgaggattatatacatttgaatttgagttctgtacaagtcttaactgcttcagggattgaacctttggggtggatagaaatgaacttgtgacaatatggcaaatataatgcttttcatgaaagtattgtataaaatattcttggtcagatttaccacaaatatacacacctacacctgtaaagtacgagttcagatgatccactttagagtattaataatgcatgctgtacctttgaggtagatcatggtatctacatttacaaagagttactaagcactcacctgtggaagaagatgattcatgaaaagagtatttttcaggattagacaattcctacacaaagaaaaagctttttttttttgagatggagtctcgctctgtcacccaggctggagtgcagtgatgcgatcttggctcactgcagcctctaccttctgggttcaagtgattcttgtgcctcagtctcccaagtagctgggattataggtgcacaccaccatgcccagctaatatttgtatttttagtagagacggggtctcgccatgtcggccaggctggtcttgaactcctgacctcaggtgatccgcctgccttggcctccaaaagtgccgggattacaggaatgagccaccacactcggccctcttttcaataacctaagtactatatataaccaagtgcctaagagttgaatgctcagtcctatttaaaaaaaaaaaaaaaaaaaaaaaagcaaaacagatgctagcctccagaggaagggagtgtctgatgaaatgttgaaggcaggtgaacaatgaacacagtaaaggaacaacccaaaccgtcgccagttttacatgtccatctgctcactaggggtctgcttttctttcaccaagagttcttcagggtgatttcatttctcacgatctcaccccttcatgctcagaaactcttgttttgccatttccaattctccagtcacacctcaaacaaatgtcaattccttttcttcccttaggaaaacctttctctttcccctatttactgatttctgtggctctgacttccatgccctcagttactgcttctggactggagcttcagctgtcggcaagaatgttgttcctccctttaccctttccccactttatcctcaggtatctgacctaacaatgcttcacccaccctatttgctttccacctcacctaatacctttcccaaatcgagtagtttgttaggtgcatgggctttggggtgtgttttcatccgggctcaaccacctatcagctacggatctctctaaattacttactcttcttggcctcagcttggccatctgtaaaacagagataataatatagcacctacctcataatattgttctaaggttcaggtaaaaccatacatgtgaaatgctcaacacacttctagagcatagtatgtgctcagtaattgttagctgtattactgctcagcagtcatagattgttagcaaagtcatgaatttgtactgcttcacagtgaaaaagaattcttagcttaacaacatcactgacatgtaacacggacacaaccataaaacttagctttaaactatgttaatatagtttgggaagaaaacccagctaaaaacctttgtgttataaagtttacatgcatttcgtcatttactttttaaatacaaccccatgttgacatgtttgacaaatggcattacgactattgctgtttcttggttggttgctcagacgctgacctgctttttccttacacagggggatacactgcattttttttattttttttttatttatttatttttgagacagagtcttgctctgtggcccaggctggagtgcagtggtgcaatcgtggctcactgcaagctctgcctcccaggttcaagtgatcctcctgcctcagtctcctgagtagctgggactataggcgcatgccaccacacctggctaatttttgtatttttagtagagacgggtttcaccatattggtcaggctggtgttgagctcctgaccttgtgatccacccacctctgcctcccaaagtgctgggattacaagagtgagccactgcacctggcctacactgcatttttgacatcctcttaattaaaagctcagtgactaatgtggtatttctaaaattatgcaacttgccatctctaaccactgctttttggggctgtatctatgttcattgagtagactagttttggcttgaatattttcttaacttctgtacagttattcaaaacatctctgtagttgttccacttgttaaaaggggctggctggttcattgccttcttgactgggtcaggggtggcgagggaaacataactggaatcctggttttcccccctcttaacagttaaatctatattcaggattattttttcataaagattagttttttttttttttttttttttttgcatacagggtcttgctctgtcacccaggctggagtgcagtggcaaaatcttgggtcactgaaaccgccacctcctaagctcaagggatcctcccacctcaacctcccaagtagctgagactacaggcatgcaccaccatgcctggctattttttgtagagatggggtctcaccatgttgcccagtttggtgtggaactcctgggctcaagagatccgcccacctcagcctcctagcactgggattacaggcatgaggcaccacacccaacctactttttttgatggaaagtaatccagcctttctggttcttttcatttatagtcactaatgttgattatcttctcctctgctcttccatgagtgtgggttggtgattatcagaatatttaaggctctaaatgtcttctggatagtctgtttctacattgtctttttcaaatcaagctttatgagacaatgggattgtcaacatgaagttttgctgacttcttactgtattaaatttctaacaaaaaaacaccattacatcagacagaatgcatttttgatatacaccccaaagctgcttttgctcaatattcctatcttggtgtttagacacttcttttcacacatcccattacttcatcagagctgagcttgctgactctgaaccaatcagaacaaactccagaaactcttatttcctatagaattcttgccaaaaatggtgccccaaaaaagaatttctaaggtagacagggggatgtgggtacaagaacagaatacaaactgttttgttgattgtaatttatcagcaagtcctgggaacagaaagtttaataacaatggactttcctaaacaccttaattttgacatactattgcaaaaataatttttaaattatcctatccatgaggatttatccttatgccatgtgaacagtagacatgattatgtatccttatgctctggagacagtaatcacctaaaaaatgtgagtgaggcagggtttgacaggttgacttaatgcttagaatatgctatttaaagtgactgttactatttctttattataaagccatgcctattcaattcaaatacatcagggcatttctctgggaggccaatagtcttcttactgttttaggactaaaaatatacaatgactgtttactgagcaggtctcaaatgttctgaagtttggcagaaaaagaacttcctagcattcaatttgtccaaaaattaagatcagcaacagattcttatgctctggggcatatacttctcattttactcccttcaaataaagcaagtggccatgcttgaactactcaaaagcgtagttactgagaaaagcaccaatattgatgatctcatgaaaaaaaaaaaactaaaaagccactttatgttgcaaaagctatgctacttaccccctcaaagcagcagtccccaacaatataaagtcctgaatttaagtcatgatgggactacaagcaaagtgactcattctatactcattctcttaacagttcttcacattcccacatggagttctgaatcttgattatggtggtggtgattacatgaagctacatgagataaaattgcacagaaccaaacacacacaaatacatgaagttacattagataaaactgcacagaaccaaacacacacatacacatgagtgcttgtaaaactggtaaaatctgaataagctctgtggagtgtatcaacattaacttcttggcttttaaaagttttgacacacacttctcattgtataagatgttaccattggggatggctggttgaagaatacaccaggacttctctgtacatttttttctacaacttcctatgaatctgtaactatttcaaaataaaaatttaaa

SEQ ID NO: 1601 - DNA, 894 bp, Homo sapiens
ccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgag

SEQ ID NO: 1602 - protein, 298 aa, Homo sapiens
PQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKFNRCITSQMIKWFSNFREFYYIQMEKSARQAISDGVTNPKMLVVLRNSELFQALNMHYNKGNDFE

SEQ ID NO: 1603 - DNA, 43591 bp, Mus musculus
  misc_feature (1)...(43591): n = A,T,C or G
caccatagaactaaagtacaaataagtaacagaaagagaactgttattagctataattccatttggaagataatattccaaattatctggagtagcacgtttttgttaaatcacggtagaatatatgtactgaaaaccttactattttaaccatttgaaaacacacaattcagcaaccttaagtacgttcatacatccttgtcttatcaccaaggaacagttgaagaaccaacccctcacacatacacttccttctttatctcaaaaggctgaagctctacccaccagctcctgtcttccccttcaccagcccctggtggccaggatcctgcatacccatgtatgcatacgcgtgttgaagtctgaggaccagttacgggagtccgttctcccctaccatgtagattccagggatcaaactcaggtcaccgggcttggtggcaagtgtgcgccatcttgctggatctctataaatttgaccgctctggctagcgcctgggtagtctcatgaagtacctgtcctttggcggctgccttccttcactagcatcctgtcctcagtgatgtgtagatgcacccacgtgtccggagtcagaacgtctttccctttttttaaaaatatttttaaaatttatttattatatgtaagtacactgtagctgtcgtcagacactccaggtgagggcatcagatttcattatggatggttgtgagccaccatgtggttgctgggatttgaactcaggccctttggaagaacagtctgtgctcttaaccactgagccatctttcccagccccacgtctttcctttttaaggctgagtatcatgctgtacagtctcagggtggttttgatttgcctttacctaacacatctttatgtgtttattggcatgtaaaagatacatatttggagatcttttctattcaaatccttgtctggtaaattgagttatttttctttttttgtgtatgtattgacacctctttatctactccagatactaagcctctgtctgtctctttccatttcttttttgagtttgagataaggtctccttagcccaggctggcctaggacctaagagctaaccacatatccacatgcttctctccctctccctcttcctctcccccctgactgctgggtttaaaggtgtatgctaccatgctcagcactaattctctttttaaaaacgtgcctttatgtgtacatctgtgtgagcgactgcgggcgtgtacggcagagtatgtgtgcgggcctctagaggccaggagagggtgaagatcccctggagctggggttccaggcagctgtgagccacttattgtgggttccagaatgaacccaggtcttctgtaagagcatgtgttccttcctcacccctgagcatctctgcagcctccacctggacaccagtctcttagccaatgcccgatgctgacatgccttccattttggagagttcctttttcttgatagggttctttcaggcaccaaaagttttcattttgcttgtttgagaaagtctcactgcatagcctaggctggcttcgaactcttgatattcctcccaaatactgggctaacacacagacatcaccactatgcccagtgggattacacatagacattatcaccacgcccggcaaggatttatttttgaactcccaattttgcttttttttttttttttttttttttgagggagggaggggatatgggaactgtacttgtagttttgtgatttgtccttttagtgatttaaggtcctgaagagccacgcctatgtttcttcccttaggtttttcatgtttaaatcacttaagctttggggagttttttttgggagcaggggttgcatatttgtttgtttggcatttggagacaggaaacaaacaaaaaaaaagcatgcaggctctgccagatgcctctccatggatcctgggccatggctctcctggatagccatgtattccttagagagccaggctccagaggcctgagcagcgcagcctctgttctctcagctgcccagcaggcagtgcacacatttccatccactgtaccttctctcctggtcagttatccctttccacagatttgcgggactcatacctactcaggccatcaggccccatgtaagtttttctgccagctgggctatccctaacatactaaagtagagttctagttatcaatttgagagactttctttttaggttgaaaacaagaactggtgattagatttcttaaatcattcttagaaggtttggcacagtggtgcacattctcaaaggctggggggcgggggtatgggcactaaaataaactcaagaccagcctgggtacaatagtgagacctgacctcaaaagaaacaattgaaatgaaacatttatatataaaattatatatatatgtgtgtgtgtgtatttatatttatatatacacacacatacacacatgcatacatatcaggggactgtgtaagcagaaatgttttcattggatttgtgtgtgtgtgcgcgcgtgtgcatgcatgtagatgtcagaggacaacttgtgggagtcacttctctccttccactgtgtgtcctggggatctaactcaggtcaccaggcttggtggcaagtagctcttcctgctgtgccaccttgttggccatggaaactggtttatgatatggtgttagcatatagaaatttcctttcagagaagcctattggaattccacttgcttcattgttttgttaatttttcctggggagacatgaataaatgtctgttcaccctagctagactaccaagaactgaccaaacaaatgattccacgcaagggtagcttggtaaactagtgagttttaattttgatcaaacatgaacaacttacaggcagcaacagcatgtagttcctacccacccccatccttaacatggtatatagtgtcagggagggttagagtgcagtggccgtttatgctggctaatgagctgtgctgagagccccctaggaactgctttgtggtcctcctctccgaggatggatggaatgctattgtgtcgaatatgaggggcttctccagtaatcacaactgctacgcttctaagaccagagttctccagcacttggatattcaaatctgaatgtgaatcagcaagcagtattacgatatcttttaaaaacaagagtagaatttagcatccagataaagcctgttggaaatttccatcctccaaggggtcaaaatttggagtgtcctgttcaccggaatccaggtcaattgcatttcaaatcagagacttatttgactgatagaacctcctgctcagaactgcaccgttatgctgatagctgctcgccatcggtggtgatttcatagctggaggttgaccgctccaccagcttacggtgaagcacgagggtacagttacacagccggctggatgggatgtctaactcagagtgcactctcctctgccatgtgcctctccttcggcactcaacacacactgtaggtagctcctgcttctctccatggcttactattccatccctttgatggaaatatttttgttcattatacaaacacatctgctttgactataactgcttggatggatgccccatccagttcctcctcaaaacattttttgctttccttggcatacccgagcaatttcccacctttgcccaggtatgctggcacctacacatgcaatcatgttagcccccatacgcgtttgcaatccaaccacttctattgtagatcaacaatgatataatatcctaattataatttatgtagcaataaaactaactccagtacatcactgtctttcctgaatgctcacttctgccacatttaataatgaacactagggaggaaaaaagccacacagcagttgctcttcataagcatgtgcaacttgattgtttttaattaactaattttttattttttattggtattttgcctacctgtatgtgtgtatggaggtgtcaggtcccctggagctggagttataaatggttgtgagctgtcatgtggatactgtgaattgaacccaggtcctctggaagaacaaccagcgttcttaaccactgagccatctctctggcctccacatgttcaactttaaagacaacgtgattacttattagatgagagaaacgaaacgctaggagaaggtttggaaaggtggctggcgtgagattctccttcagagatgagctttattgggagaactttgtgaccatgggttctgcgggcaggccttgaggtaggagagcattaattcatcagatcaggcaacatggcagggcttacaggctttcatttaaaacttggagaagaatgggaaggtggctcagtgggtaaagactggtggactgagctcaatccccaggacacacaatggcggaaggaaggaacagacctctgcaagcagtcctctgacctctatacttttgctatggtatgcgtgccccacccctatatgtgtaactgtaattaaaaaggaggagcatcattaagaaagttaacttaggggccttgggtagccggcttagccgcccatactgttcttccagaggatccgagtttaggtcccagaacacatatggttcataatcaactttaattctggctccaggacacctgccactgccctcttctggactctgtgggtaccagcactcacataccacaccccctctgtatatacatagttgtcttagagtttcatggctctgaacagacaccatgaccaagacaactctctctttctttctttctttctttctttctttctttctttctttctttctttctttctttctttctttctttctttcactctgtagaccaggctggccttgaactcagaaatctgcctgcctctgcctcccaagtgctgggattacaggcatgagccaccactaccctgcccaagacaactcttataaggataacatttaattggggctggcttacagtttcagagattcagtccattatcatcatggcaggaagcatggcagtgtgcaggcagacagtgctggagaaggagctgagagatctacgttttcatccaaaggcagtaggagactactgtgtctcataatgggcagagattgagctcaaagccctcctccacagtgacatacttcctccaacttggccacacctactctaacaaggccacacctaatagtgccactcccttgggccaagcatatccaaatcaacacaatggtaaaaatacttttttttttggaaaaaaagagaagcaggcactacagtcatgacaggggtagaaggaatgcccacaagagatggagccttcagtgaaatcccccaaacaaagggaaatatctgactcttatgctctttcaatattagagtttgtcagtaacttatttttagtgatttagcttaggatagcctacaggataaagagcattgaggagccaggtactggatagggccatatattaggggctatgagttatgaggctgtacacacagcacggcttcttagctcttggtccagagagagctgcagcagggacccggcctggtttctccaggctgccaatctggtctcttagtgcggcgcgggtcgtccacgggcaggcccatgatctgacaaggaaggcgagtggaaacctgatagctgtggagcctcctgagccctgagtgttgagaggctccccagctgcatcccttctctaaatgtgacagaaagtgggctttgggcgcaatgtaaacacgttgggttagagttcccccaacagtaaaaacaatgcttgtgttgcccaggaaattgtgaaatactgtgtaatgatctttaaagatacaatggatcccttcatctggatttgtttaggtgtggtccttgctaaaggcaaaggggagggtcaagtaacttgaagctttttctgtttaatacacccattagactgctgattaggagaagaaaaaaatgagggttgtgggtatagtctagagcgagagtgtttgcctgcctcgggaccatgtgtgaggccctagatgaatccccagggcttcgaaaccaatctaaaactcagggtcttccccacctcactttatttggctaggcctaatgctgcacactcctaaggcagaggcagggcgatggctgggagatcggggctaacctggtctatatgatgagttctatccaagccagccaaggctacatgatgagactgtttcaaagaaaaaaaaaatgaacaagctgtaagcactaggaaatcattctgaaggcatcttttgggggctcactctagcgcttgaccataattactaagcaatgaaaaatgctaaagaagtcaaatgctgagttttgtagaatttttaaaaagggggggggggtgtagaatcaagtggctaaaaatcagccatgagatcccctttggtgtctgttttgatttttctggacagtgtcaaattagttccggtggtttgattccaggccaggatgctggcccgattctgtctccctttgttccgtgcagtctcaccgcacctctctttctctcttttcttcccttaggctgagggtaaaaagctaggtttggtgggctgggttcagaacaccgaccggggcaccgtgcaagggcaactgcagggccccgtctccaaggtgcgcttcatgcagcagtggctggagaccagaggaagtcccaagtcgcacattgacagagcaaacttcaacaatgagaaagtcatcgcaaacttggattattcagacttccaaattgtaaaataatgaaacgaatcttaatattttttcaaaataatctcactcctttttttaaatcgctagattaaaaaaaaaatagaactattctgtgctcagtattagaatttgttagtaagttattttggttgcatgttggaaaagttaccacgtattacaagtatgatgaaatacaaatgtgtataattctaaccaataaaaacacattagaaccttatgcttacattgcttccccccctcccttttaatccttagtgaactttgggcaacatgattaattcgttattgtgagaggaaaattttggggtagtttaacgaggtctgaaagagaagtaactttgccatttctttacattgtttacacgggagacttcatgtgtagcaagagcaaatgccaccaggttgggctgttccgtgttcacatgacgcactgcactaattacttttggttttcaatcctttggaacatctacagtcactccttttccaaaggtgagaaattcagataaagtagttatggcctggattgcgcctcccctcatttgtatacctaaactactctaacccaaggaccaatcccattggactgctgactcataagagtgtatgcaccacagaccacgtgaagacagacagccacacccaagaaggaatcctggcctaaactccagcttgtcctagaactggaaagaaaagaaaacaaacaaaaaccccggctacttaagccacccagcctgtggccttttgtcatgaagccctggcaaactgaacaataatcagaagtttgcttcattggctccacaagtctgatttggtttggttagtaattaaatatatactcatttaaaactttgtcctaagttcctttaaagggaggagggatgtcctccctgtggagatggctcagcagttaagagcactggcaacttttccagaagtcctgagttcaactcccaacacccacatggtggttcacacagtctatggctctaagaccaagggatccgatgccctcttctggtgtgcagaagtacaagcagacaaaaccccatacacatgaaatacataaatcttttttaaaaagtttctgggaggaggtttggatgaaacagaagacaaaaactgaggattgcctaataattctcaaaatattctcactgtgctcttgcaggaaaaagccgtggtggtatgggggtggggagagagagagagggaggaagagaggaaggaagggaaggagggaccctgatgtcctgatttgcaaatcaagagagttgggctgggcagacgtggaggtggggtggggagtgggagcacacctttaatcccagcgtttgggaggcagaggcagaaggatttccgtgagtttataggccagcctggtctataaagcgagttccggggctgttacacagagaaatcatgttttgaaagaaaaacaaaaacaaaatatgagagaaagagagagaggcttctcagccctttccagcttcgtaaagctttaattttcaagaatgctcttgccaggcagtggtggcgcacgcctttaatccctggatttgggaggcagaggcaggcagatttctgagttcaaggccaacctagtctacagagtgagttccaggacagccaaggctatacagagaaaccctatctcgaaaaacaaacaaacaaaaaaaggaatgctctgcattcattccctgaatatctacttgccaccaggacacagcagtaaacaaaaaaccaaactactttcacatagtttacaatctagcgaacaaagactaaggaaacaagaaagatatatgtggaactacatattagaacatgcaaaggagacgagaaggggagcaaagtaaaatttagtagaaacagcctttcaccccattccgaaagagaataagacaaaagaactaattggaacccgccaggtgaagggacgcgcagcttggccaccttagcgcctgcgcactgagacgtcgtgcagacgccgtctggcggtgtctcggaagcgcatgctcgggagcgcgcgctcggcgttggaggtggttggtcggtgagagttgatggaggagattcgaggtgaagggggaaagcacgtgatgaaatgtggtccagagagcttgtctaactggacaggagcaatggtgactgccgcgggcctgtctggcggggccccggctcccccggaggtgcggggtgggtggattgcgcaggcgcggcccggcctgcacgggatgcccgactttccagaccctagaactgctcattacacattcaccccgtttgccaacggtggctaaatgctgtcgtagccccggtttttccaggctttaaaaacaaaacaaaagagcctgtcacctgcctcactgttgtcacttaagaatgagacctttaactacctagagtcttagggtttgtataagaaaacctggaatcagggtccgaccaccccatacactcactttttattgccaagctatgttctggggatataaaagaccgagagtatcaatataaaagaatatcagtaataagggcctttctgcaagctatcaagctacacaggagcaggacttaaatatcaaaggagttttacctcccccacccccacctcttcctgagaaagtaatggcttactgtgtctccttgatagatttgactttgacttagtcccattgttttttttaccttcttacttacagtgtcttagaacatcaaaggattttctaaaagccgtggttattgtgtaaagtataaatgttatgaaactagcttggacttttttcatgaataatttctagctaatgtttcttagctgcgtttaatttaggcatctgtttttagtgaagtgcttagaaatttgaatagtgtctttacggatcagcatctagcgtaattataatttcactctagggcattcattttaggaacagcgaaaattaatgaaattatgaatgctttggaattgaagcttgttataccagtgcatgagttttgtgtgctgtctagaaactagaagtatacttccctttcgcgttttggtttaatactctaactgtagttctttgtaatagtcgagagaaatgggtgatgtgatataactgaggtttgctagagtatgtgttgtgttttgtttcctgtaggtgattattttccagtcagagaaggaagccagtgtctgccactccctccacatgtgtccctgccatgatcaggtgtctatcagatgacgtaaaaaccaagttgcgttccggtttagccataagctccttgggccagtgtgttgaagaacttacccttaacagtattgatgctgaagcaacatgtgtggccatcagagtgaatatggaaaccttccaagttcaagtgatagacaatggacttgggatggcgggggacgatgtagagaaggtgggaaaccggtattttactagtaaatgccactcagtgcgggacttggagaacccagcattttatggcttccgaggagaggccttggcaagtatagccgacatggctggtgctgtggagatttcatccaagaaaaacacaacactgaaaacctttgtgaaaatgtttcagaatggaaaagcccttgccacccatgaggctgatttgaccagaccaagtgtggggactacagtaacggtctataacctgttttaccagtttcctgtgcggaggaaaagcatggatcctagactagagtttgagaaagttcggcagagggtagaagctctctcacttatgcacccctccatttctttctctttgaggaacgatgtatctggatccatggttcttcagctccctaaaaccaaagacatatgctctcgattctgtcaaatttacggattgggcaagtcccaaaagttaagagaaatacgttttaaatacaaggaatttgagttcagtggctacatcagctctgaagcacactacaataagaatatgcagtttttgtttgtgaacagaagactagttttaagaacaaagttgcataaacttattgactttttattaagaaaagaaagcattatatgcaggccaaagaatggctctgccagtaggcaaatgaattcaagtcctcgacaccgttctgcctcagaactccacgggatatatgtaatcaatgtgcagtgccctttctgtgagtatgatgtctgcatagagccagccaaaactctgattgagtttcagagctgggataccgtgttgatttgtattcaggaaggagtaaaaaggtttttaaagcaagaaaaattatttgtagaattatcaggtgaagatattaaggaatttaatgaagataatggttttagtttgtttggcacgactcttcagacacatgtgtctactcatgagaagtgtgaccagagcagtttccgggaagcgtgtaataaaattctggattcctatgaaatgtttaatttgcagtcaaaagctgtgaaaagaatagctactctagaaaataaaaccagacaaaaccctggtgattcagaaactatcagaaaaaagacagtgggctcattgtacacagatgcatcggatggcccgtgctatagtaaatcggtagagtctgttttacaggacagcaacaacagtgcttacttagaaccgagggtgtcagaagaagaggtagccaaaacatcacactccggagaaaatgagaaatggaaaaaatcttttttggaaaataagacttcaggaaggatacatgaaaccagtccaaaaatgttttcaagccccatccaaatgcatcacctccttgaggagagagaggcagatctggaaatgcagacaataagtagtactgttaatgtcatggctgccaacattccccaaaataatgacattccgagtcaactggagaaatggaaagatgctcctgaagtggggtgccaacctctgccttttgagacaaccttattaagggtacggggtactcagaggaagaaggaaagaaggaaaaaggagcccagtagtcgtggaagagtaaatgtttttagttatggacaagttaaattatgctccactggctttataactcatgtagtacaaagtgagcacgctaaatcaactgaaacagaacattcatttaaaaattatgctcgacctggtcctgtaagtgcccaagaaacatttggaaaaagaacacaccatgcaattgagactccagacagcagtgatttaacaagcactttaagtaaagaatccagtcaaccgcccaacaaaaggttttgcagaacaaatacaggttacgggacagagaacaaacctgtagcaacagatgacaacttggctctttttcaggaaagctgtaaagaatcacacacagatcgccttttgcctgatgcatcctccttcccatggtgtagatatgtttccgatggttgtaggaaaatagataaaaggggttccttcaaacaggtagtccgtaggaagctaagcttgcgttcacaagtagggtctttagagaagtttaagaggcagtatgggaaggtcagcagttccctagatacagaaaaggataataacactgaagtcaggactcatcttgatcctcaaaatgaacccgatgttcttctgaaagacaagagccacttagatatgtctgatggttgtgagatcactactgtggagcacagtgagacttgtcaaccattaagtcccatcctgtacccagaaaaaattttattttccaaagaagatcgcttagaacagatgcctcatttgagagaaagtcctataactctggaagaattatctcactgtaacagaaaagctgatgttgagaagtccgctgcatcactggcttctaaattatccaaactaaaggattctgaaaaagagatgcaaaccgtggggatgacaggtcatactagtgaacttccagattcaaatcccagttggaaagataatagccagtgcactaggttagacttggatttttgtgaattattaaaaaacaaacttgaaaaaatagagagtgatatgcttccaatggcagattctgccacagaggatggtcccatcaataaaaacagtgaactacatcctaacaatacaacggatgacacagagaaaccagaaactcctttgctgttcccctgtaatgattctaaaatcagcagagattcagatgttcttatcagaacttcagaacaacctacaggaaaccctgactctgtcggtaaagtgataatgagtcaggtagaggatggcattggcagccaaggtggagtctgtccccagggtgatgaatctaaggcaagatcttgttccaaaaatgaaccaaacgcacactgtatggattggcagcagcattttgatgtaaccctgggaagaatggtttacatcaacagaatgacaggacttagcacattcgttgctccaactgacgaccttcatactgcttgtactaaagatctgacaactgtggctgtggatgtcctgcttgggaatggtaagcatgcaggactcattggtgtgaaatgtttttgggaaagagaatagtggccaaagagcaatataatttttgttcatagaggtgacctcagcagatagcattggaagactgtgcttcatatttttttgggagggggggtcaaggaataatgagataaggtcttgctatgtagtccgggctggcctcaaactctctttgtagccaggttggtcttgaattcatgatagctcctgcttctagagcctgtagaagtaaaggtatgtgccatctcactcagcttctgaaggcaagtttttaagacctctgctgtggttaaggaataacacagtaggttcactgatttacgagtgacactcataagtcactcatggagagtcactgggtttaacaatgtttaaatataagaatttagtagctccccctcttctctttctgctgcctcctcctctcttctctcccaataaaacctcttccacaccgggggaaagaaaagaatttagtaaagactgataaaagatgtaaatgtatttacatgtgtctaagatgtttgtgtgtgtaagagagagtggggaacttcattttaataaaatggtacactgttactggctagaagacacacagtttttatctaccctattttccctttcttcccaaatacacttgtagaaattatctttagaggcatgactgcttccatttgtggctaccagcctaaggttggaaaaacctaagtttccaataagatctgtaggtcagcatagtgcgcttttatgagcttcccctagaatataggatttggccacattttgcaaaatgtaggctaggccttcataactatatttttcaaatgtactttactataatgcgtttatcagtccacttgctatgtttctgatgtaagaagttgatgataacgtggctctcaggtcacaccacaaagcagcaccagagcctggtctaggactttgggttctcaggtttcccgcaacgttaaaagtgacattgttttggcagtgtgttagagccagatgttgggagccggtaaagctgattcccatctggctacaatctcggctttcaccagtaggataaacattaaatatgcatccccgttaaaagtctcaaatgctgtaaaagaatgtaaattgtatgaatataattgcaaattacaatgccttcttaggataaatatttctagttgcaggctctgatttacttgaggttaaataaatcctgtagtgttcaatgcttttttcttatggaaaaaaaaaatcactattgtaacttcaagagaatttaataggaggagaaaacctctttattttcggtattgttcttgagactgtccagttgctcttacggcatctttatgggctgcgcagtcggggtcgtatgcactggcttgcgtgtgctgagctgctcagagaggaacatccaaggcagtggcctctcatctccctgaaatgtagctgcctctgacacagtgccaacagataactggatggcgttcaactgtggggtggttgttgccaaaacaagggggggcatcttagctgccacattcaacataaacatcggctcctgttaagtagatgtagatgttgaagcttcttcaatccacttaaccaccgggattaccgtatcttgtgaacttttgcgaatcctgttaaatcaagttccaaatgaaaaatgattttggtatcaaaacgagttcattgaaaaggtggtgcctcacatcctccattgacatggaaatgtgggacatcatgacatggtagacccacacatgaaaatgtaaacatgcagtaaattactgagggactcgctaaagcttattaatctttaacacttgggaagtggaggcaggaggaccaggagctgaaggtcaagtacctctcaaggccaactgggcgtgaaacccaaagtttactatataaagctaaacttagagtaacgtcatatccttttttctttatttttaaagatgtatttattttatgtatatgagaacactgttgcagtcttcagacacaccagaagagggcatcagatcccattacagagggttgtgagccaccatgtggttgctgggaattgaactcaggacctctggaagagcagtcagtgctcttaactgctgaaccatctctccagccccgtaacatcatatccttaacccgtgggatttttctctttaaaaatgtcttcttttcccagtgcagggccttctacatgttgtacactgtaccactgaaccgcagccctgatcagtgtcctttattatgacttaaacagtgctatcttagctagtatcttgctctagttttgctcaataggtttgccttttcaggtaatagtcctggtatatgttcaactttttatttttttaatttattttatgtgtttgagaatttttggttgcatgttggtccaatatgttcatgtctcatgccggtggaaggcagaagagggcatcaaatcccatggaactagagttacagatggctgtgagccactatatgggagctggggattgaacccagatccgctgggagtgcagctggtgctctcaacactgagccacctctccaggccccatgtcccccacttttcaaaactgtctctctgtttctaagactcaaatctgctcttccttcagaaagatggttagaactagacagtatctccctagactgccgtgtctgcacctctcacccactcatccatcttgccgattcattcagcatttgttgcttgttaaactgagggaggtggtgtcttacttctcagcctttcagtctattagggatagctgtgttacacgatgcaatcatgcttagagtagagacgtgggttgtggataagggacttataaggctgcagcagttgtggggatcgttaactacaactgtgtgtctgacaaggcattcctgagtaactataccttttagggtatttagcaccccccctttatctgctggatcccaggagctgcaccatttacccaaaatatgaccatgaaaatgactcaaggcattgcctaatgtgcctcccacccccacaactgcctccctttggctgttgagaatcacattcatgaataaagaaataagacattattaatgtaagttagcagatagtttcattgacacttctgattttctgtgtagtgtttcgtagtctgccttatggttttggtcagtttgtagagcaaaggattttacatattctttaatagtttacttgtatgttgagttcaaacttgtaggtttccttttttgcttaggggctcagtacaggtgtcatccatttagaagcgatcttgttcttcctttcctgccaagagctcaggaagagaggaccatgctgaggcacaacagcagtgagtaattgcagcggctgtggagacgcttggtacaccccgagcactcagtacagaagacaaagcagtgtgcattctaagcttgatccgcaccagctgtgccttaggagccagacttccccacggctctgtttaacagcagagctaagtcattcagcacatgcgtttaggtcagaaattgcttttccaggctggaggttcgtgcagggtttgtgcgtacgctatggtgtctgtgactggggaaatggtttttatttttaaagattaaatttctccatatttcagtagtttgatctttgtaaaattctttgaaaaaaaaaagctaaagaaatctattattttgttgttgtttcttaaatagattaagtatatttttaccaaagacaacaagaaaatttgaactacagttttttctggacacatacttggaaatattcttcctttttaaaaaaaagacttggttttattttgtgtgtatgggtgtttttgcctgcatgcatgtctgtgtaccacgtgcatgcaatgtcctagtccagaggaaggcagattctctggaattggagttacagatggttgtgagccaccatgtgggtgcaaggaaccaaaaccaggtcctctgcaagaacagcaggtcctcttaaactctaagccatccccccaggcacctgaaacattgttatagacaatttggagaaaactatgcccaaagatcctgtcaaaatcctagttttaaagtagcattaaggttgggtgtggtagcacaaacacctttaatcccaggactcaaggggcagaggcagttgcgtctttgtaggtttgcggtcagcctggtctacagagtgagttctaggtcagccagagctacatagtaaaaccctatctccaaaaccaaagaggcagcatctgaacaaatacggggaatgtggggagagtctttggtcttgagactatagctcagtacccgaggacattccctctctgggccttgatgtcagctctccccctttgttgtagatgctgtggatgctgctgctgctgctgtcagtgaaccccttcagtctctgttttcagaatggagcaatccagtgtttgctcgatacccagaggtaggtctgcagcactttttcattgcctgttgttaagtttgaacttcatttaagctgggtatgggcatgcctgcgtatatgaatttatgattatgaatggaagcggcaggttctcagctggtttacttggaaattagtgtttaatgtagagaggagaagtcagcactttggaaagggcaggaattttggcttaaacacgtatattccgtgtaagagtaaatgcctttgtcctgtcttacagggtggtagtaagttgttaccattcaacaaaatgtcatttcgtctgcaggaacagggctgcatgtcctggcagtgttctttctttggtgtgttggcacggcatgttcccagtgtggtaatgagtgtgggtaacagacaagcagttgactactgattcttcacttaagatgccttgaaggacttaatcatggatcatagacagattgttctgaaataatgctgggttttgtcagtgttcattaaaaaaaaagttagacaacttatttttagagccctttggatctaaagctttcctacattcatcctgtcccttgtaagatatatgaaaatgtttggttttattttttgcagtgctaggagttgatcctagggcctacatgtgctaagcagtgctgtgccaccaaccgattatgttccaagccccccaaagtgagggttctaatgggctttgaaatcatgggtaaaacagttgcacagaattaaaactgaagttttgtctttcctgggtctctctaggttgctgttgatgtcagcagtggccaggctgagagcttagccgttaaaattcacaacgtcctgtatccctatcgcttcaccaaagagatgattcactcagtgaaggtaaagcggaatgcttcacgtacactagctccatgaaatttaattttttgtttttgttgttcttctctgtgtagctttggatgtcctggaactgactctttagaccaggctggccttgaactcagagttcacctcctgagtgctgggactaaaggtgtgtgctacacacccaactaagtgaatttttttttttaagtgagacaaactgtattagtcaaggcatgttgtattagttaggcctctctagaggaacagaaatgatagaatgaatacatacatatatacatacgtgtgtgtgtgtgtgtgtgtgtgtgtgtggagagagagagagaacatatgtgcacatatgtacatattgtgtatatacatagaatggctttcaagctatggtccaaggagtccaacaatggctgtctaccaatggaatgttcaagaatacagtagttgttaggttcacaaggctggatgtctcagctggtcttcagtttacaacataagcctgaagaagtcggcctagtgccagtgaaggaacggacttgccggcaggagtgagggcaagcaaacgtcttctctctgtgtcctgtgccagcaagaagtgtagccagattaaaggtgaatcttctctttcaaaagatctggattagaagtgggttgaaaatgatttaatcaaggggaaaaaaatcccacacaagtataccaacttttgggttttggttaattccagatgtggtcaatttgacaaccaagactaggtgtcagacatgggtttctttgcttataatctgactggaatcttaaatcatcatcatcatcattattattattaattttacttttaaatatattttttgtttatgtttcaagccagggtttctctgtgtagctctggctgtcctgaaacttgctctataaaccaggctgtcctctaatgccaccatttcccagctggaaccttgagttttatcttcaggggaaaaaaaatccagattaattttaatagccaagaagaatacctttaattgtgtgagcaggttttcaggggctggattatagtttaggctgatagtatcatggactgttaacatttctgcagagaattatatttcaattttatattttataacaatatgaaaaaataccaaaaaattatttataaatcaacactgttgttaactgcaaaaatactcacttttaagcgatcctctctctgtgaggctaaggaagccatagactgggaggttcgttaataagaggacccgtgactcttgtccttttctgctgtgttgtctgtacactgctctgtctcagtctccttgctttcagaattggaataaactagaacgtgaatcccaaaggtgaaagtcaggtaatgaggtttgtgacaagcaccgtctcctgtggagccttctcactggctcctccactgggtctcggctgtgggtatagcaagttgagtattgtcttacctctttatgcaggtaagcgtttgctaatttttggttagtgtcacatgacttatctccgtgaatcgcaggttctccagcaagtggataacaagtttattgcctgcttaatgagcacgaggatggatgaggatggccgaacaggtaagcaaggagttctgcttcactaatgagccgtctgggtgataattgccttttagagtatttgtggggtacaacaatttgtgtgggattaaaaaaaaaacaaaaaacaaaaaacaaacaaaaaaaaaccaacagataaaggaaaaccgacctaaagtgagaacctgaagcacattgtaaagtacatgacctgtcagcgcatcaacacacacgtaaataagatgcatagtacgtttttagtcttttgagatgtagcccaggattgtctcatactcatggcagtcctaatgcctcagcctgactcggatggcacaggcctgtaccacacaacacctggctcattaaactagtaatagtagttcactcctcgtagtagtaagaactactaatagtaattgcctcggaagtgaaatgaaaatgggcaaagggagaatttcattttctactcttttaaaatatgttatagacttgtgtgtgtgtgtgtgtgtgtgtgtgtgtgtgtgtgtgtgtgagacatgtggaggccaggggtaacttaaggtgccttcctacagtactttgtatccaattttttgggacaagtttcttgtaaacctgaggcctactgtttgtgttagactggctggccagcagtggtacatcggcctcatctgcctgtcccagcctttcccattgcttcggctgcaggtatgggccaccacattcaagcttttgtgtggatgctaggggtccaaactcacatcttcatgcttgcacagcgagtattctcctcctgagttcccagaccccacacctgaaatgactctataaatgtctgtatacacaggtgttcatgtacacatgtggacattaaagaataatcatgggtggcagttcagggatggcatccatctcctgtcagacagtgtttctaatttctaagttgtctggagctcaccagttaggcagccctggctggccagtgagccccaggcatcttcttgtctccacctctgtagcttggaggttacaaggatgtaccaccataccaggcaattttacatggattctcaggctccaactcaagtccttgtggttgcaaggcaagtgctttacccattgacccatcccccagcaccttgtacagtgttttcatctatagtaataagtttatataaatttatgtaatgtgttttgctaggtttatcaagtgtttacatagaatcaggagtctggagagatggcttggctgtgaagaacactggcctctctaacagaggacctgggttagattcccagcatctgtagagtggcttacagctgtttgtaactccagtcctaggggatctggtgctgtcagccttcttgaacaccaggcatgcgtgtggtgcatagatacataggctaaacatgtatgcacataaagttaaaaaaattaaacagaattggttcgtaacttgaattaatgaggcaatagttcctatataaatcattcaacaaatattatttaatgcctgttgtttgctagggagtttaccaagctctaggagtacaatgataagaaaaaatagataacagtcacacaaacacataaaaatttaacagtatctcttaatggggaagtgaaatgtggtgtaagaactgatgttgggaatttcgatcttgtcagagaggtcagcagaccttggtagagtgagcctgaagtatgagcatgtcaagaaaggaagtagtaatttcctgtttgtcaggtggagcaggcagtaaggctgcagataaagctgggaaggaagtagcagccagatattaaatgtcagcttcaagctttgctgtgtcccaacactagctggaaacagtgttatgtcatgttgcgttttaggactgttctagttgcaatatggagaatggagtgagtttgtgtgcagttctggattccacagagacagttaaggagatattgcagcatctaagaaatagtgaaggagaagtgaaagcattagaactgagtgttcattgtatgtggacggacaatccagcactcggaagaccaaggcaggagatgcaagactatatactatagcctgggctaccacgtgtgacctcgtctcaaataaaacaaagaaacaacaactgtggatgcagtgagaaagcaggagataaagtgaacagagtcgttgataggttgttatgggagaggaatggcaaagataatgcttaattttttgaccactgtggccgccaagtggacgacaatgttctaagaccagattagaattggaacaggctagaaggacaaaaatcacaagtcaatctaaattctctttgaaataagtattaaagaagagctggcaaaaatgtgtttggcttgtgcaggtatagactcaagtgttctgatcaggtgatgtaaatttgagtgtcagcataaagttagttattagtgatataagttttatcacctagaaatatagagagtgagaaatggccctgagtctagaataattctaacatgtaaccacagctgactagaaaggcccgggcagaagagaaggaatggctagagaaatgcagagaaggaaggctgtcgtgctgcatctaggacctcacacagctgctgctgtactgggcactgttgagttttgtgactgtgccttggccctgagactgagagctgtctgacggaagagatggggcagaaaccatggctgctctgaggaaatctgagccctggaagggagggaccagcagagagagggggaggtttcctttccatgagaattctgagtacaattacagttgtctgcctgttctgtggtcttgctcccctcggtttcagttacccacagtcaaccaaggtcagaatattaagtggaaaattccagaaataggcaacttacaagttttaggtttcaccctcctctgaatagtatgatgaaatgtcctgtcatctcactgtggtccacccaagttgcaggtcactcctctgtgcagtgtgtccctgctgtgtatcctggctgcctgacactcagctggcactcagcccctgcgtacatcaccaggggaactgtacagtactgtcaggtgtccccggaagcgttattgtaatgatgcatagagtatgatagaaatgatgttagcatcttgttgttagcctttattacttatttatgtttatagtactgggtatgctatacaagtactcgtagcactgagccacacccctggcctgttttattattaattattgttaatttattgctgtacctaacttttttttttgattcaataaagttttattttcccaaatgcacagctgattgaacctgctcatgctcttcacccgcagctggggcgtctccaccctttgtgtttctggggtaaatgactggactctgtgctttgaaaccagcttgataagtcctttactaaggagttcctggagggctgccctggccaaggaaccgcgaatcttcagtctctcggagaccacggctggagtaataagcttatagttgggaacttccttatagagtttgtcgtatgtcgctttgtcaaacaggacaagattgttcaacttgtcctgaactttgcctttggaccacttcttctttttggccttgccaccagatttatttactgggtctttgtcctttttggctgactttccggcgtctttcttcttcttggcatctttcttcttcttgtcgtctttgggcggcatggcgaagctcagagagtcgtgtggaccactgcagcctctgtacctaacttataagttgaactttagcatagatttatagatctagacaaaaatagtctgttcagggtttggtacaggagttggttctctcccgctaccttttgggtcctgggtttgaactcaggtcttcaggctgggcagcaagtgtctggcctgctgagccttctctccagccctgaagttttgattacttgaaattctgtgagttttgaaataccaagatgtcagccagtggcacccaggatgagcgtgagcacagaaactgtgtcttcaaagaaacgacaaaaggccactagttaaacttctcttgagagtttatatttattgttggatatgctaccaaagagtattcttcacattcttttggaggggtgtattttgagacagggtttctggctatcttggaacttactctgtaaaccagtctggcttccaactcacagagattttattgcctctggctcccaagtgatgggattaaagatgtgtgccatcaccccctaaccagattcttttcaggagcaaaaccaggatgagagaattttcttctcttctcttctcttctcttctcttctcttctcttctcttctcttctcttctcttctcttctcttcccccttccctttctccctcttgctccgccccccccccccactccttcctgcctcgtttgctttgacccataggttctttatttgtttctcatttgggatggttgtgagccaccatgtgattgctgggatttgaactcatgacctccggaagagtagtcagtgttcttaactgctgagccatctttccagctccaagagaattctcttgaggctgaggatgtagctctgttgctagcatgcttcctggtgtggatgaaagcctgggttcaaccccagcactgtataagactgagcatgttctataagtccaggaagaggaaggcagcggtagcatcttccttagctaaatagcaagttcaagaccagcctgagctgtttttcatgagaccgtcagaaacaaagtttaatattttcctccgaaccaaatgtgagtgtttttatttctagtcataaatatgcaacctattcctaagttgacatattttaatctttatatttgcctgtttgtcttatttttgtttttgtttttgagacagtttttttattgtatagccctggctgacctggaactctctatgtagaccaggttggctttgaattcacaagattatgttcttcctgagtgccagggttaaagacatgtgtcgtcatcactcctaattaatattgacatattttaattggatacatgttattgctctaaatttcagtgaaaccaataactaaggcatagttcttcctaccttgagctatgttaattcagttatccattctaaagaataaatttattatataaatagttatcaagtacccattatttaaaattctattttatgtgctaagaatgtaacatgaaaacatctcatagaacttctgtcctgttgtgatgtcaaaatgatggcgtctgtgaacaaattgtctttctgtattctgcttcattcaagaaatgaaaagctcataacattgtatagacaatggaaagataagctgtttttctgttaggtacaggcctgatttcatggtgtttctgagtttggtagtttgtgttgatgttcaagccactcctttgaagggtgtggctttttctgtggttttgcccagtgttcatcagaaatagcagctgcagccgggagtggtggcgcacgcctttaatcccagcactcgggaggcagaggcaggcagatttctgagttcggggccagcctggtctaaaagtgagttccaggacagccagggctatacagagaaaccctgtctcgaaaaacaaacaaacaaacaaacaaacaaacatagcagctgttcttcctagcctcaaagaatatcagtagttaacatgggggcattcctgtgttatagctgttgtcagaagtcagctatggggcccggagagccttagttagtagagtgtttgcctcacaagcaggagaacttaagttcaaggcccagaacccacatcaataattttaagattctatgttagagcatggataaggaaacaaaaatcccaaatccacatctcctttctattcttcaattttaaatgcatcctaacatatgtcataaaagttaaaacatatttaaagttgggtggtggtggcacgtgccgttaatcccagccctcagagggagacaaaggcaggcagatctctgtgagtttgagaccaacatggtctacagagcaagttctaggacagggccacacagaggaaccctgtcttaaaataaaaaatcaaaaaccaaaaagcacatgtctaaagagaacaaatgaaaaccaagtatatgctgggctgtggtggcacaggcctttaatcccagtacaggaggcagaggcaggcagatctatgtgagctcaagggcagcctggtgtacaaagtgagttccaagacagccagaactacacagagaaatcctatgtcaaaaaaacaaaacaaaacaaaatatgacacatatttatgtagatgccatcatgaaattaattcctctgtttgctaacctcaaaatgattagtttattaataagagaaatttttaaaaaaacagatgagtgtgctagcatgcaattataatcccagaggtggagaggcagagagacaggtgagtccccggggctgaccggctggtgagcctaatggacttgatggacgagctccaagctagtgagaaaccctttccaagaaagatggagtgtctaaagagcatcacctgagattgacgtccgccttgtaaacacacacacacacacacacacacacacacacacacacaccagaaagtttgagaggtgagaggtattgctcaattggtagaaagcttacctatcaggcaactacaatttgctgtgtagttgaagacaaggttattgtcacctgtcagtctgcagccagcctgaaatatgaaataccgtgcatctcctctgtttctgttttctttaaatcttgggctttctgctgtgagcttgatggtatctcccctagcgtcatttctgtggctgagaaaacacactcacaaagcttcttagggaagagtttattgtagctcacacccccagattacattccatcactggaaagaaataaggcaggaatttgaagaagctagtcacatcccacccacagtctagagaagagaaatgagtgcaggcaaaccatctgcttgccttgctttgtctgcttgtcctgttggggccacaaacccagggcacagtgccccatactttcaggcagctaaatgaagacagacctctacatcgtgtccacaggccaacctgcctggacagttgaggcttttctcggttgacagttaaaactgtcagtgtcatagaaaaatgcttcatcttttaatagaaataggaaaaagacactttctattttgatcaaattcaagagaagaacttttatttcaatatgattaataacaataagtgtcaatctttaagccaaaaacaattcaaatacagcttataaaaggtaatattgtcttggaaaattgttctgtctctgagattcccctgtaggtttgaccctttgcctccttgcttgtacttgaaagtctgaagccctgctcttaaaagtgaggcctgtaatcggtggagacttggctcagtggctagcaatgcatactcaagaattctgtcaccaacacccacatcaggtggctctcagctacctgaggttctgcctcacagaaaggtggcttgtgagggcacctgcttccatgtgcagtcatgtgcaccagcacccacatacagacacacaactacacataatttaaaatattttaaatttattttattttatttcacttaaatttaatatgtatgaatgttttttctgcatgtatgcatgtgtgtcacatgtgtacagtacatgtagataccacataaaggcttcaaatttgctggaacaggattacagatagttgtgagctctcatgtaggtgttagaaatcaaacccacatcttctgtaagaacaacaagtgttcttaacttctgaaatatctctagctcctaaaagtggggccagcagacaaggccatctggttgttggttagaattgcagaagcttgtccccggttgttgactctgtgtttgagcatgtttccaggtgacaggttcacccaggaaagctaaaacagctacaactgccgtctgggaggagacacagtgagggtctgtttttctgcagccagggaaataatgatttttacatccttacatggttaggaaaaaataaaaagacttcttgacacagccacattctatgcagttacttcagtgtccataaataaagttttattggaacacagctatagtggcacagattgtctatggctgctttagctcaaaacaaatagttgagtagtcatgacagcatccatgtggcctaaaaagcataaaatatttccattcttcctgtttgtagaaaaaatgttctgccctctgatctaaagttatcagtacattcttcttgagtttcagagtagattgcaaatcaaaagcctctgactataacgtatgcagtgtgttatctaatgattcttcattgtaaagttgacttaataaagccaagtctgcatgagtatttcaaaatttatccttttctagatgaaatgtaaataagttacagagcttttcaccagggacaaatttggtaatttattgacaatttcagggttttggtttttttatatagagtataattgatttggttgtggtagcacacatctttaatcccaacacgtgggaggcacaggcaagtggatcactgtgagttcaaggccagcctggtggatagacaagctccagacctgttaaagctatatagtgagaccttgtctcaaaaatatcaaagcacaattgtatatcttatgtatatgtcattagatgaattgagtaatcagtctttatcaccttccacactttatgattcttttaatcttgatatggaaacttcagtaatcctggattattttgtaggtggaaacctgttagtcctggtggaccagcatgctgcccatgaacgcattcgtttggagcagcttattactggtaagtatctgtctgtagttagaggagatttaagactccagtgcagttggcacacctacgagagtttttgacaccataactgtgaggaagactgcattatatgtttgaaaaattaagctgagatcatctagtctgaaaaccactggaagactgctggaatttgctttgctatttcaaacatgtggatctgatcaatttagtcagtggcacatttactatacatttattctccacctagtcctagctcatttacagtatacatgtatcgatgtgttttccctactgtgtgttctccctgctgtgtaacctccttgctgtgtgctctcccttctgtgtgctctccctcctctgtgctctccctgctgtgtgctctccctgctctgttctctccctgctgtgtgctctccctgctgtgtgctctccctgctctgttctctccctgctgtgtgctctccctgctgtgtgctctccctgctctgttctctccctgctctgttctctccctgctgtgtgctctccctgctgtgtgctctccctgctctgttctctccctgttgtgtgctctccctgctgtgtgctctccctgctgtgtgctccctctgctgtgtgctctccctgctgtgtgctctccctgctgtgtgctctcagtaaatcttccccacagtcctcaaggtcccatgtaatacttttatttttaaaatctcatttatttggggatcaatagtgtgagcgcactgatgtgattctagaagacacaaaaggaaatgcaatgaagcctcctttacattctgtatttatcccatcttctctttcggggcagccagcgtgagtactcctcagctgtatctttccaaagtcactgtgctttttgatggtttttttttttcaatctctgtcatcatgaggcatttttcttcaccaagtgataaaatacaataaataaataaacaaatgaataaataaataaataacaaaaccaaaataaacctcgaccacatagtttctctgtgtagttcaaccttgagtgctctatcctcttagctgtccaaatgttgaaattacatatgcaccaccatgcccttttgaaattatcgggaaaatctttgattcctatgataaagtaatgaacagccttaatgtcaaagagttaagtgagaatccagggagacatttcatgaactggaatcgcaattatgtcactaatattttatttgccttataaattgaaatcccaagagtttggaaagacacaattaaaaaaaacagtgagaaaaattacttactttgagtaaggacttaatacgattcctcctttgtgcctctggtgggtgaaatgcagtggtgtgaggactgccgagggtgtggtgccgatcagtatttgagaggcttcggaggacagttgctgagtctcatcaggcagccagcaaaataaggtcctgttccgctcactagatgctaagctgatgtttgttgctcaagtgtcttcctcactgagtgctcaactgtaagcaggctgatgaccacaagaaatgagctggctgtgcaaaaatgtgaaaattttttttgcataaaaattgtcagaggaagacagggagatggagaggctcgacctttccatggcttgcccaaggccagaactgttattaaagtggtgggctgtggtgtggcagttaaagactctcaggctaaggaggtcatcagaaagaaatgggaaatacaagatgtggacaaataaaagtttgggctctttcaaaacaagcttacaggtgagtgaggcggtttagctggcagagcacttgcagagtaagcctgacaacctcgttcaatccctgtcgcccacatggtacagaaggagagacctgatctccatgtgtgggtcatggcctgtgggaaagccctcgccacaccaaagcacacacatcacacacacacacacacacacacacacacacacacacacacacacacacacacacacacacaaataaataaataatgtgaggctggagagaaggctcagaagttaaaagcagcagctgctcttacagaggatccaggtgtcccagcaccaaaatggcagctcccagctcagaactccagttctgcagattgtgatgctctctgccctggcctctgtgggcacaaggcacacaagcaggccaaacacctatacatataaaaagccaactatttaagaataatactggcaaattcttttcaaagactgagaaacctttctgaaggaaccaagaaaccatcttgacttagaggattgtatagatgtgatgttctgtgtagagacattttgtatctctgtatcaatatcacacacgttaatcccttgttgtggatgtaagagttaagtcttctatttcttattttgaagaaatgctaaaatgagtcaagtggctgactgtcccttagtttgcttagaattcaaactgtagaactgaacactgaacacgctatgcagttctagagaactcttgccaccacacagctcaccaagtgtcttcttatgtaaaactgatgtaaaagacttcccttattcttctctcgttcatctctctctcaatagattcctatgagaaacaagatccacaaagcgctggccggaagaaattattgtcttccacaataatccctccactggcaatcaccgtgtcagaggaacaaaggagactcttacggtcagtagcctgaggacatgatgccagtcggtctgtaacacttaccatagctctgtgaggtttctgcatgcatgttcctttttttctttccagagaaggaaactgagacaaagagtgttgcatggcttacccaaggtcttaacggttagcagtgcaggctcagagcctgtcttctaaccccaaatgccattcttctctctatagcatagatactgagtataggatagaatttccctggtaatgttttccagcatttggcttagaacacttctccttcttggaacagccaagtgtttatgctgcactgtttctgagcaaagttagggagataattgtttccattcttcttgtcttggtccattctagattctacatttccataatcttattatgaaagaagcaaaataccaggatgccagggtggggaaagccctgggccaggtcacagcacaggtcacaggacaggtcacggcataggtcatttccccacttcggatacgtgtatgttttttgaaaatgaaaatggtccgttcgtttcaggcctggttactccctgctgccaatgcagctttccctagaacacaattcacttatttactgtcaccaactcgtccccagtcaggacatccccagtcttggagctgttaattacctccctcttttaacaccgattcaaaatattgtcagacctcttctttgagccaaactcctttaaatgcaggcagcaaattagttccttagtgaagaatggaaacttaagaataagatttagaagtaaattggttctcacaatagaaaaacagaaggaaaatcagttactctacagtagtcttccctcatatgtgatgggtttgttcaggacccctattggatacctgaaaatgtcactaccgagtgaggcctgtgtacatatggttttcccatggtcagtcttcagtattttatgctttggtgcctcctttgcatcactacttaatgtgtttggggagcatcataaagtcaaatgagttacttcagcatagactgcagagctgggctggaggtgtggctcactgcttaggagcactcgatacttttgcagaggacccaggtttgggttctagcaaccacatgaagtctcacaaccaactgtaactccagttccagaggatcccgtcccctcttctggactccacaggtgcggggcaagcatgtggaacacatacacgcaggctaatatccatagacatcaagtacaaagataatagatacaccttttttaaaaacgtgacctgccttagtgacatgataagtaagggactaacagacaggcgtgagcctttaccatgcttctcagagcggcatgcaatttaagttttatggccagggacatagctcagcggtagaccatatgcttagcatgtgcaaggcccctgctcagtccctaaaatgaagtttacttctggaattttccatttatttttttggatcacagtcaaccactagtaactgagttcttagaaagtgtaactgtgaatgagaattactgtgattggaaaggaaatttgataataaaatcctaacacatataagcatcaggaaaacaatacgacttccaaaggtcatagcagcttttgaaaatgatggagtgtttggagctagctccagagagagtgaagtcatgcttgtcatctggggctgtctccttaggtcttaccacaaacatttagaagatctggggcttgagttgctctttccagatgctagtgattctctgatcctggtggggaaaagtgccgctctgctttgtagnnnnnnnnnnnnnnnnnnnntcttgctgaggccgctaactgcaatctttgtcgtcggttctgcacatgtttgtgtcatgttcacagtgccagatgatggaaattgacagatgtatgaggtcacagtaaggaggaaggacgcagttataacacagtgggatatggagtatagaggtgtcattgggagggggttagagctacatgtgtagcccctgtcagtcatttcagtgtgcaagaggggaggaaggaggaaggagcttaaagctaactagggtttcactgtgagactttgtgtttttaaaggggatgggggaggctggaaagatggcttagaacttaagagcaccttgcagaggacctgggttctgttcctactacctatgtgttggctctcaaccatctttaactctagttcctggagagccattgcccttttctggccttcaccaggcccacatgtgatccacatacatacataggtttaggtaaaacactcaggcagccagatagctcagtggataaaggctctatggccatatctgacctgagttggatcctcaggacctacatgacagaacgagaaaactgaccacttaaggctatccactgacctccacatacataccgtggcatgtgcatatgcatgcatgaatgaacacatatgcatacacgaataatgtaataaaataatacacaaaaatcagaagacagacttagtgactgagttaggacagataatctaggaaaaggtagaagcagggtgtgtggttaaggctattgtacttgttcccatacaagaagatggagattaagtcattagtagtgggaatggaaaagaggaacagatttgatacctggatgagagagagactccaaaagatctggtgcaaaaagaacacaaaagaataaaggagaaagattcatctcggtgatcctgagtttgtgaccagacagtagtgtcaccaaagaggaaggcagtaaagagcagcatgcctgctgggtgggcacttcagtgcagaggtgtagagatgcagagacgataccttcaggttggggtggccaggggcctggcagactacagtacagctcttgcaactagaacagaaatctgggttgtacatatctgttggcaataaaagcatgcccactttggtagcattggaaggtgagaaaaggccaggagccaaagagactgagagagcatagatgaggggggagaacagaaggcagaggatgtgctaggtcaaggaagcgaggctgaaagagccatgagatgaccgaagatgctgaggaaggacgagtccaaggaaggtaatggaggggaagctacaggcagagggagggaggtagcagtggccataaagtgagacctggccaacctggcatcatacacctggaattccagcactctggaggattactgaggcagggggattacaagctcaaagccagccttgaactacagattacataggacaagccttaggtttccttccataatgctgaagtaaaaagaaaccaaagcctcagccgggcgtggtggtgcacgcctttgatcccagcactcaggaggcagaggcaggcggacttctgagttggaggccagcctggtctacaaagtgagttccaggacagctagggctacacagagaaaccctgtctcgaaaaaccaaaaccaaccaaccaaacaaacaaagaaaccaaagcctctggctgtatccagagggagctggggtggtggctgaaggttaggcgtggttgagtctgtgtgtgctggacagaaggctgcaggacttgagtatgtttgagggttgagggtgctcctggtctatctagcctatgttgttccaaccccttaagtcactgttggtgacagccttggctctgttttaagcagagctcttctctgcccacacagctcatttcttctcagacttctgctctggatttgaattcaaattgtgttgaatccaaaagataggatctgtgagaatcttactgtaattcaaatacctaaagttctaaccagaacattataataaaaacctctcctgaagcgacttcaaagactacttacttttaaaaaaagagtttactttaaattgaaacaaagtttgtggtttcagaaaaatttgattatattaagtcaggtggataggcagagtccttgactttggaagaagttggagcaattctcttagcaatagagtcattgatacattcttaccatttgtggtccagtttgatgtctgaggctggatctcattatgtagctctggccttcactcacaggtccacctgctgggattaaaggcatgtaccatcatgcttggcaagacggagccttttaacatcattaaaatgttctgcactaactgaagtaagccatgaatggaaagtgagacccttcttcctctgcagccttacagatgtgtttttcagtcccactcacacatcagagagcaacacagttagccttgattcctgaggtactgggctttgcagaaggttaggtggtgtttttgttaccctatagggccttgagcctagatcttggtaaccatgagcatttataaagctttacagacgagctttcggagagaaggacatagaatgattgatttcacttctaggtttcaaaagaaaatcatcctgttgtaatcttagaaggctgatttcgagaagtaataaattctgtattcttttaaaaatatattaaatgtaccataccttgagacaggttgttgttgttttgttttgttttgttttgtttttttgggtttttttttgttttatttttacctccagaggctaaacaaattggcaacattaaatagtatcagctgtaattaaaattttccattttagctggtgctggtggccctcgcctttaactccagcagtccagaggcagaggcagaggcagacagatttgaattcgaggccaggctggtctacaaagtgagtgccaggacagccagggctacagagaaaccctgtcttaaaaaaagaaaaaagaaaaaaaagtagtttagttggttttacttttttatttttgtgtgggtgcatgggtgacaacagttctctccttccaccctgggaatcctggggcttgtgcccttacctgctgcgcatctcatggggcctaggctttaagttattttgtaattaaagtggtgtgggcagactgaggcaggaggatgacaagttcaagaccaggctgaccttcataggaagagtgtattgaaggaaaaactctgcataaggacagagacatacaggggaggagaaacttctcaggagagctttggaaaataagcctctcaacttgacgtccacggagggaaacacccatacacacgatatgaaaataaaacaaacctgaatcttaaccacgggctccctggggagcaggtttccttctggagtgttcacacatcctttctctgggctgactcccctgctggcctcctccccatctccccgcccactcccgcctttgccccgatcctttccactttaatgtccctgtcacccttcaccctcaccccctcagagccactgggttgtctcaggagtcccttgctagtttctagcctctgcccacctagataacacatcctgttggaagctaagatctgcgtgtgagagacaacatgtgtgcttgtctttgtgggcctgggtttcctcacttggtgtgtttccacgttttgattatctgtccatctggagatgggtatctcttttggttccatgctcttcccgttgtgaaagagcagctgtggacgtggatgtgcagtccctccatggagggatggagtccttctggtgcatgccgagaggggagcactggctcacatggtagttctcccttagcctttgagaaggcttcacagtgggttttgtagtggccgagcacttcccattccagtcaacccctgatgaggctcctcctacagtcagtccatcctcctacagtccatccagcccatgtggtgttttctatcttcttttttttttggggtgggggggtttggtttgtttgtttgtttgtgtatttgtctttcagggcaaggttactctgtgtaagagtcttggcttttgtggaacttgcactggcctcaaacttaagagatttgcttgcctctgcctcccagtctctgggatcaaaggtgttgcaccacccaccccagtctggcttcacttgatttaatgatagtaattctgactgcagtgagaaggaatctcacaggaggtttaattctcactttctgatggagatatacatatacatatacatatacatatacatatacatatacatatacatatacatatacatatacatatacatatacatatacatatacatatacacacagacatatatatgtgtgtgtgtgtgtatgtatgtgtgtgtgtatatatatatatatgtgtatatatatatatatgccattgatatttcttttgagaattgtctgttcatctactgatcggcacttttgtcttgctgtgtgtgtgtgtgtgtgtttcactttagctctttatatatctaaatgttagcctcttgtattactggcagaggtcttctctcacactgtaggctcccttccctcggctgtggtctctctggctatgcatttactttttcagttcacgtcctcacatttcctaaccgttggggttgtttctattcactgaggatgattttgctaaaagggcaaggacagcagaacagccaattcatgcctgttttccttttggctttttaggaattaattcgagaacaagtggaggtaagcttttctcttatttgggagtgtcacagggacatgtcacacacaaggcttcattcatttcccttttactaattctgtagctgctccagaccacaggaggtatccaagggacactgccactgactgtccagaaggtgttggcctcccaggcctgccatggtaagagcttgcgcgtagctcgtctggggagccgagcattggcagggtacagtgattgtataggagacaagcactcctttctcttcacctgctacagggtgtagtgtaggtcaagaggctgacgctaccataattttcaaaaattactttttgaaagtagaacactactagaactggggtagaaagtgactaagaaagtagagggtgggccttaagggaggtgtcctgattgaggccagagtgagcctggggcttaccacagcgtgaggagcagccttggcagggccacaaaggccagactaaattcctctcatgaggagcagccaagagtaccaagaaattaggctggaaataaagaccagacgcttagaaggttccagagagacctttagagctgatacagggcacaggtctagtgaagggtcatgagcaggggatgtgattcgtcgaggacatggcattgctggactcaaattagggacgtggcctctgcggagctggcctgcaactgttctgggacccactgtcacccccactttattcctctcctttcaagcttctcacccctgcccctccaagcttagtctgcaccctgcaaatatcccagtgtcctttgctcctttattctgtttccagccctgcaccatcactgtcttcggagtctgagtctgtctacattgcccttctccttacctccctgtgagccctctacctaggcctcacccagtccagctccggctccagcaactattcccttagcacctccgaaatttttggtaattgttttggtttgcttcaggcagagtcttgctttgtaccccaggctgtcctagaactgcttacatagaataataagccgacctctaacttgtagtaatcctcctgcttcagcctcctacagctgggactacaggtgttagccaatactcccagccagggagatctttctaaaacatgtttctaagcatgtcattcttccatctgatgtacacattgccatttacgaatgctcttggtataaaagtattttatgtatttattttttacatttttgtctgtttctttgagataaagtttctggtctcttaaagtttcagcccaggctggtctcttaacttagtatgtaacagaggataatcttaaactctgatccttcgccctctctccctccagagtgctgggtcacaggcctctcctaccatccctagcaaagccagagcctgcggctcaccagagctgggcatagccctgcctgctgtttgggtttcagcagtcagtcacactgcatggtgcactacagttccaacctcgtctttgtcttgtccctcctgtatctcgacactcacactggcctttcctcagcccaacatgcctttgtgttccttctccaaggaaaaaaatcatgaaatctcctcttttccttctcttccttctcctttttcttcttcttcttcttcttcttcttcttcttcttcttcttcttcttcttcttcttcttcttcttcttcttcttcttcttcttctttttttggggggggggtttcaagacagggtttctctgtgtgtctctggctgtcctagaactcattttgtagaccagactgtcctcagactcagagatctgcctgcttcagtcttcttaacccagtgtctcagctgaaatagtttagcaagagagcactccctggcctgagctgggctggtttggtgtcacatgttctcggcctagggttcataacactggtggctgaacttgttctgtcatgatttgtcctgtgtgatcttacctgttggagctccgtgaaggtagagagggccattcgctgtctgcaaaggctcctaatgtacagcaaacatttagttaatacttattgacttagaataaagtcctgttctaacatgtgatgatttaaaccaggaagactgttactgaaatcaagaaaaagggaaaacaaaacagacactataagaaaacagtttgttactagcaagcgttggctgaaaggaccgtgatatagctgtctcttgtgagactaggccggggcctagcaaacacagaagtggatgctcacagtcagctattggatagagcacagggccccaatggaggagctagagaaagtatccaaggagctaaagagatctgcaaccctgtaggtgcaacaacattatgaactaaccagtaccccccggagctcttgtctctagctgcatatgtatcaaaagatggcctagtcggccatcactggaaagagaggcccattggacatgcaaactttatatgccccagtacaggggaacaccagggccaaaaaatgggaatgggtgggtagggaagtaggggggagggtatgggggacttttgggatagcattctaaatgtaattgaggaaaatacgtaataataaaaaataataaaaaaaaagaaagaaaacagtttgttgggctggagagatggctcagcggttaagaatactgactgttcttccgaaggtcctgagttcaaattccggcaaccacatggtggctcacaaccatctgtaataggatcctatgccctcttctggtgtgtctgaagatagcaacagtgtactcatacataaaataaataaatcagtctcaaagaaagagaaagaaagaaagagagagagagagagagagagagagagagaaagaaagaaagaaagaaagaaagaaagaaagaaagaaagaaagaaagagaaagaaagaaagggaaaggaaaagaaaagaaaagaaaagaaaagaaaagaaaagaaaagaaagaaaacagtttgcttttgaaccttcatggacagaaggaaactacttaaaacttcacacactcctaagtaggcaaatactgccctatgtctttgagaaaagcccccaaaacaagatcctagtgggttaaagagtgcccctcccctctagaacacagggacaaaccatgttaggaagctgagagagaagggcagtcctgaagactgaggctgtcccataaccccaggtgccagtcacagcagtataaaggccagactcaaggagtctaagaaatccatgactgtggccgggttgacaccgatcttcactgtgcactgtaactttttggtgtctctttcattaggggctattaagtttaatgatcgtctgagcctagaagagagctgccgcctcatcgaagctctgtccttgtcccagctgccatttcagtgtgctcatgggagaccctcaatgctgcccttagctgacctggaccacttggagcaggaaaaacaggtacagttctaccttgttctagtttacttcctgttgctgtgataaaaccaaccaaaacacacttggaggccgagggtgtgtgtggaggggggaggggggccaatttggctcatgcatcacaattatactgcaggaacggaagcagagacccatgagaggtgctggctacaggttcactcagcctggctcttacagtacccaggaccatctgcccaggagtggcaccacccacaatgggctggaccctcccacaccaattactaatcaagaaaatgccctatagacttgcctacagccaagctgacgtaggcattttcttaaatgaagttcccctcttttccacagtggctatagcttatataaagtcgacaaaaaacaacaacaacaacaacaaccagcatagacctatagaatcaggaagaagtgaagtttatcttttcttttcttcagcttctgctatctattgtagtccatctttatcctctccaaacaggagagttttgaaaagcatgcactggaagttttatttaaggccatccacttggtctttcagttcacatttgaaatggagcttagactaaagggtcagcttatctccatgatggcctcctggtttcagcttcccatgtgtacatgtatcctgaatatcatgtatcctgcacatcagttgcctgccagctccaagtttcatgagtcctgaaggtagaaatgtctcgagcccacagctgtgagaacatagccggcatctggtcccttgcgagtgtgtgccctcagctggagctggctatctcagaggatctccctgctttctcgtcagccacggaaggaagcagcctttggagatctcctgggccgtggctctgatctgtgcccaagcagcgcgtgaacagtgatgtggctgacgcagggtctgcacggagtccttacactgagaacactttctgttcttgttataatctgctcttcttttcttttatgtgtaagggtgttctttcttcatgtatgtttgagcaccatgtgtgtacacagtgcctgtggagactagaagagggtgttagatccactctggagttacagatgcttgcgaaccgccatatgggtgttggtaattacacccaggtgctctggaagagcagtttgtattcttaacctctgagccatctctgcagcctctgttcacatctgaaatgaaacagaaatggccgtgcatagggtactgtgttgctactttccagaatcctttcttttgcttctctttcttgctaatggctgtaaagtctttccttgcatggagatttcatatactgtttgttccctgacttatccagttaatcttactccactaaaattcttttaagggattggaaaaaatggctcagtggttaagagcaccggctgctcttccagagaatccaggtttaatttgcagctccacatgacactcacagctgtcagcaactccactttcaagagacctgctgccttcttctgaattctgcaggcataaggcatgtacatacatacatacatgcatacatgcatacgtacatacatgcatgcaggctaagcagtcccactacccctccacaaaaacccacctctttgaaaaatccctgtccccatcactgaggaggtaaggatttagactttcagtttaattctgagggatgctgtcatctttttctgagtccaggaaggagaaatttaaacacatttggagagccattctttgaaatacttaaaaaaaataattggtatctata

SEQ ID NO: 1604 - DNA, 3814 bp, Mus musculus
atgatcaggtgtctatcagatgacgtaaaaaccaagttgcgttccggtttagccataagctccttgggccagtgtgttgaagaacttacccttaacagtattgatgctgaagcaacatgtgtggccatcagagtgaatatggaaaccttccaagttcaagtgatagacaatggacttgggatggcgggggacgatgtagagaaggtgggaaaccggtattttactagtaaatgccactcagtgcgggacttggagaacccagcattttatggcttccgaggagaggccttggcaagtatagccgacatggctggtgctgtggagatttcatccaagaaaaacacaacactgaaaacctttgtgaaaatgtttcagaatggaaaagcccttgccacccatgaggctgatttgaccagaccaagtgtggggactacagtaacggtctataacctgttttaccagtttcctgtgcggaggaaaagcatggatcctagactagagtttgagaaagttcggcagagggtagaagctctctcacttatgcacccctccatttctttctctttgaggaacgatgtatctggatccatggttcttcagctccctaaaaccaaagacatatgctctcgattctgtcaaatttacggattgggcaagtcccaaaagttaagagaaatacgttttaaatacaaggaatttgagttcagtggctacatcagctctgaagcacactacaataagaatatgcagtttttgtttgtgaacagaagactagttttaagaacaaagttgcataaacttattgactttttattaagaaaagaaagcattatatgcaggccaaagaatggctctgccagtaggcaaatgaattcaagtcctcgacaccgttctgcctcagaactccacgggatatatgtaatcaatgtgcagtgccctttctgtgagtatgatgtctgcatagagccagccaaaactctgattgagtttcagagctgggataccgtgttgatttgtattcaggaaggagtaaaaaggtttttaaagcaagaaaaattatttgtagaattatcaggtgaagatattaaggaatttaatgaagataatggttttagtttgtttggcacgactcttcagacacatgtgtctactcatgagaagtgtgaccagagcagtttccgggaagcgtgtaataaaattctggattcctatgaaatgtttaatttgcagtcaaaagctgtgaaaagaatagctactctagaaaataaaaccagacaaaaccctggtgattcagaaactatcagaaaaaagacagtgggctcattgtacacagatgcatcggatggcccgtgctatagtaaatcggtagagtctgttttacaggacagcaacaacagtgcttacttagaaccgagggtgtcagaagaagaggtagccaaaacatcacactccggagaaaatgagaaatggaaaaaatcttttttggaaaataagacttcaggaaggatacatgaaaccagtccaaaaatgttttcaagccccatccaaatgcatcacctccttgaggagagagaggcagatctggaaatgcagacaataagtagtactgttaatgtcatggctgccaacattccccaaaataatgacattccgagtcaactggagaaatggaaagatgctcctgaagtggggtgccaacctctgccttttgagacaaccttattaagggtacggggtactcagaggaagaaggaaagaaggaaaaaggagcccagtagtcgtggaagagtaaatgtttttagttatggacaagttaaattatgctccactggctttataactcatgtagtacaaagtgagcacgctaaatcaactgaaacagaacattcatttaaaaattatgctcgacctggtcctgtaagtgcccaagaaacatttggaaaaagaacacaccatgcaattgagactccagacagcagtgatttaacaagcactttaagtaaagaatccagtcaaccgcccaacaaaaggttttgcagaacaaatacaggttacgggacagagaacaaacctgtagcaacagatgacaacttggctctttttcaggaaagctgtaaagaatcacacacagatcgccttttgcctgatgcatcctccttcccatggtgtagatatgtttccgatggttgtaggaaaatagataaaaggggttccttcaaacaggtagtccgtaggaagctaagcttgcgttcacaagtagggtctttagagaagtttaagaggcagtatgggaaggtcagcagttccctagatacagaaaaggataataacactgaagtcaggactcatcttgatcctcaaaatgaacccgatgttcttctgaaagacaagagccacttagatatgtctgatggttgtgagatcactactgtggagcacagtgagacttgtcaaccattaagtcccatcctgtacccagaaaaaattttattttccaaagaagatcgcttagaacagatgcctcatttgagagaaagtcctataactctggaagaattatctcactgtaacagaaaagctgatgttgagaagtccgctgcatcactggcttctaaattatccaaactaaaggattctgaaaaagagatgcaaaccgtggggatgacaggtcatactagtgaacttccagattcaaatcccagttggaaagataatagccagtgcactaggttagacttggatttttgtgaattattaaaaaacaaacttgaaaaaatagagagtgatatgcttccaatggcagattctgccacagaggatggtcccatcaataaaaacagtgaactacatcctaacaatacaacggatgacacagagaaaccagaaactcctttgctgttcccctgtaatgattctaaaatcagcagagattcagatgttcttatcagaacttcagaacaacctacaggaaaccctgactctgtcggtaaagtgataatgagtcaggtagaggatggcattggcagccaaggtggagtctgtccccagggtgatgaatctaaggcaagatcttgttccaaaaatgaaccaaacgcacactgtatggattggcagcagcattttgatgtaaccctgggaagaatggtttacatcaacagaatgacaggacttagcacattcgttgctccaactgacgaccttcatactgcttgtactaaagatctgacaactgtggctgtggatgtcctgcttgggaatgatgctgtggatgctgctgctgctgctgtcagtgaaccccttcagtctctgttttcagaatggagcaatccagtgtttgctcgatacccagaggttgctgttgatgtcagcagtggccaggctgagagcttagccgttaaaattcacaacgtcctgtatccctatcgcttcaccaaagagatgattcactcagtgaaggttctccagcaagtggataacaagtttattgcctgcttaatgagcacgaggatggatgaggatggccgaacaggtggaaacctgttagtcctggtggaccagcatgctgcccatgaacgcattcgtttggagcagcttattactgattcctatgagaaacaagatccacaaagcgctggccggaagaaattattgtcttccacaataatccctccactggcaatcaccgtgtcagaggaacaaaggagactcttacggtcttaccacaaacatttagaagatctggggcttgagttgctctttccagatgctagtgattctctgatcctggtggggaaaagtgccgctctgctttgta

SEQ ID NO: 1605 - protein, 1272 aa, Mus musculus
  VARIANT (1)...(1272): Xaa = Any Amino Acid
MIRCLSDDVKTKLRSGLAISSLGQCVEELTLNSIDAEATCVAIRVNMETFQVQVIDNGLGMAGDDVEKVGNRYFTSKCHSVRDLENPAFYGFRGEALASIADMAGAVEISSKKNTTLKTFVKMFQNGKALATHEADLTRPSVGTTVTVYNLFYQFPVRRKSMDPRLEFEKVRQRVEALSLMHPSISFSLRNDVSGSMVLQLPKTKDICSRFCQIYGLGKSQKLREIRFKYKEFEFSGYISSEAHYNKNMQFLFVNRRLVLRTKLHKLIDFLLRKESIICRPKNGSASRQMNSSPRHRSASELHGIYVINVQCPFCEYDVCIEPAKTLIEFQSWDTVLICIQEGVKRFLKQEKLFVELSGEDIKEFNEDNGFSLFGTTLQTHVSTHEKCDQSSFREACNKILDSYEMFNLQSKAVKRIATLENKTRQNPGDSETIRKKTVGSLYTDASDGPCYSKSVESVLQDSNNSAYLEPRVSEEEVAKTSHSGENEKWKKSFLENKTSGRIHETSPKMFSSPIQMHHLLEEREADLEMQTISSTVNVMAANIPQNNDIPSQLEKWKDAPEVGCQPLPFETTLLRVRGTQRKKERRKKEPSSRGRVNVFSYGQVKLCSTGFITHVVQSEHAKSTETEHSFKNYARPGPVSAQETFGKRTHHAIETPDSSDLTSTLSKESSQPPNKRFCRTNTGYGTENKPVATDDNLALFQESCKESHTDRLLPDASSFPWCRYVSDGCRKIDKRGSFKQVVRRKLSLRSQVGSLEKFKRQYGKVSSSLDTEKDNNTEVRTHLDPQNEPDVLLKDKSHLDMSDGCEITTVEHSETCQPLSPILYPEKILFSKEDRLEQMPHLRESPITLEELSHCNRKADVEKSAASLASKLSKLKDSEKEMQTVGMTGHTSELPDSNPSWKDNSQCTRLDLDFCELLKNKLEKIESDMLPMADSATEDGPINKNSELHPNNTTDDTEKPETPLLFPCNDSKISRDSDVLIRTSEQPTGNPDSVGKVIMSQVEDGIGSQGGVCPQGDESKARSCSKNEPNAHCMDWQQHFDVTLGRMVYINRMTGLSTFVAPTDDLHTACTKDLTTVAVDVLLGNDAVDAAAAAVSEPLQSLFSEWSNPVFARYPEVAVDVSSGQAESLAVKIHNVLYPYRFTKEMIHSVKVLQQVDNKFIACLMSTRMDEDGRTGGNLLVLVDQHAAHERIRLEQLITDSYEKQDPQSAGRKKLLSSTIIPPLAITVSEEQRRLLRSYHKHLEDLGLELLFPDASDSLILVGKSAALLCX

SEQ ID NO: 1606 - DNA, 55114 bp, Homo sapiens
ataatcatttaaatatatatgttcatttgaacagttgttttgctgcaatgtttgctgttgatattatctagcctcttatttaaattccttcatttctagagaagtgacaaataataattcagggacttttgaaaacttggaatataatttacatcccataaaacccatcctcctaaagtgtataatttggtgatttttagtatattcacaaaatgttgcactaattccagaacattttcatcatcccaaaaagaaacccctacctaggttagcactcactcctcatcccctgagcccctggcaaccactaacctactttctgtctctatggatttgcctattctagatttttgttgttgttgttgttgttgttgagacagagtctcaactctgcctcattctgtcacccaggctggagtgcagtggcgtgatctcggctcactgcaacgtctgcctcctgggttcaagtgattcttctccctcagcatcccaggtagccgggattacaggcatgcaccaccatgcccagttaacttttgtatttttagtagagatggggtttcaccatgttggccaggctgggtcttgaactcctcacctcaggtgatccacctacctcagcctcccaaagtgctgggattacatgcatgagccaccgtgttcagcctattcttgatatttaatataaatggaatcatacaaatgtggcctttttttgtgactggctcctttcacttaacatattgttttcaaggtttatctacactgtagcatgtattagtatcctattcctttttatggctgaataatattccattgtatggatataccacatttcatttatccattcatcaattgatggaaatttgggtttctgatttttggccattatgaatagtagtgctgtgaacacatatgcacatatttttatgtagacaatgttttcagttccattgagtatatacatacctaggagtagattgctgggtcatatggtaactttatgtttagctttttgaggaactgccaaacttttccaaagtagctataccatattatgttctcactggcaatgtgtgagaattccagtttgtccacatccttgccaacaatggttactgtcttttatgttagccatcctagtgggtatgaggtaatatttcattgtggttgtttgtttgtttttcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttcagtgtggttttgatttgccttcctaatgactaatgatgttgagcatcttttcatgtgcttattggcatattttatgtctgctttgaagaaatgtccattcaaatatttttgcccatttttagttatttgcctccttattcttgagttgtaagaatatttttattctggatactagtcccttatcagatgtatgatatacaaatatttctcccattctgtgggttgtctttttaatttcttgatagtgtctgtgaagtacaaaagtttttacttttgatgaagtcaaatcaaatttatctgttctttttttgcttgcacttttagtgttatatctaagaaatcttcctaatccaaggtcatgaaggttcatgcctatgttttttgtttgttttgtttttgttttttgtagcaactgggtttccccatgttgcctggctgatcctgacctcaagcaatctgcccacctcagcctcccaaagtgctgggattacaggtgtgagccaccacacccagctgctgtcatgcctatgttttcttttcctttttttttttttttttttttttaagacagagtctcgctctgtgcagtggcgtgatctcgatctcggctcactgcaaccttccgcctccagggttcaagcgattctcctgagtagctgagattacaggtgtgctatatcacgcccaactaatttttgcatttttagtagcgacggggtttcaccatgttggtcagactggtctcgaactcctgacctcgtgatccacccgcctcagcctcccaaagtgctgggattacaggcgtgagccaccgcgcccagccgcctatgttttcttcaaaatttcatagtttacactcttagattgaggtctttgatccagtttgagttaatttttatgtgatgtgaggtaggaaatccagctttattcttttgcatatgaatatccagttgtcccagcaccatttgttgaagtgagtattatttcccacatttgtcatagcacccttttcaaaaatcaacataaatgtaaggatttatttctggactctcaatactattccattcatctatatgtctgcctgctgtagttgagatgtttgtccccttcaaatctcatgttgaaatttgatccccagtgttgaaagtgggacataatgggagatgtttgagtaatggggccaggtccctcatgagtagattaatgctcttcctggggggtgggagggtcaatgaagtcttactctattagttccctggagaactggttgttatttttatttattttttttgaaacggagtcttgttcttgtcgcccaggctagagtgcagtgacacaatctcggctcactgcaacctctgcctccagggttcaagcaattctcctgcctcgccctcccaagtggctgggattacaggcacccgccaccacacccagctaatttttgtatttttagtagacacagggtttcaccgtgttggccaggctggtctcaaactcctgacctcaggtgatccgcccgcctcagcctcccaaagtgctgggattacaggtgtgagccaccgtgcccggtgagaactggttgttaaaaagagcctggtaccccacctcttcccacccctgcctcacagtggaaacagcctaaggccctcacctgatgccagtgacagtctcatgcttatacaatctacagaatcatgagccaaataaacctcttttctttataaattacccagcctcagcaggtagttttttttttttttttttttttttttttgagacagagtcttgctctgttgcctaggctaaagtgcagtagtgcgatctcggctcactgcaacctccacttcctgggttcaagcaattctcctgcctcagcctcctgagtagctgggattacaggcacccaccactgcgcccggctaatttttgtatttttaatagacggcgtttcaccgtcttggccaggctgatctcgaactcctgacctcatgatccccccacctcggcctcccaaagtgctgggattacaggtgtgagctaccacgcctggtcctcaggtagttctttatagcaacacgaaatggtctaagccactatccttatgccagtaccacactgtctcagttactgcagctttgtagtaagttttgaaattgggaagtgtgaatccttcaactttgtttttccttttcaagattatttctagctatcctgggtcccttatgtttccatgtaaattttagtatcaatttttcgatttctgcaaaagcactgggattttgatagagattgagttgaatctgtagatcaattgggtagtaatatcatcttaacaatgttaagtatttcaatacatcagtaagggatgtctttccatttatttagatactctttaatttctttcaagaatgttttgtagatttccatatatgtcgtgcaattcttttgttaaatttattcctagacactctatctttttgatgctattataaatggaattgtttcctaatttcattttcagtttttcattgctagtgtatagaaatacaattgatttttgtatatcaatcttatatcctacaaccttgtgagactgttaattagctctagtgtgtgcctgtgtatgtttcttaggactttttgtatacaagatatgtcatctacaaatagaggtagttctgctttttcctttccaatctgaatgccttttctttctcctgctgtggatagaccctcaagtataatattgagtagagtggtaacagcagacatccttgtcttgttcctgatcttcgtgggaacgtttttaatctttcaccattaagtatgatgttagcagtgggtttttcacagattccctttatcaggttgaggaagtttccttctgttcctagtttgttgagtgttttgatcataaaagaggtattggtttttgtcaaatgcttttttgccatctattgagatgatcatatagcttttgttttattaatatggtgtattaaattgattacttcttgtatattgaaccaaccttgaaagaaatcctagtttgtcatggtatacaattctttttctgtgttgcctgatttggtttgctagtattttgctgatgatttttgcatctctgttcataagagatattggtctatggttttttggttgttttttctcgtgacagctttgtttttgggaggctgaggaaggaggatcatttgagcctgggaggttaaggctgcaataagctgtgactgtgccaccatccttcagaaaaaaaaaagaaaaaggaaaagaggtattgacaattcacattcatgtttcaaagattccttccaggttagaatttgaattttaagtaccacagtcccaggaatgagacacttatttttcatttttattttttagctttagttttagtatgaggataatgctggcttaataaaatgtgttgggaagtgtttcctcttcttttttttaacccttaattcttggtttggatcttcttctattttttggaagagtttgtgaagggttggtaaaggatttttttttaaacatttggtagaatttacccatgaagccatctggtcctgggctttttatctgtgggaagtttttgattacaaattccatctcttggtataggtctattcagactttctatttcttcttgattcagttttggttgtttgtctttctaggtattaggtttgttttcatccaaaaaaatttaatctaattttttggcatataattgttcatagaattcccttttatcctttttatctttgtaaggttggtggtaatgtctccttttatttctgattttagtaatttgaggctttcatccgtttttctttatcagtctagctaaaggttgtcaattttgttgatcctgtcaaagaagcaacttttgttttattgattttctctattcttctgctttccattaatttctgctctaatctttatttccttctttctgctcattttgaattcagtttgctcttctttttctagtatcctaaggtggaaatcttgattattgatttgaagagagtttctttttagattgcaactagaggtggtgattacagtccttgaaatgttgtcagatgattgtttaagcaaaaatatggttatgaggtagaattcactttttggaattttcttaggggagaaaaaccctgttggtgcaatagatattcaaaactgaacatgagtcaataacattatgtcatcattaaaaaaataagaacagagttgagcacacaaatgaaaccagtaggaaacgcccattctcaacactggtcaaattttggagtgttctgttcaactctcaagagttcagataaggccaggtgcagtggctcatgcctgtaatcccagcactttgggaggccgaggcaggcggatcatgaggtcaggagatcgagaccatcctggctaacacagtgaaaccccatctctactaaaaatacaaaaaaattagccgggagtggttgcgggcgcctgtggtcccagctactggggaggctgaggcaggagaatggcataaacctgggaggcggagcttgcagtgagctgagatcacgccactgcactccagtctgggcgacagagcgagactccgtctcaaaaaaaaaaaaaaaaaaaaaaagagttcagataaatcacattgcaaatttttaaagatttatttgactgtgacaacctcctgtttaaaactgcacattcttacagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatgttagcattagtcaataagttattttaatgtcagatttttgaatgttattatatattacctgtatgatggaaggattaccactgtacacaaatctaatcaataaaaacgttagaaccttctgcttagagtacttttaaaaaatcttcagtgaacttccttttgggcgaaatgagaggtctttattcagtaaacatttgtaggaagaggattttgaggtaatttaaagaggtctgaaagaaaaaaagtctgagtcatttctttaaatggtttctatgaaatgttcttcaagaaattccatgcctaataagaacaaataccacaagttcaatttgttagctctgttcaccttatgtttggatgaattacttctgctgttgtttcttttctctgggtaaggaattcacataaagttatgttatgggctgaactgtgtcccaccaaattcatatgttaaagtctcagtccccagtacctcagaaagtgactgtatttggacatagggcctttaaagaggtgattaagattaaatgaggctgtgagggtgggccctaatccaatctgactggtgttcttataagagaacatattggctatagacacgtgtgcaaaaatcaaagaccctgtgaaaatggccatctacaagccaaggagagaggcctcaggagaaatcgttgctgccaacaccttgatctcagacttccagtctctagaactgagaggaaatagacttctgctgcttaagctactcagtctgaggtattttgttatggcagccctaggtatagtaataatcataaacagttatcaggattttgcttaatcagccctagaagactggttggttgggtttggttagtcactaaactagcatatatcaaatgcttaccaggtctgacaaattcgttataaattccactttaaattctcaatgaaaatgagatagaaagcaaaaactaaggactggttaacaattccaaaacactttattctcacagcattctcagagttctgctctcctttagttatttttataactaaaagctgtggtggcactggggagattcaagtcagtgaagagagtcttggtgttgtcatctgtaaattaagagttgagcaaaggccgggtgcggtggctcacgcctgtaatcccaacactttgggaggccgaggcgggcagatcacctgaggtccggagttcgagaccagcctgaccaacatggagaaacccccgtctctactaaaaatacaaaattagccgagtgtggtggcgcatgcctgtaatcctagctactcgggaggctgaggcaggagaatcacttgaaccctggaggcggaggttgcagtaagctgagatcgcaccactgaattccagcctgggcaacaagagctaaactccgtctcaaaaaaaaaaaaaaaaaaaaaagagttgagttagacagtttctcagccttttccagctccaaatgccataattctaagatggcaggctctggaattattcattcattcggtgcctaccataggccaggcactgttcttggtaactgggatacagcagtaaacaaaatatataaactccttaccttcacatagcttacattctagggagagaagacaataagtaaacacataaaatatatattgaattaaacggtagttaagagcaaaggtgaaaatgagaaaaaaaaggaaagggaaaacacgggaaaaaaaaataaaaacaaaagtaaaagttacgacatagtctttaacaccatgccaaaagggaataaggattgagactgtaggtaccggttcactgaaccctgggatgcggatccttggctggaacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggtgactctgggggaagcacgcgacgaaaagatgatgccggggtctcttctaacaccagaagggccctgatgatggctgcgcgcagctttcggagccggatgcgcgagggccccggaggcccggcggcctggcggccgggcgggcccagtttggggacaaggacggggctggccagggaggggctgggcctggcgggaaggcagcgctgccccggactcggcccgcgcggccctcccaggcccccgtgccctggatccaggcccgtgcgtcccgtcagtcccaggcgctgggaggcgtcatcaggaaatcattgggtttacattaatcggaatacttgttaaacgtttacccctcagttgctgccggctgcttagtgcattagcttagaaagcagcagaaattctgcagttaagagccctgatttgtcccgagtttggaaaaccggccccaccgcctgcaggggcccacccacgtggctctcactgatggagaagaaggggagacctttaatggcactggaatcttagggtttggttttttttgttttgttttttgtttttgtgttttcacttgcaggaaaacttaaaatcaagttcaggcagccccatgccatcattattattaccaaggtagtttatgcccatctgtaaagaccaaaagaatattaataatgaccttctggccgggcgcggtggttcacacctgtaatcccagcactttgggaggccaaggcgggaggatcacttgagttcaggagttcgagaccaggctggttaacatggtgaaaccccatctctacataagagacaaaaattagccaggcatggtggcgagcgcctgtaatcccagctactcgggaggctaaggctggaggattgcttgagcccgggaggtgcaggctgcagtgagccgagattgtgtcattgcactccagcctgggtgacagagtgagactgtttcaaaaaagaataataacgactttctaaaaacatcagagtaatacatgaacaggatttaacaatcaaatggcaaagaaaggtttatatgaaaaggaattttcctgctttatcttttcccattcccagcctctttccctgaggtgactatacttaaccataataataataacctcttaatgcccccaatctctctttgatacaatttgattcttaaaatttcttcctattgcttcaccttattacaatgtcttagcaattcattataagtatttttctaaaagtcatggttattgtgtaatgtataaatgttatgaaactagcttggacatttttgtcatgaataatttctagctaatgttccttagctgtatttaatttaggcatctgtttttggtgaagtggttagaatttcgaatactgtgtttactggtcaacttcaagtgtaattatgatttcactttaggacatgtgggatttagaaaggagcattgaaaattatgaaattatgaattttttttggatgttaatccattgcaccaagcatgagctgtgcctagagatcagcggtataactttgttttgctttgtttcacaatttggtttaataagagtgatttcatttacctcaagtgctatttcttcataatgctgtgtaatgctaaagctttgattatgtgcgtgtgtggtttttttctccaataggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcttagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggtaagtacgtagtattcatgtgcatgagatgcttttgaagatgggaatgctggacaaggagtaagatcctcattatccaaagagattatctcaacagatagaacattttgaagaccacttataaaacatatgttgtattttcatgctatatgaagatttgctacgtccaacactacttttttttttttttttttttgagacggagtcttgctctgtcacccaggctggagtgcagtggtgcgatctcagctcactgcaacctctgcccccctggttcaagcgattctcctgcctcagcctccagtgtagcttggattacaagagcatgccaccatgcccagctaaatttttttattttcagtagagacaggatttcactatgttggccaggctggtctcaaactcctagcctcaagtgatccacctgcctcggcctcccagagtgttgggattataggtgtgagcccgcacgcagcctctaggtccaacactatttaaatggagaagtacagtgaaaggatgtcagtgtgtgtatatgtgtctatgggtgtgtgtatgtgtaagaaagggggtgatgggtatatacctagagcaacaacaaaaggggtgagactgtccaattttaataaaaatgatactattaatagttgggaagatccacagtactttcctaccttgttttcccttcctgttaaatgcccagctttcctagaaatgtgtctttaaaggcacctgcagtgtcagcatggtattttactggaagtttctctgcgtggcttccaggttaagggccagaatgattctgtaatcatcctaggtttcccagtaaactctatggcttagtacagtactacatttatgagctttttctttctagaaagtaggacttgtccatgaattttcaaaatataggtcaagtatatactttcatgactatacttttcaaatgtactttattataatgcatatggtaaaatctccttgatgtgtttatggtacaagtagctgttattcaggaagacaataatatggcatttatttatttgagacagagtttcactcttgttgcccaggctggagtgtagtggcgtgatctcggctcactacaacctccgcctcccaggttcaagggatcctcctgcctcagcctcccaagtagctgggattacaggcacccgctaccacacccggctaattttttgtgtttttgtagagacagggttttaccgtgttggccaggcttgtctcgatctcctgacctcaggtgatccacctgcctcggcctcccaaagtggtgggattataggcgtgagccactgcacccaaccaatatagcttttagatcgtaccacagggctacattagagcctgcactaggactctgggttctcggtccacatttaaagtgatattgctttggcagtgtgttgagagccagatgttgggaggtgataaagctgatttccatctggctataatcttggctttgcactaggaggataaacattacatctgtatccgtatttaaaattttgaatgctgcagaagaatggaacatgtataaatgtagttataagtcaatttctaatttctcctgacgatgaatatctctagcagaaagctgtggtttctttaaggttaaatgaaacctttacttttcagtgtttttctgtttttccttgtgaaaaaaaaatcactgtagtaacttcagtagtatttcatagtattttgtagtattcattaggagaaaactcatttctttcactgttgttcctgagactatcaagttgctcttaaagccactttatgtgcttttcaatctatgtggttttatgtcctgacttacactgaaggcttttcagaggtaaatctacagcactgacacctcatcttcctgaaatgcaactgcttctgatatggtgccaaaaaataactggattacattatactgtgagatggctgttgctaaaagaaagggggaaatcttagctgccatattcaacgtaaatatttcttccttttgaatatagacgtttaaaacactttaacctacttaacattctggattagcatacttttttatgaacttttgagggtcatgttaactgatagtttcctaatgaaaaatatttttggtatagaaagaagttccatgaacagatggctcctcagtaccctgctacctttctggaaatggctgatatacatcatgacatcaggacattgtcaaactttacataaaagtgttacatgaaataaattgttaaaagacaattttttttttttgagacggagtttcgctcttgttgcccaggctaaagtgaaatggtgcgatctcggctcactgcaacctccgccttctgagttcaagcgattctcctgcctcagcctcctgagtagctggaattacaggcatgcgccaccatgcctggctaattttgtatttttagtagagacgggatttctccatgttggtcaggctggtctcaaactcccaacctcaggtgatctgcccgcctcggcctcccaaagtgctgggattacaggcgtgagccaccagcctaaaagatacattttaatgtacagaaggaggatctataaaggtgattttgaggagtagtgtcaagtccccaagccttggtaattttttctttaaaatatattttatgcagttctttctattgtagttataaaccttatttcacttcattatcttaattttatcattcttaacctctccaggtttagtccaacagatttatctctcatgttttcctcctgttctaaagctgtcaaattcagcattgtttctaaaactcaaatctgattatccttcatggagaagaacagcatttgggccagatcttactagactctggagtttgaattgagaacctttcatttgtctacctgttcactttttcatgcagcatttgttgatcatccacactgtgctaggtgctgtcacgttgcaggttaactgactttgcttttaggagttcacagtactattagggaagatagctatctaaatataattgtattataatgagacaaatgttaggatagagacatacattggagataagagacataagttggagatttgtgaaggttgcaccaagttatggctgacaagtactgctgtatgtctaacacagggcttctctgggtaattttttgttgtaaggtttgtcctatgcattgtagaatatttagcagcatccgtggcctttatctgctagatgctagtagaacgtagaaccctttactcaagttgtgacaatgaaaagtgtctcaagccgggcacagtggctcacgcctgtaatcccaacactttgggaggccgaggcgggtggatcacaaggtcaagagtttgagaccagcccggccaatatggtgaaaccccatgtctactaaaaatacaaaaaaattagccgggtgtggtgacgcatgcctgtaatcccagctactcgggaggctgaggcaggagaattgcttgaacccgggaggcggaagttgcagtaagccgagatcacgccactgtactccagcccgggcgacagagcgagacgccgtctcaaaaaaaaaaaaaagggtctcaagacattgccaatgtcccctcgtgcaaaattgccccccagtgagaatcacagtgacctattctaggtcttcattctgtctggtatgaatagataatggaactaagcattaatatagagtcctatatggacagcataatttcattaaaggatttctgattctcaatctagtgtttagtagtctgctttatgtcttgactcagtttgtgcagaaagaggttttatgtgattaaatttttaaagagtttacttgtattttaagttcacatttctaggtttttctttcttatatttagggtctcagtacaggtgtcaaccttttagaagcgaccttgttcttcctttccttccgagagctcgagcagagaggactgtgatgagacaggataacagaggtaagggtggcagagagtgctggggcacacagtacacatcgtaccacctaactcaaaaaacaaagcaggcttgcattaagcttgatcagtgccagctgtgctgtactggaatcaggaattccccacggccctgtttaacagcggaactaattaattcagcgcatgcatttaggtcagaaattacttttccagacttgaggtcaatatttgctgattatgcatagtctgtggtgtcttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagtttaaaaagtaacagatcaaaataatttagagatacagcaaacactgaacatttgtagaacatagaaacaatgtacgtgacctttggtcttgaggctatggctcaccaaacaggaaatgccattccctcctttccctgtggttctggatgccaactttacctgttcccttttgccctagatactgtggatgatactgttagtagcgaatcgcttcagtctttgttctcagaatgggacaatccagtatttgcccgttatccagaggtgggtctgtagcagtttttctttgccttttttttttcttcttcttcttcttattttttaaattttgagatggagttttgctcctgttgcccagactgaaatgcaatggcatgatctcggctcacgtaaccttcgcttcccaggttcaagcaattctcctgcctcagtctctcgagcagctgggattacaggcacctgccaccacgcccagcgaattttgtatttttagtagagatggggtttctccatattggtcaggctggtctctaactcccaacctcaggtgatctgcccgcctcagcctcccaaagtcctgggattacaggtgtgagccatcacgcccagcctttctttgcctgttattttaaactttgagtttcaagatgggtacagtggcatgcacttatagtctcagctactcaggaggctgaggtgggaggatcacttgaggccagaagttcaaggctatatagtgtgctgattgcacctgtgactagccactgcacactatagcctgggcaacacagtgagactccatctcttaaaaaataagtaaattagttaaaaataaaatttgaattttatttaagctgggtatgggcatgcaagactatattaatttgtaattatgattggaaactgggcatatttccaaattatgtatttggaaattactgtttaatgtagaggggagaaataaaatttatagcatttgggaactcaggcattttggattaaacatgtataatcaatgtgagaacagtgaatgtgtttaccactctcagaaaccctgacttgtagctttggcacagtattcagggtggtgataatgaaattgttatcattagataaagccacacatcttctactggaggaacagttcctcattggccccgcatggatgttctctcctcagtgtattttcacagaatgtactgtgcatgttataaacagggtgtataatagatgagcatttgtttaccagttctttcctcaagatatcatttgaggacttgatcatggaacatagacaaattgttgttgtgaaacaattttttttgttttgtcagtaattttgtttataagcaaaaatttttatgtaagactcattattcataaattcttttgaatttttttttttttttttttttttttttttttttttttgtgacagagtcttgctgtgtcgcccaggctgaagtgcagtggcgtgatctcagctcactgcaagctccgcctcccgggttcacaccattctcctgcctcagtctcccaagtagctgggactaaaggcgcctgccgccacgcccagctaattttttgtattttttagtagagatggggtttcaccatgttagccaggatggtctcgatctcctgacctcgtgatctgcccgcctcagcctcccaaagtgctgagattacaggtgtgagccaccacgcccggccgattcttttgaatttctataaattccctgaattaaacccacctctagtaggctaaataaaaatgaatgcttttaaagcactctgatatctttggtaaaacaattctgacacaaaaattaaaatttcaattatattttgctgagtctttctaggttgctgttgatgtaagcagtggccaggctgagagcttagcagttaaaattcacaacatcttgtatccctatcgtttcaccaaaggaatgattcattcaatgcaggtaaaagattaacttcaaaatctcataaatatatatatatatatatatggcctaactcttctaaaatttgatttatttaatgatatagaccaccttggtcaaggcacgtgtgtgtgtgtgtgtgtgtgtgtgttcttactagaacttttatcatcagaagaaaaagcaagggattaattataattacaaagaaagaaatatctttagtagtgtaagtaggtttggagggaatgaattatggattcaggctgacagtttcaaggattctcaaggttctcctgcagaagattatatattgactttatatttggcaataatttataaatcaaagtcctttagtgaccttgtccttaagtgtgcaacagtgcccttttagaaattaccttctattgtgtgagcctacacaggtttgggaaagcccatattgagaagtcatttcacaaaagggaccctttgtctgatctgcttttctattttgccttgtgtttaccaccatggctgtcttattccctttgttttcagtacggaaacaaattaggaggctaacaaatttgggtaaactcctaacctggcattgacctggtaccagagcaggcaagcagttgatccagaaatagaccctggggcagtggtataggctcgggggtattggagagcctcaagtacctagacagagaggaaccaccaaggtctaaagccaccagtggcttttaacttacttctttaatagactagcagccgggcgcgctggctcacgcctgtaatcccagcactttgggaggccgaggtgggtggatcatgaggtcaggagttcgagaccatcctggctaacacggtgaaaccccgtctctactaaaaatacaaaaaattagctgggcgtggtggcgggcacctgtactcccagctactcgggaggctgaggcaggagaatggcatggaggcaggagaatggcatgaacccaggaggcagagcttgcagtgagccgagatcacaccattgcactccagcctgggtgacaaagtgagactccgtctcaaaaaaaaaaaaattaaaaataaataaaaataaaaatagactagtttctccataatcgttttccttgctttcatataaattttaaaaatttatttcagcctgtatgttagcaatctctggtcacattacctattctcaagagtcactctgttgggaacatctcaggccttctctaaagtattgctagcacaccactctgagacgtgggagtctgtcttcccctgtcgcctccctccccttacatcttctgatcaactccacctgcccattctttcatccttcctagtgactttttctggttcatcagaaccttacccagtctcaaagaaaggagtgtgataaggcaaacaactctaaataaaatacagttctgtatctttctatgcaaataagcctttgttaatttttatttagtgttgtaccacttatttgaatgtctgacaggttctccagcaagtagataacaagtttattgcctgtttgatgagcactaagactgaagagaatggcgaggcaggtaagaatggagtttagcctgaatgactaaccagctggtcttcttgtaacctttttttaatgattatttttggtatataatatagtttcaatgatttggatggattagggaaagccaatctaaaactaagaatattatgaaggctgggtgcggtggctcacacctgtaatcccaacactttgggaggtgaggcaggtggatggcttgaggccaggagttcaggaccagcctgagcaacatggcaaaaccccgtctctactaaaaatacaaaaattagctgggcatggtggtgtgcacctgtagtcccagctactcaggaggctaaggcacaagaatcgcttgaacttgggaggcagaggatgtagtgagccgagattgcgctattacactccagcctgggcgacagacatttagttttatgttcatacacatacatatactcaggatgcacattaaactatcaagagtatttactttgggagtgaaaatgagggtgtgcaaaggagatatttcaacttttactctttttgtcttttttttttcctttttgtggagaacggggtctcgctatattgcccaggtaggtcttgaactcctgggcttaagctatccttccacctctgcctccctaacagctgggattacaggtgtaagccaccacgcccagcccatcttttattcttttaaatattttctattgtttgactttttaataatattttcatgttttccctttataataatagaaagtgtatataatgaactctgctaggtttgtcaatatttacacagaatctcttggtgacctgctctaatgaaacaataatagtttgtaaatatattaactcattcaacaagtattaattgagtgcccattgtatgccagggactgtaccaggccctagggatacaataatgagaaaagatatatatgcaagagaaaaaaataattacacaaacataaaattttagttctagcccctgtaatggagaaagagatacaagatgctctaagaacctgtattgggagatttgatttcatcagggagttcagggaagtgcttcttggtaaaatgaggtctgaatatgaatatgagttaactaagtaaagaaaggagggaacaaccatgcaatttgtgatttattctcctcagtgagtggaaacagggcaaggggaactggagatgaggctagagaagtaggtaggagtcagatcttaaatgccagctacaagctttgctttgtcccaatactgttggaaaccattgaaagcttttttttttcattttttatcatttgtattttgatgttgtttttggggtggtacatgtcacatcacatttgcattttaaaaagattgctctggttgcagtgtggagaatggagtaggagtaggggtggagtcccagttaactgtagattgactgttaaaagaatattgcaatatctgagacatggttagatgggaccagggtggactagagagcagtgaatgtattggaaagatatttaggagatagagtcagcagggcttggtgatggattggatatggggaaagtatgtaaaagatgacttctggtgttctggcctccatagctgagttgatgatgttgcaggacccgtgttgcaggcagagcagagaggatgaaaatcatgagttcagtctttgaaatgctccagaagagatgtcaaggtggccaggcacggtggctcacgcctgtaatcccagcactttgggaggccgaggtgggtggatcacctgaggtcaggagttgagaccagcctggccaacatgctgaaacgctgtctctactaaaaatacaaaaattagctggacatggtggcagatgcctgtaatcccagctactcgggaggctgaggcagagaattgctttaacccgggaggcggaggttgcagtgcgccaagatcgcaccactgcactccagcctgggtgacagagcgaaactctgtcaaaaaaaaaaaataaaaagatgtcaagaatgtggttggatattacaagtctggcctagacaagtgttctgacatggagatacaaatttgagccatcagatgcagaaaagtgatcactgaaaccctggatataaatgttatcacctagaaaaaagaagagtgaggagaggtcttgaatctagaataattctagcacttaagagctcggtagaagaggatgaaccagcaaaagagactgtgaaggaacagctagagaaataggaagaaaacagaagaatgttatgttggaaaaccaggatgtcatgccaaacgctgccaagacattaagtaagatgaggatcatctgattttgtgacagtagagattagggattttagcaagtgagagctgtttcagagaatagacaggacgagatgctgatggtgctaatggagactgcaaggagatactcagaaatgtgcccatgacacggaagagggactacagagggtgagggtgacagaggaccttttttttttaatgggagaaacttgagcacatttgcaagggatgcctgatgggataaagtccctgaaaaggcctgagtggctgagccctgagcagcagtggagggctggctccagcttgatagtacctgcaggcaagtgctaaagttttagagcatttattctctatgtatttcaaaatattccctttaccttgtttagtaaatgtcatagcagatcaaaggcaaattaacctaaagttctgtcagaattatcatgaatatagaatttgtgaagatcaaattcctatagttttactatttctagaaaagtaatagttttttgttgttgttgtttttgagacgaagtttcactcttgttgcccaggctggagtgcaatggtgcaatctcagctcactgcaacctccgcctcctgggttcaagcggttcaccagcctcagccttccaagtagctggaattacaggcacccgccacccacgcccagctaattttgtatttttagtagagacggggtttctccatgttggccaggctggtctcgaactcctgatctcaggtgatccgcccgccttggcctcccaaagtgctgggattacaggcatgagccaacccgcctggccaattttttttttaagttttcattatctggaattctttgttgtttttgagatcagaatctctactaatgatactcaagatgggtgtaactacaaaatctgcagatgttgaaagaagcaaaatggatctgttgaaatttctctttttttctttacttttttttttttttttttttttttgagatggagtcttgctctgtcgcccaggtgggattgcagtggtgcaatctcggctcactgcagtctccccttcccgagttcaaggaattcttctgcctcagcctcccaagtagctgggactacaggcacctgccaccacgcccggctaattcttgtatttttagtagagacagggtttcaccatgttggtcagctgatcttgaattcctgacctcaagtgatctgccctcctcagcctcccaaagtgttgggattacaggcatgagccacaggcccagccagaatctgtgttttaataagatccccagggggtatgtgatatgaacgtttgagaagcccaagtctaaggcaggataaacatggcccgaggggaatctgggcatcacctctttctgtacagccagggagatgggaatggtttttacattttttaatggttgggaaaaaaaaagaagactatttcttgacacattaaaattatatgaaattagtatttcagtgtccataaataaagttttattggaacacagctacgatattcacatattgtctatggctgctttggctcaaaaagaattgttgagtaggcatgacagaaatcgtgtggcccaaaaagcctaaaatatttatgatctggcccttcagaaaacgttctccggcttgtgatctaaagtgcactggaagtacattctttgtgggtttccaagtagcttgtacaccaaggttagctgattataacaatgtgttgtttaacgatcctttatcatattaaagttgaattaataaggcaaaatcagtatttaaacataagaattatatattcaagcttcaaacttgaggaaatgccactttgactttttttttttttttaagatggagtctcactctgtcaccaggctggagtgcagtggtgcaatctcggctcactgcaacctacacctcctgggttcaagcgattctcctgcctcagcctcccaagtagctggaactacaggcgcgtgccaccacacccagctaatttttgtatttttagtagagacagggtttcaccatgttggccaggatgatctcgatttcttgacctcatgatccgcccgcctcagcctcccagtgtgctgggattacaggtgtgagacactgcacccagccctgactatgttttctaaatgagatgctggtgaactaaagagtttcttagtttaccttttgtttcctaaaaaatgaaattatggggaaaataataaaacttataggataaaaattagtaatactggtaatctctggagagagaaactagaaggggtgggggcaagagtataaaggagactttattaaattcccttttgtgcctttcagaattggatctgggattcaaacatatgggataagtttgctatcattttccccataatttcatgttttaggaaataaaagatacaattgttactcctcagaatgttttgtcttatgctgttgttagatagtttgaattaagtcttctctgtcctcaacacacatgatggttgtcgtcttgctctgagaatcaaagttcacaatccttgctcatctaggtgggaacctgctcgtgctggtggatcagcacgctgcccatgagcgtatacgtctggagcagcttatcattggtaaggatctgtttgcagccagaaaaaatttgagactcccagcagaatcagtacacctcaaagagcttttctaactgcaactgttgtgagaaagcacactttgtactgtatgttcaaaaattaaactaaagtcctgcagtttggcctgtgttataattgaaagaatgtggtagttcactaattgaaagatgtgaacttatttatgtggtcagaggcatatttgccagatgttattaacaacccagaagtacgcaaggataggctgcttactctgacatccagcacaaagctctgcccctccatatgcccggtgatcttggcatgccttcccacactccatcaggcagagaccagtggcagctcagaaggcccagtatgctgttttgattttaaaatttagtttgcttttgaatatgcagtataatcaaatagatccaattctgaaaggcacaaaagggaatataataaagtctcctttctatccttgtccccacccctcctagtttctctccccagagacaaccaatatctctggtttttaaatctatctttccaaagcaatatatgctttttaaatgtttttttttgctacccttttcctcatcatgaggcagtgtgttcaccaagtggtaaaataccaggaaagtctttactcctgtggccaatgagtaatgtcaaagagttaggcaaggacctaaggagtgcttcatggactagaatggcaatgatattactactgttttcacttttccttataaaatgacggcctaagagttgggaaagatatagtaaaaacagtgttagaaaaacttacctctacaggccctgcaccatttgagaatagtactaattctctccagagactgggagaccctgctcaaggaaagggaagccttctggagccataagactgtgtggtcaacccacatatgttcctggtaatccacattattcacctctgtcatcaaaacaacatttattaactacaggaacattggcttgttcatctgaatgtaagatgcaagtcttatatttcttattttgaaaaatactaccaaaattgttaataggctgaatatttattagtttgactttaaaaatggaaatccaaaatctaaaactgaacattaaacattctgctttgcattagaatgattatctcaaggccgtgctttatttttatctgaatctagaagacttcccttcctactcttaacccattcatctttctgccaatagattcctacgagaagcaacaggcacaaggctctggtcggaaaaaattactgtcttctactctaattcctccgctagagataacagtgacagaggaacaaaggagactcttatggtcagtaccaccatgagaatgtgatgttgatggtatcaattctcacaataattctgtgaggaataagcataactattgttccatttctcagatgagaccaagagaggttacaagacttgtctaaggtcatagcagttattaagtagtggagcaggcactcaaaggcaggtcgtctgactccacaggctgtttgtttccttttttaaaatatatttttttctgcatccaatcatccattaaaatatttattttgtgagacatggtctcactctgttgtccaggctggagtgcagtggcacaatctctgctcactgcaacctccaccttccaggctcaagcagtcctcccacttcagcctcccaagtacctggaactacaggtgagcaccaccatgctggactaatttttgtaattttttggtagagatgggttttcgccatgttacccaggctggtctgaactcctaggctcaagcgatcctcccactttggcctcccaaagtgctgggattacaggcgtgagccactggacccagcctattctttccactgtatcccagctgaagagtataggatagagtttccctgataattttttccagcagttggcttagaacactcttctcatttcttggaacagtctgtgtttatgccatgctttgtgaaagcaaagtttctgcagtaattggtcccattctgctttgctttggtgcattctagactcttagttttcattatcgtaatcataatgggaagaaagtaaaacattgggatgtaaggaaggggcgaatcatatagtgagtcacaagataggatatttttcctcttctaggcagcacaaattattgaaaatgaaaaagaaatttctcccaatatgtttcaggtttgggaatatgatactgccagtaaatctttttttccctatgacataatttatattagaggcagatctatttacttacatcccgttagtcaggacttctcaattccttgggctgttaattacctccctgctttaatgctgattcaaatcactctcagaccttttcttcatgccagactcccttaagtgccagcagccagaagttagcagttcctcaatgaagaaaacacacttagaaacaagacttagacacagattgattcccaatggaaaagagaaaaacaataaaggttactgtaattcaaaaaggaaatttgataataaaaaatcccaaacacccacacataagtgtgagaaaaacaatacggttgttaagccctgtggcagcttttgaaaaactattaagtagtatttggaaccagtagtgaagtgcaaatgaagtagcactctttttttttttaacatttgaggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggtaagacacagctgcagatgttaaggaaattgctgagtgatggtaacctcatattttgtctgtagattctctgaattcatcttttcttcaacaagtattcatggtatttacctgctgtgtgccaggagctagaaattcagagatgagttagctcaaaataaggaagaagggcatttaaagaattatagtcagtgaactttggctagtagaggtatgtgttttgctttcttcccagtgataaaggtaatgaaaactaagagtctagaatgcaccaagatagtttttcagaagtgttatggaaacacagaatgacttgtgtgcctggggaggtgaagtcaatgaaaatgtcacagaaaagctgttttcttaagaaaagtttttacttttgagagaccaggtctcactctgttgcccaagctggagtgcagtggtgcaatcatagctcactgtagccttgatctcctgggcacaagcaatcttcctgcctcagcctcccaagtaactcggactacagacacgcaccaccatgcctggctaattttttccttttttttttttgtagagatgggggcctcactatgttgcccaggctggtcctgaacttctggcctcaagcaatccccttgcattggcttcccaaacccccggcactacaggcatgagccactgcacacagccagaaaagtcttacagaatagtgggaaactaggctgggcaaggtggctcacacctgtaatgccagcactttgggaggccgtggtgggtggttcacctgaggtcgggagttcgagaccagcctgacaagcatggaaaaaccccatctctactaaaaatagaaaattagccgggcgtggtggtgcatgcctataatcccagctactcaggaggctgaggcaggagaatggcttgaacctgggaggcggaggttgcattgagccaagattgcaccattgtactccagcctgggcaacaagagtgaaactctgtctcaaaaaaaaaaagaaaaaaagaatagtgggaaagtgctgagtacagaagaggggagaagggcattctagacagaggaatacatatcagagacttgagatacatcctatgtttagggaactatcaatagatatggctcaaattaagatctacagttgatccttggataacttgggtctgaactgcacaggtacacttaaatgcagattttctttcacctctgccattcctgagacagcaagaccaacctttcctcttcttcctcctccttagcctattcaatgtgaaaatgatgagggtgaagacctttatgatgattcatttccacttaatgaataataaatatattttctgtttcttatgattttcttaacattttctttttctttctttctttctttctttttttttttttttttgcgatgcccaggctggagtgcaatggcacaatctcggctcactgcaacctccacctcccgggttaaagcgattctcctacctcagcctcccaagtagctgggattacaggcgcacaccaccatgccccggctaatttttgtatttttagtagagatggggtctcaccatgttggccaagctggtattgaactcctgacctcaaatgatccacctgccttggcctcccaaagtgctgggattacaggcatgagccactacgcctggccaacattttcttttctctagcttacttaattgtaagaatacagtgtgtaatatatacaacacacaaaatatgtgttaatcaactgtttatattattggtaatgcttctgatcaacgttaggctattggtagttaagatttggggaaatcaggccaggtgcagtggctcacgcctgtaatcccagcattttgggaggccaaggcgggcggatcatttgaggtctggagttcaagaccagcctggccaacatgatgagaccccgtctctactaaaaattaaaaaattagccaggcatgatggtatgtgcctgtaatcccagctacttgggaggctgaggcatgagaattgcttgaacccggaaggtggaggttgcagtgatccaagatcactgcactgcactccagcctgagtgacacagtaagactccgtctcaaaaaaaaaaaaaaaaaaattggggggaaatcagaagttatacttggatctttgactggatgggagttggctagatgggttgtcaaggtcaaatcataaaataatttagcatattctactaagtagtttgcattttatcctataggcagccagtgaaaacttttaagcaggagagtaaggtccattttagattgcattccaaatatgattactttacatatatgttttggtaaaggtttggaaagctactgctgggctgtggcattggaggtattagagagaactattactttttattttgattacttatatgtttctttttttatagcaaatatcatttattttgtctttattgtctttttcctctcctttcctgttttctattatagttttctgtatttctctttttttttttgctctactcgtttagaagttatatattccatttatatccttttagagattagccttaacttttagcatgcatacttatcaaagtttaaaagtaattcacttctctatcctcttcctaactgtaccaaaatcttacaaactgttcatctcccatcaccctcctcccatcttccatgttgctgtctagtactttaattccaccttgtttttaattccctggtggtcatttattttatagtcaatctttatttagattaaaaaaagtgttcaccagagtctttgttcaccattgcctcttgcatcctacttattctgtgttcttttgggttttttgtttttttttttttttttttttttttactgaagtaaatctcttacaagatcttttatccacaaacagatcttgagacaaaaaatacaaaaatataaaaataaatagaagttattttagtaagagtccgtgggccaggcatggtggctcatgcctgtaatcccagcactttgggaggccaaggcgggcagatcacctgaggtcaggagttttgagaccagcctggccaacgtggtgaaaccctgtctctaccaaaaatacaaaaattagctgggcatggtggcaggtacttgtaattccagctactcgggaggctgaggcaggagaatcacttgaacccgggaggcagaagttgcaatgagctgagatcacgccattgcaccccagcctgggtgacaagagtgaaactctgtctcaaaaaaaaaaaagtccgtgaatgataagctgtcttttaaagtatctttattttgtcttcatacttgcatgattatctagctaaaaacagaatttcacattgccagttatcccccccgcattttgaaaatatttcactacttttgactttctattttattttattttatttcattttttgagacagagtctcactctgttacccaggctggagtgcaatgggatgatctcagctcactgcaacctccgcctcccaggttcaagcgattctcctgcctaagcctacaaagtagctgggattacaggtgcccaccaccacacccagctaatttttgtatctttagcagagatggggtttcaccatgttggccaggctggtctcaaactcctgacctcaggtgatctgcctgccgtggcctcccaaagtgctgggattacaggtgtgagccactgcacccagcctgactttctgttttagccattgaagtccttagtcaatccaattattactctgtaggtaatctgattttccctctggttgcttttacgatggttcactttgtctttggtgttctgcaatttccctatgatgtatctttgtatggatttattttcatttccttctggagattcactatgcttcttcagtttggaaagtatgcagtcattatcacctcaaacgtttctttcccattctctctcttgtctcttggaaattttgtcagatatctactgggccttatctttctactctgcatgcctcttcaactctcttccatatttcccattgctttctctctgtgatacattctgtgaaatctcctcacttatcttccagtgaactaaagtatctcttcatcttctgtttaattatgtgtttagcttatccactgagttttttatttcagtgactaaattttttatttcaatggctatattttttatttccagaagttgtgtttttttccccaaatctcactcttccttttttatggtgtcctgcttttttcatgattgttccttctcctttatcactagctttcttgatttggagcacaggcaaatccacacccacctcatctagaagtctgaagtgctttagtaatatctaaaatagtaaaatctaaaattagaggatagatgtagtagataaattgggggatggatttatgtgggaagatttgagtcagggagagcagctgacgggttattgcagtggttaaggtaagagaagatgaggattggactgggtcagtagcagagggagtagagaggagtgacatatttgagacagaatttgggaggcagaagcaagaggacttggtgagcaatcaaacgtgaaaggaataaaggagaaaacaaaagcaacagtgattctgagggttgtagcatggatggctggaaggatggtggtgccattgacagagaagggacacagatgaggaggaacaaacctgcctaggagttccatcgtgaaggtgggtttagacacagtgaatgtgcctgcaggtggaatgcccagtggataggcacacttaaaagatctggtacttggaaaataaatctgggctgtacatatctatctgagagttaacagtatatatatattgatagtatcagaagctggagaagggccttgaggaagtgaggttgtccagggagaatatggagagtgaaaaggaagagagaaaagagtggagcctgtggaacatcagcatccagggtgcatatgctttggaaaaggtctggaaagctctgctgaaaagaggaaattctaaggatggctgaaaatacttggttagagagggaggaggaaaaccaggaaaaagcaatattgccaaaactaaggaaagttttaagcaaggagggaatggtcaataacggctatgaagtagagcctgaaacgctggacttgactgtcatgaggacattagttgtcttgtggaatcatttcctggggatgaggtggggcagaagataagagtgcagtgagtcaggagtgcgtgaagcaggaggaagtgaagctaagtagacaactctttcaggaactttggctacacacagaagaagagagatggggtgagagctaaaggttagaagtggttgggaagtgtggggtgggattcaaggctgaggaaaggtgtttgtttgctttaagacaaaaaagacgtaagcaggtttgcaggccaagggggaaacattcaagaggaagagcagctgtcagtcagctcttgggtcatcttggctttgccctttccagaatcgcctttggatcagacagatccaaagatttgctctgcttccagcaaagctctttcctccccacagacatgctttctctaagacccctgctccaaattgtcctaaatccaaaagataggatctgttagagtcttttattgtaattcaatccctaatatgtaaccagaaaattataagaaaaacttttcctgaaggaacttaaaagactactgttaaggagtttgcttcaaatggaaacaaacctctggtttcataaaatcttgattatcctatgtcaggctgatcaggagagactttgtgtgattctggaagaagctggaacagttttggtgttttgaggaggtagctatttgaatcctagcagttgaaagatcattaatacatccttctataaagctctatcttctagcctggtgaggaggtggaggctgcagtgagctgagatcgcgccatggcactccagcctgggcaacaacgagactccgtctcaaaaaattaaaaataataaataaatacggccaggtgcagtggctcacaactgtaatcccagcactttgggaggccgaggcaggcggatcatctgaggtcgggagttcgagaccagcctgaccaacatggagaaaccctgtctctactaaagatacaaaattagccaggcgtggtggtgcatgattgtaatcccagctactcaggaggctgaggcaggagaatcgcttgaacccagaaggcagaggttgcggtgagccaagatcgtgccattgcactccagcctgggcaacaagagtgaaactccatctcaaaataagtaactaactaactaaataaataaataaaaaataaaataaaaatattaaattatccagcattaaacagaccattggaatataaaatggactgagatgagacccatcaccccttcactaagcttacaaacagatgttttaccatcccagatgtacaaacacaagaatgtttgctctccatccacactaagctttgtcagtggattgagtcttatgagaccatctttctgtttaggtttgtttgggaaaacatgtgatttttaaattatatgtaatatagtatctactacctagctcttgataactgtgctcatttataggcatggcagactagagtatagatgaaggagggaagagaatttcctgagtctggttttaaaagaaaaggtaccatgttgtaatcttaggagcagatttacacatagccttttccaggagtaaagaaatgattttcttataaagaaatcattaaatgtgcaacaggtttttttctttttacctccagaggttaaacaaattggtagcatgaaatagtgtctgctttaaatttctttaagcttcttttgtaaatattaatatccacagggatataactattgaaaaggttaccccagggacagagacatgcaagggaggagaaatttctcaacaaagggcctcagaaaataaactttctgacctgaagggaattgtccccaaaaagcccgtgggaactaaagtgactgtttacttatgtttatgatatttaagcaagtgttatactgagcagtggttgtgttgatggttgttgtgtatttattctcagtttgtgtgtaatattacgcttgttctggctaagattacacacacaaacagacagccttttagtgagaagccttcctgatgttttgaattggttgaatcatcaaggctactctcaccagctacataacctcattagttgagaagctatctctggaggaagtctcagtagctaaatatattctgtgttcaataagagttctattcagttgcttggttttttcatattcaaagtgccttacaacaaataaatttgtacccaagtgctgtattgctggaactctttctttcaggaggcatgatttaaagaagaaaattgagatattttgtaaactatcaaagggcaagtaaaacataaccgtagattaaagccgattttccttttgctttgcaggaatttatccgagaacaactggaggtaagcttttcctttattttggggtttcacacagaagcaccacacataaaaggcttcgttgttccattttcttttcctgttaataacgtgtttatgcattagctactccagaccaccggaggcatccaagggacattgccactgactgtccagaaggtgttggcatcccaagcctgccatggtaagcccttcaacatagcagtgatcaaacacctctgcatgcagagccctggcagggctgccgggattacgaaagaggcagagggtacatttactacttgactcttggagaatacaatttagatcaagaaactgaatatacccttttaaaaatcacttttacaaaaacaaaatcccaacacaaaaatttgactatagtgctgcctgacctatatgagtggaggaataactcctagaggagatgcattttgagatgaattttgaatgagctggggaacatgggttcatagcatggaaaggggaattcactatagggagagtaaacagcctgtgcagagaggcagaacagaaacaagttagttatatgagaagcagcaaagagtatcaagaaactaggcaggtaagagaacagaaacctagaaggtcacagcaaaacctttggatttgatacagaaggcattagaattagcaagcgttctttttttatctttccaactttcattttaggttcagggggtacatgtgcactttgtaacatgggtgagttgcatgtcgcaggggtttggtgtacagattattttgtcacccaggtaatgagcatagtacccaataggtagttctgatcctcacccacctcccaccctccaccctcaagtaggcccaggtgtctgttaccccttctttgtttctatgtgtattcaatgtttggctcccacttttaagtaagaacatgcagtatttggttttctaattcacttaggatgatggcctctagctctatgtttttgcaaaggatgtgatctcgttcttttttatggcgacatagtattccatgatgtatatgtaccacattttctttatccaatccaccattgatgagcattgaggttgattccatgtctttgctattgtaaatagtgctgcagtgagcataacacatgcatgtgtctttatggtagaatgatttctgtttctttgggcatattcccagtaataggattactgggttgaatggtagttttgctttaagttctttaagaaatctctaaactgttttccacagtggctgaactaatttatatttcccaccagcagtgtataagtgttctgttttctttgcagcctcaccagcatctgttattttttaactttttaataccagccattctgactggtgtgagatggtatgtcactgtgattttgatttgcatttctctaatgattagtgacattgaacattttttatatgcttgttggccatgtgtatgtcttcttttgagaagtgtgtgttcatgtcctttgcccattttttaatagggttttttggtttttgcttgttaatttatttaagttccttatagattctggatattagttccttatatagattctggatattagacctctgttggatgcagtttgcaaatattttctcccattctgtaagttgtccgtctattctgttgatagtttcttttgctgtggagaagctctttagtttaattaagtctcacttgtcaattttcgttttattgcagttgcttttagagtctttaccaggaaatctttgccaaggcctacgtccagaatggtatttctgaggttttcttctagggtttttgtaaaaagatggaatgcgcccaggcgcggttgcttacgcctgtaatcccagcactttgggagaccaaggcggatggatcacctgaggtcaggagttcgagaccagcctggccaacatggtgaaaccccatctctactaaaaacataaaaattagccaggcgtggtggcgggcacctgtaatcccagctactcaggaggctgaggcaggagaatcacttgaaaccaggaggtagaggttgcagtgagccaatatcacgccactgcactccagcctgggtgacagagtgagactccatctcaaaataataataataataataataataatgaagatggaatgcttcatgaatttgcatgtcatccttgtgcacggaccatgctaatcttctccgtatcactccaattttattatatgtgctgccaaagcgaacaccattgagggttcttgagcagggtaatatgatacaatatagaaaatggggagctgggtgaggccctgtgaggaaggtgcctgcttctccttcaccttccgccataattgtaagttttctgaggcctccccagccatgcagaactgtgagtcatttaaatggtctttcctttataaatgacccagtcttggtcatttcttcatggcagtgtgagaacagactcatactcctctatcaccaaatgtcatcattgccaccttcaaaatgtatcttcggtccgtctgattcagtctgtctggctcctccctcatttttgccactgttgagctctcttacttagttcttcacatccactctggctccctttcaagctgctcttctctcagcacccagaggaatctttttgaaacatccctccaagcatgttgttcttctaactaaaatgtgtcaatgatgacccattgctcttgggatagaaatgtgattttttactgtggcccacaagggtcttcgtgatttggcccctgcctgcctctccagtgtcacgtcatatcactctccaccttgttctttacatcccagcctgcttttttggtcttctgcttcctgtgtgctaaacatttgtcagcgtcggggcctctgcactggccttctcctctacctgaaacacttttctctccttcttcaattagccacgtctttcttaacctaaagtctcagcttgaatactactttgccaggaaagccttccttaagctcctaaactgggtttggtcttcctattatatattcatatcctgtattttatagcacctatatttatcatttaaattattgtataattatctgcttcatgtttgtctcccctattagaccataagcgccatgaggatggaaattatctgtctcactaactgcctgacaaagctcccaatacaaagtatatacttaataaatatttgttgactgggtaaattgtgcataaaggcaggttataacaatatgagagtttagattaggaagattattatggaaattagaaaaaaagaagcaaataaaatgaacattgtaaggaaacaatcagagattgctattggacgatccatggagaaagataaccccaacttcacaaacccataaagagtaggcaaaaatactgctcttgcctcttggagaaaaactctgaaagccagatcctaacaagttaaggaatgcctcctacagagattagaaatacaaatactccgtaagaaaaagctgagagacagaaggtcagtcctgaagccttagtttcatccatggtcataagcactaatttatttccctctttttttttttttttttttttttgagaacggagtctcgctttgttgcccaggctggagtgcagtggcgtgatctcggctcactgcaacccccgcctcctgggttcaagtgattcttctgcctcagcctcccaagtagctgggactataggcgcgtgccaccacacccggctaatttttgtatttttagtagaggcgggatttcaccatattggccaggctggtcttgaactcctgacctcatgatctgcccgcctcagcctcccaaagtgctgggattacaggtgtgagacaccatgcccggcctataagcaccaatttcaagcaggattaaagcttcattaaagaagcctaagaaacatgttactttttccagatatttggcagtgacccaaggtcagcattggtttcccactatatacactataaccttcttgtttctgtctttcatttaggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacaggtacattaatgactaacaggagcaggagggagcaaagtttatcttctctttcttttctggcttttactatgcaactgtaatctgtcttaacctttccaaaataggagagttttgcaaaatctgcattggaagtttcacataaagcctcacccatttcattttccagctcaaatccaaaatggaacttagactgaactgtcaggtcacctacataatggctttgtattttaaaacttaacacatgtacagacttatgtaccctgaatatctattgcctgctggctctaggtttcataatatgcagttctttctgaagctactgaaagttggtagaagcacagcaaattcactgttggcaatatagagcctcaacttccagtttcttgatagtacctgctggaaacggtgatctgtgactgtagctggccatccccaaggatcttgagttatggtttgaggatcatcagacagggacccaagcttggggatctctacattatgctttggccctaattacccagcaacctgcaaactacaatgtggataatgcagaaaaggcacagaatggcttaaatgaagaacttctgtccttgttataatcttcagtgaaggagaacatggagaacataacaggaatgtccctgttgctgctttccaaaatctttccttttttttttgttttttgagacggagttttgctgttgttgcgcaggctggagtgcaatggtgcgatcttggctcaccgcaacctctgcctcccaggttcaagcaattctcctgcctcagcctcccgagtagctgggattacaggcatgcgccaccacgcccggctaattctgtatttttagtagtcagcgtttctccatgttggtcaggctggtctcgaactcccgacctcaggtgaactgtccaccttggcctcccaaagtgctgggattataggcatgagccactgcgccctgcccaaaatcttttcttttgctaacctttccctgctaagggatataaaatcttttcttgcatggagttttcaggtactaatgttgtctgactcaactagctgattttacttcattaaaacctctttgtttcacaaagaaaaatatgaagaaagtttttctccattgctgagagctgggaatctagacttaaagttctgagtccccttggatccttaaaacaatctgtaatctctattgaatccagaagttagaaatctaaacagattataacagccagactttggaaatatttgtatgctacctacattttcaattttttttttttgagacggagtctcactctgtcgcccaggctggagtgcagtggcatgatcttggctcaccacaacctccgcctcccaggttcaatcaattctcctgcctcagcctcctgagtagctgggattataggcatgcgccaccacacccggctaatttttttttgtatttttagtagagacagggtttcaccgtattggccaggctggtctcaaactcctgaccttgtgatccgcctgccttggcctcccagagtgctgggattacaggtgtgagtcacctcgcccagcctgtatgctacctaccttttcatattgctaattgaagttattctttcttcccatagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttccatccctctcttcattcagcaaatcttcagtgagttcctttctaaatgtattgtatcagaacttgtgggggatataaagaaaaaaaagaggttatcacatggcttaggatgtttccaacccttggatcattttcaccccaggcccattagttacagagcactcagtcttacccagaagcatcggatatagtccaggcaaccggatccaagcgtgtgggaatcgcagtgtgctgcatgtgggaatctatcaggccaggatgattcaagcagcagcctgcagaagtgggatttggccagccttgcctgactctggccttccaacttgctcttatctacttccaaagtaaggaatgccccatgatgggccgagcagtccaaaaaaagtggcttggagttagctaccgcaattagcagtttctcattattcaacactgcattacctctttttcatattagttaactgcagaattttatttttatgtatttattatccttccaaacccagtgttgtaggaagaatattacatataaatgataacttaggaatcttgtcaagtttttgtttcttcagcactaagtagcttattttctaggcaggtcttaattctaaatgtaacatgcttgaaaaaaacactattgaaaggatccgtctcttcagcatagtatttaatatacatatcaggcaatcaccatctcaagcatgattagactcaagtgctgccctccatcgtgtgagggatgctgggagactggaagcttagactttagctctttaagttggtgcaaaagcaattgcagtttttactattaataataataattgcctagccattgtgcagtaccttgcaagagctctttggcaaatgaaagaataattcaaagcaaagtcggccagatataaaacacttccaaatcacatttcaaaattgttctttcatgtcaactaggtgcatgtctgctaagggagtttttgcaaggacaggtggatagtgtgaggcctttacaataatcacatcaccatctggtactatctgtatggcagagcagttctgatgtagttgtagtattatagatcattacagagtatgccagtcattccatgatggaactgtgactggcagccttcattagcccaaagactgatgcaacagattgctttgagaaatagttttgaagcacatccatgaaacatatgatcctatgggttccagcattgatttctttgaggtatcattttacacttcagtttttcctggtagagtatttttcagagatgtctcttctgaggctaaattaggaatttctgttccttattcaagttccaagaattgtgcctttcctgccctctgcccaaactggaagatagaaaccgtgggaaaaaagtgtctttacaaactgcactgttatctaacttggtttatttagcatattgaggaagactttcacatccatggaatcctagttctattaattctctccaagctacaacagttgtttttttgtttgtttttttccgagtttctcggttccgccagcaaggcaggggtgggaggtgggcacccctgataccaaggctgacaggtagtgagttgatgtggaacttctgtttcctcctgttcagttcaggttctctctttctgatacttacccctcctcaaatagggaaacggagagaggggaaataggaagatgagccttaatagggtttacttaattggggtcataaagattctaaaaagtatgcattcctgcagttctgttctaggcactgtaagagctgaccagaaagagagcttctacccttataaccttcatccaactcagtcatgcctgggaaggatgttggtgctaattttagacacagagactaagatggacaaaggacaagtatcataaagcatttttggagccaggaacagatttaagttccttgcctcactgctgctcttactccaaaccacacaattgtacccaagtgaattgctgttagaattggtgcctttggaggagacaattgctcgtaattggtagctacaagccacttcactgagaaagcgtggggtcttagatgctttaagaaataatagaaagactgagcctgagtgagtcaggctcttctgagtcatacagcttttaggtcagtgtaaaatgccgactttctgaggtcttacttttttcccctctctggaagacctaaggcaaagatcgctctcaaagagatatcaaagaatagagacctttccctcagaacctacctctgcccagtgttaaccaaaatgtggtttcaaatcacctgttcaaagcccacagggtatttgttaaacatgcagattcttagtgctccctccacccacacagacactgcacaagaggccctgctttggaccactagttcctaaacatggcagaaaatctggatcacctgggagactttttaggttaaaaaccggaaacaatatgtaagcataaacatgtcaacaaaattagaggatgtccctctgcttgctgtgcttggtattatacttctatactgtttccctatgcgtgtacatataattttgttttgtttttgtgagacagagtctcacccactgttgcccaggctaaagtgcagtggcccaatggcactgctcactgcaacctctacttcccaagttcagcctcccgagtagctgggactacaggtacccacaaccacacctggctaatttttgtatttttagtggaactaaaaattttattatagtattttagtttcgccattttgaccaggctggtctcaaactcctgacctcaagtgatctgccctcctcagcctcccaaagtgctgggattataggcgtgagccattgcgcccagccagtgttgttttatggaaatgagtccgtattatgcatattgctctgcagcttgttgtgttttttttccccagcttgtttttaactaacagagtatcaaatggacttccttgcaaatctgtcccattcttttaacaccaggatcacaactcaaatgcctacaggggttaggcagataacataaatgagttaaatggatccagtaggaactgcagaaaactggagatgttccatccaatggcatcagatgttacccaaccacaaactaactactgccatttggaaatgttggcccagagttgccaaatttgagttttcaagaaaagcaagaaatctgaatttttgaaatgtgcaatctccagatttttaaatattggtaacaaattcacattaaatgcagtgaaccagcccaaatgccttcaatccagacactgcccctccagccatccttttgaaacttctattgccatgtataatgttccacggtgtaactgtcaatacttaacctttctcctattgctggacacttaggctatgacattacaactactacactgaacactctgtataaatctttttgcttgtacaaataattctagaaatacagcttccaaattgccctctaaaaggctgtaccaatttatagtcctataaacactacatgagactatccttttctgggaagctttaaacagattcccaggtagtaaccctgagatcagatgcagtaggactgagatgaaacccaagactgtgtgagtgagtgatcggaatcactctcaggtgattctgatgatcagcgaggttttggaactactgttttagactatgaacaaactttggggccaggagcagtgaattgtaaaggaaactatactttcatttgtacttgttatttttttagagacagagtcttgctctatcatccaggcaggagtgcagtggtacaatgatagctcactgaagccttgaactcatgggctcaagtgatcctcccacctcagcctccagcatagcgaggccacaggcatgtgccaccatgtctggctaattttttaaaatatttttttgtagagacaggatcttgctatgttgccaggctaatctcaaactccaggcctcaaacaagcctcaaacaagcctcaaacaagcctcccacctcagcctcccaaagtccaggattacaagtgggagccactgcatctggccagtactaccatgttgtacacttttcccgctaactacagccctctatgcaaacacaaaaaaggctctgctgctgctgtttcaagcagttctgtcagagtaggacaataaataaaccaactatggaaccttcaagtggcttttattggtagagcctagaaaaagtgtcatagccatttctgagcaaaaatctgtatcccagtaaggtattcagtgttatgtttaacacactactgaaccagaaagtttaagttcctgacacagacgcaaccaggtcactaagaggctccaaaatcaacaagttaagccctgctgctctgttaagatctgaaaggcaagacacagtcctggatgtgtgcccttgttacggggtgactaaaaaggcaggcaacagtatcaaggattttttttttaggtggactcctgtgcactcccacattgcaaggatgtgcttcagcagcaacactcaagtctcctcttcattctgtatctgcctaagcaatctgcttaggacacgtgtggtcggtcataaaacatgatcatcaggatggtagagttcactcatcaggcggtagatgtaggaaggtgcattcccaccaatgttggagataaagagggtaatgagctctgggggaacgtagtcaaacacagggcaatgcacgctgaccttctccagaatgtcccctgaaaggcaagcacacatgctaaaggtaaaactgaggctccctctctcataattaagtagcatatagattccaggctcgagaatgcaggcatattagctccccaaggacgggaagctatggaaaaatgcaaaccagaagagatgacttcagatcatgacaatccctgcttacaactctcccatgcctctgcacagccctcagaataaaattcaaactcaggattgaagtttaagatctgggccctccctgacacaccacatgaattacaatttggaccactctcccccttgctcattactgtctagccatgtatggccatccttttctaactggctaagcccctgcaccagctcatagaaaactatgatcttcatatggtggactctgttcattcaggactcagctgaaatgtcatctcattaagacccttcctcaatctcaggcccctagccactttctaccacatcagccttgcttgtcctcaggcatcccatgacctgatactttctcatctgtcttccacaatagaatgtgtgggaacagggccttatctttttcattcattgttttatcttcagtgcctagaagagtgctggatacattgtaggtgctcaataactatttcttgaagattgaatgtttatttaaataaagggatgaagtcaatcaacttccaagaggaactaggaccccaaccaactactatgcgttgctctcagatggtgtgtaaggccacccttgctgatgaggctgcacgcgtaatgagctgagctgctgccttcagaagaagccagagaaaagaaccccaagacatgagactatccaggctacaggtgagttttctaaggaggaacatttcacaacctgcttcctttgggagtcaattcaccaaaatgactccttatagcaggaaaacaggtacattttcccaactggttgttgtctatatctcaaacagcatgcaaagccaaacccagacaatgctaaatgatccaacccacaatagccccaacaaatctaaaatatatttgtctcagaacaaattaacatggacttggtcaggtcctcaagcactttgagcttctaaagaaaacagtccccacaagaagtatgataaaaaacacaacttgacagcattcagttctactgaccaacaaaacaacaaaaagaccaaaacacatgcacacacaaaccccgaatacacacaacacatgcacgcatgcacacacagcttctgtaccttctgtgaatggcaggacttcttcaggagccacaaacttatgaaatgagtcttcttcattggggaactaaaaaggaaaaaatttataaaaactagagacccagcaattccactcctaggtatgtaccctagagatgaaaacatatgtccacacagaaaacttatacacagatgcttatagcagcattattcacaaaagccaaaagctggaaccaacccaaatgcccataaacagatgaatggattaataaattgtggtatgttcatataatggaatattattcagcctcgaaaggaaattctgacattacaacatggatgaactttgaaaacatcatgctaagtgaaaaaagtcaggcacaacatgtcacatattatatgattccttttatacaaaatgggcaaatccatagagacaggagcagattggaggagatggggagaaggacaaatagggagagattacttaatgggtacagggtgtttttctacagtggagaaaaagttttgaaactagagagtggtggttgtacaatgctgtgaatgtactagatatcactaaattgtatactttaaaatggttaattgtatgttatgtgaatttcacctcaatttaaaaaatagagacctataaataggttgatgttttcaaagcaaatagcttctatcactgatgaaatggctcttcacttagtccttgcttgtattcaggttacaaaggacaggccctgcaacaataacaaaactgattctatgatcctactttcaacctgcttggcattttcagaaatggtcaggcgacagggagtggtggcaatcgtaagcaaaggacctttcccaactacatattgtccttacaatcttgacttcctaaagttgacagctgagaactctcaactgttttactgaatcaagacttctgtggttctttccagcctccactgggtgtaatccattgagtaaatgcagataaatggaggccctggagtgaggtggttgaagtcccagagttcaagcctaccctttggcttccttcttttctgctggcttctagctagagacagacacacttacctgtggagaaagtttgaacataggtgcacagacgatgagtggggtggaatggtgttttgctgccagtgccagagtgtgagttcctgtcacagctctcagggccccattggccaggatggtcttcgtgccaatgatcacctttgggacaagacaaaaaatgtgagccatcctgggggtggagccctaaaagggccactggccacaaaaagctaaatgcttagacctcagaattggtatcgtgaggggtcacagactggtagaggtgaagggatccctggctcaatacaagttctagcttaaaagtaggtttccaaggaaagaatgaatgtaaaatgggacaagaaactgcaaaacctactgctctcagtcccatattttctggaaa

SEQ ID NO: 1607 - DNA, 5190 bp, Homo sapiens
caagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcttagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataa

SEQ ID NO: 1608 - protein, 1429 aa, Homo sapiens [sequence omitted]

SEQ ID NO: 1609 - DNA, 25651 bp, Mus musculus
  misc_feature (1)...(25651): n = A,T,C or G
ctctgatactccactgtgacttcatcttagcaatgtttgcaatgctcctacttccaaatgaggtcacattctgatataagggctatcaagacttcaacatatattttgtgggtcacagttcagcccattttgctacataaaaatgacaagaatttgagttcaatttgacatataacttttttatactaaagtcacatagacatacatgttatttacagagaggtgaggtgggggatggcttgatggcactacaaattctatgtgaactccaaacatcctcagccactgttgctgctgacatacattttatttttatgtgcaattcagacatccaccctgcttctacacacatgggttttgcttaaaacctttacccactctaacaacctcacaagaaaagatcccattgtaccacatggtattaattttgcagtcttcttaagacctcattgaatatgagacattcacattttagtgtacatagctttacattgggaagatccacatccagtctctctagtctcttcttggctgtgccactatttggaattgtctcttttctagtcatatccccatgtaggctctgtcctggcccaaccctatcagtcctggttatctgtctggactctacacaaactttgcattgcctgtctcacccctcagaacactcaggtattttacttattttaaactctgcaatggaagcttgcttccataattccaaagtccaccagatgagtggttatagacaagcaacagagacctgttttcggaaatattaaactgaactccaagttcccatgcttaaacatctcagatcagtttataatggcatttatagaagggctgggtccaagccttgtacttacaaaaattttgtatcaatagaagacatttataccagtgaaaaccttgattttttattaaaataaattctgtaagaattaagaagtcataagaaattatgacttcaacttagtaacaattataaagatttcaaccaaatgagtttatgggtatataatcaattctagctatttcctctctgttccaattatgaccattactaaattccctaaaaaggcaaccttagaatacccacctctacctccaaagccaagggaactggaacaacaactcttcataacatcttcaaggtgaatatgggtgttgagatatttttgaaaggggggggtagggaaaatggggagttggttggccttaagaagttcacaccaatgattgtattagtctttgatgtgtgtcctaactggatctgactgaaagtccaaaacagcaggagttcaagcaggtcagtttagcatgcctgatgatgagactcgccaaagttgtttattctgtaatatacaaatctcaaaacaaaattttggtaccatcaagataacttcttttttgattctctggaatctagttgtctggggggggtctccctctatcaaatctgatccatattactctggaaggtatatagacactaatcaccttttctaaaaatgcaaagacaaatcctttctcccaaatcagcatatccttgagccaataaccagaaaacctttatattgacctttatattcccagaggaataatataaccacaaaactcaaaatcacacccattttgaaagttaaagcaatccaaaacaaatgaagtaaactaaagtactgtatgtgcctattcttaggccttttctattttgccaagcaataactaattgctaataacccaagcaataactaatggctaataacccaagattcacgtggagcccatgttagacagaatttgagaatcctgtgagttgtattagagcaatatatctttgtaccttctttctgtttggctctcttcctaatgcagtcattctgttatgccgtctatctgttcagttctctacctggagccacagatatttattaattaatacctcttatggcaggtaattatcactgtcctctctacttggagtcagtgactaattttccctatcctggttctgtaccgtgggtgaaaatccctgtctcagccagcgctacccagctactcacttaaaaaataaaataaaataaaattctaattctcgggcaaataatcttaaatttctagtgggttcttgcccaacatgttggttcaccccctgttgcaggaaatattaaatattctaagttcccgagcttctcccagctactctcagcaccggcagtcttgcggggcagttcttatctcttggagactctctgactcagggctccaaaatctctccacccagcttgctatcccatctaaaaagcctctaactttctcttctctgtccatccaacctggaagttttgcctactcgcccagtgattggttattcatctgagggaaggttcacaagaagtcacctgagtacaagactcattccttgttcccgacaacctctcatgggaaagtagaattaacatcaaaatacaggcatcaccagggccatctacaaaggagaacctattgttggttatagacaagcaatggagaacctattacagacagacaagaaatgcagaaactataccaaatacgtatttctaattcaccatttccatattctcattgttgtgatcataaaaagagaaagagctataagaatatgttctcatagggtgtgggggaaggaggtgcctcagtgggaccatgctgaggcatctctatcccctgagggaccagccataccagccatacataggtatagtatagaatagagtttatttagggcatggggatggggggttaagagggtagtagcggcagagaaaggcagagcaaaggagagagcagataagtggaggcaggccatgaccatgtggagagagggggaaagggaatggagagagagggggcacaaaggggcaagaggcaagagagaggcaagagtgtaagagggtaagggagagagagagagaggaggggtcaagcagccccttttatactcggccaagcctacttggctattgccaagtaactgggggtgaagtttagacagaatgcgaatactcatagaattatttttgtaagccatcagaatagtggctacatttttacattacattttcttacaggatgctctaaactcagaatataactaatccttaaagttgatctcatgaaaatgtagaaaaccttctcagtatggctttattatgcttagaagaggattcaagctctcctgtttttgtctctggtttgcacgggtttccagaatggttatctgaagttcctaagtaaatttagtgctctcttcacagggacagaataggcagcaaagtgagggcccatgtaccagagtctctgccagccacagcacagctggtgtaagtcacaccaactcccagggaagcagaactcagagtctggggaaaatctgttcagattcagctacagtcagtgatgtgtgcaaagcctctctggagagaccctcaggatttctttatcctgtggttagtaattccatctggatatgtctggaatattcagttatttcttctcttccaaggttaaatttaaaacaagatccccttaatgtagcatattattaagatttagctggttggtttttgtgtttctaaaaccaggatagtcacacaactgccagtgaaagctctcggtttatattccctttgagagtaacctggtgatttgaataatagtaccattagggatttccattacattaaaaatattcataagtttgttcttctggttattgcacaagtaagaaaagacctttccttacagcaatgggtttgcaggagaaagcaaggcctttgacatctgaaaattctgtgactaaaactaacaaatggtgagcattattaacaagcatgataattatgctctaggtgacagaaagccttaggcatgacaagaaaccttccagacagctctctagagagaaaatgcctttaaaataagccttaaaaaccacaggacatgaagaactgtagcctagcacttgcatatattcttaggagtctccatgatccaaacacatttgcatggtaatatgtgttgtctccatagtggctgcagtaacatgccctatagagtagcaatacaactcagtcagctctgacagacaggaccagagacaggtgagttgatgggcagccctgatccactggtctctctgctgggaaaggtcttcttcatgctctgtataggaacaattttgatcacagcttatagcatttcccaagaagagggtacttgggtccattatagcccaggactgtagcatacttatatggcactggttggtctaacacctgctataggcttcttgctatcataggattctcactatcacaccgttcataaccaaacagcagaccattcctgttggccctgtttgaagattcagcaactacaaccctcattttcaaagcaacgatggagcctgtatttcatcctcagactatcgtgctttccaacttgccagcatgtttctgaatgtctgcagaacatgagagctcatgtttcacacttcagcaactcattttatttcctgacttctcttattcatggctcacactcccaacactgtggtgctcaatcttcagggaacatttgaatcatgtaagtgctttccttatacatacatgatggctcttctgacccactccaacattgttgtaataggtctctgatggaaccaacaaatctgtactttactattctccctgtactcccatatcaccaattcaaatgtttttatgagaaacactgaattacactaagtcacagagtaaaaatttagtaaatattactaagtgctatatgcttacttgtaaatcactaatatacactaatatacagaaaccccaagcaaaaaaaagcttaactataaaggcatgaattagcctatataacgatgacagcaatgaaatctagagtttgcttactttggtggccaaacaaaatcatcaagcagccaggtgtttccttttgttttgtactcacaagataagttcagattcccagcacccacaagaaataaaagccaggtgtggtggcagaagtctataatcccagggctggagtacacagatccaggcagtttgttatgggttcaggtctaagacatacctaatgagaattttcagtttcttgtgtcccctgaacagtgagttagacatgtgaatcatgatagacctggaaagagaaaatggaactcccagcagtagaaggtgaaagacacacgtatgtgcctactgaattctggtcctttgtagattgttaacatatgatctaccttctcttcgtgtatcacagatgtgctttgttcgttacatatagtcctggtgagaaaagattttcatatgcttcatatatttatcatatgtctctctaacaccatgagcctagaggtaggaaacacaggcaagctctgtcagacatacaaaggaccctctgtcaggtctttactttctgctacttggcaagaagcaagttgagagccattgcactttgagctgtttgcaggggcaggggaatcccatgaaggaaatgtcccgatcatgtgtgcttcctgttttcttgttattgtgactcagcactttacagaagcctacagttctgcctgattcttctcaaaggtcccaggagtctcaagtttgtccccagggcaatagagaagccacaggtaatgcttgcttcctattcaccctcccccacacactggcctgtctcttaccccaagccacagaggccttctaacatctccaaagaactggacattgccttccgaagccatttagagcaaagcaagaccttcatgttcacacacacagcatataagctgcctcattggatctgaggagacttaaggagacttcactaaagcaagttccagagcaggccacctgctgcctcctggaagcctgcccagcctggaaggggaataaactcttccttcctgagagcacaagtggcaggcacattataacatcagtgtatttaaaaactcacctatttccttaaacatgagcacatgcacacacacacacacacacacacacacacacacacacacacacacacacacacacacacacgggttccgggagttnnnnnnnnnnnnnnnnnnnnnnnnnnnnnnnnnnnnnnnnnnnnnnnnnnnnnnnnnnnnnnnnntccctccctccctccctccctctcttctcttctcctctcctctctctctctctctctctctctctctctctctctctctctctctctctcacacacacacatgggatggggggtaggggagaagggaggggatgggaggaaatctggaagaagcagaaggatgtagctgacaggaaaggagcctatggaatggtttaaggtagaagaggcagtgagaagggccagaatgctagtgtggactttgaaaccaggtacatgtgaattgatactgaaggagtgtggaggccagcatgggctttgatttgtaaccacagatatagccaagggaggtggttctttctggctggcagactcccactttactggtttctgagagttgctactcctatagtctagcttaaacagagcaacaactgtcatcttggagtgatccattgcctttaggggaattggggttcctcttggacctgccagtggtcacattagttcttgaggttcttcctcttttaaagtcttgagttctcaaggtggctaaagctgtttgtggcccctgaagccccatctagagctaagaatagaacggtatgatcttgggacagcctcaccagtgattctgcagttgctaggactcctgggcagaaaggaagacattttccataaaaacaaaggctgttccagacattccagattcctccatgatcatatgccaggccccgggcctctagtaaatgtcaggaagcatccaggattggatagagctgaggttgataatgaggtaaaatagaggcccaggtggacagtagggtagagtagggccaagatggataactcagttcttttctatgtaaatgctgcttgtgaggatgtaatgttagcatgtgacctctgtttagattctgcagcagcagcttctccccctttcctagatacctactgaacactgtaagtctctagctgacaggcaatcccagcggagtgtccatacgcacctgctatttataaggttgctaggaaatgtggtctggttagcctctagatcaaactcaacaacaatactgaaaatgtgttttctccatgacacatgtgcatgcacatacaaggcaccaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctcttgagtgtgtaatctcaccagcacattgctgagggaccccctccccccacccagttccagactgcttgagtcatcagtcttttcacagtcacataaactgtttttaaatcatagaatctgtccatacaccatagtttcaatcagtcaaagtgacagggtgccatgatgaatcctccagaatgctctcattttaaagaaggaagactggacaagctcacctagtaaacatcttattctttgctgtctgtttcttctgtttgaaatataggcatagtatgtcaaggtggtacaagtaccttcaggctgcagataaaggtatgctccacagtggtgagggttccaaaggagcgttcctgtttgaaggctttcctggtctaatataccactgctgggccatctccctctagacttctgcttacatagacccaattccctattttcttatgacattctttgagagtatttactatgcacacctgtatacaacactagctgatacatgaagtctcacactgaaatatacctttgtaaagagtgttcttgtaggagctgtgtgtgtgtcaaacaaaagtcccaagggaaaaatagactcttttactagaccacagcaaaattaaagtccctaggaaatttaatagcactacagactagtttaaagttaatataattcttctacatacatctaatgaaattgtagcctttaaagaggtcagaaacctgcactcaagagcattggcagtgacctgtactcaggaataaaataatcaagtacattagtcatgtgtctagagtgacctcagacaattatttacctagtccataaaccattttccttctctgtggagctaatataatactgttaaactctaagaagataatgcacaatataagtcaccaagagaaagatattatatacaacattgtccagttttgtttggctataaaattcttttgtggtggccattttacttactattccaagacagatcttcatagaagctctgtaaacagtcctgtgtgtgtgtgtgtgtgtgtgtgtgtgtgtgtgtgtgtgtgtttgcatgttggacagaggttgacataaggtatctttctcaatcatcctttgagacaaagtctctcactgaacatgtagctcatcatttggctaagctggctgggatctgcctacctctatcccccccccccagggataaagtcacaggtgtaccccactgtgtctggtcttggatggggattctagagatatgaactcaggtcctcatgtttgcacagctggcattttacctacaggtcccaggtcccagtttggtaaatatatatatatatatatatataaacttgtattgttttaggttaaaatagaatttgcttacaaagatacaaagacgtacatcactggagaaggcttctctcatcttccttaaggctactattaattccttcccaactattaccattttggctttaaaattgttatcattgtatatgaaataactccagaactatgagacgtataatacagttccaaggcagagtctcatctattccttagatgtgacacaaatcaagcatttgaatatttcaaaggacatgggaaagaaaatgaaaacgtagcagtaagaaaattagttcaggctcctagtgtcttgttttgaatggaaatagctccccataggctcctatatacttagtccccagttgatgaactgtttgtgaaagattagggcagtggttctcaacctgtggcaaccccatttgaactgcataccagatacctgcatatcagatctttacattatgattcatagcagtagcaaaattacagttatgaagtagaaatgaaatgattttatggctgggggtcacctcaatatgaggaactgtattaaaaggttcaaggattaggaaggttgagaaccactagatgaggaggtgtgatttttgaggttgcaaaagcctacaccaggcccagtgtctctttctgcctgctgcttgtgaatcaggatgtaatgctctcagctacctcatgcctgcgtgctgcacactcaccaccatgatgataatgaactaaacctctgaaactgtgagcaagacaccaattaaatactttcttttgttagagttgtcttggccatggtgtctcttcatagcaattgaacagtgactgagacagatccgtgctcactcttgtaacactatggtgtgtccttcttctgaccaggggttgcccctttcttcctgccatgcctagcaaccaaacaagtcagctagaagacaggctgagtcaccaggagcgcaccgtagccttcctccttgaacaggccttccgaatcaaggaggacatctctacttgcctccacggaagccaggggtttcgaaaagaagaatctcttgccaggaagttactagaaagccacatacagaccatcaccagcatcgtcaagaaactcaaccaaaacattgaggtacatctgtttctatgttttgccatcaccacccaacaaagactactgaccgtccaaataatttttcaattaaaatgtgctgctgctactccagagaaagttaaactttagacagctcactatggtaaaatgtaacaaaaacaaacctttccttagaaaatgctgtacatcacttttgagaccaaagaatacaggttagtatgacagacattgggctcataggctttcctattctaggtctgtaaggctgacataagttgaagtagagctttgtgtattcatcaacaaactgaagccaacaatggccctcctacccagtcttctcttctctctggccatgccagcctccatgctaggcattgtgtgttcactttagtcagaccattttcccgtagatagccctttgaatgttctgtattttcttgaagttcctgctcaaatgccaccctgtatgatagcacttcccttacatcagaatcaccccttccctacagtttcagcctcccataaactttactctttctttttttttttttccgaacaaggtttttccatgtagccctggctgtcctagaactcactctatagaccaggctggcctcaaactcagaaatctgcctgcctctgcctcccaagtaactttacatttatccatagctcttacaactgagcataagattatatgtctgtctgttgtccttccatatagtacaatctccatgaggcttatatttagtttaaatcgccgctaagtcacacaccagtcccctacccccaaaaagcttttctctctctctctctctctctctctctttttttttttttttgagacagggattttctgtgaagctttgtctgaaaatgatttttaatatgttaaaagaaacaaagatttttatcaaacaaaattcctacattaaatgaaacacctttcaattacaggccttttgttcagagttctaagggttttatatatcatgagtctacacacataacttttggccaagggatctggagataatacttcaggcaaaagttcagaaattgtaaaaccatgaaaagtgacaacaatattctgctctgtacttcccccatcaagtaccagtgaaatttgagacagatttattttgttttaaatagaaagaaaaccagacagcacacgtggggttaactcagtacaagtggcttgtgtaagtttaatctttgtgtatataggtctagtgggtgtaagttgaatcttcatgtgtaggcctagtggatgccacaatgcaaccagaggacggtgaaaatgtaaaactctccgtgaagtcataaaaccgaatgtgtgaacactgtttccacttcccaggcaggttgacacatgcctgtaacctcagcagctgcaggctactaccggaaaatcacacgctccacgacagcctgagctacatagtgagactttgtcttgcaaaagcaaaagctggaagtatagctcagtggtagaacacttgcctcgcttatgcaagccctgacactgatccccaggaccacaaaaatgcattcaaagttttaaggtaatcaaattaaacatggcaaagcagaaactactaggctagcattggtaaagaactcagttaaagaatattatatagggaaatggaccctattccaatagtttaaaggaaactggactcaccagcccagctagtctatttgcattttgtctctaaagagatattgaaatatgaagtaatgtttaactcaagtccttgaatgaattggtggagggctatcttcccacaattgcagcagagtgagtggcttgatccttttaaaggtcaaatagcttatttgagacatactggccttgaacttgtaaccctgcctttgctttctgaatactggggttacaagcatgcaccaccaaacccagacaagcaaaaggcttttaaccaggaataaactgtaagtttcaaaattaatttatattttaactcagtaaaggaaatttttatgctttattgcagggaattttccctagttactgaaagcaatgtttcttcattataattcatttgaaagttcaggaagaaaatttgaaacctgggaaaatatcctcacaatcctaccacctaatggctgtctctacaaacacccagagaaattccctctagtccttgaaagcattctacttaggagacggactctcaattcaaccacagtcattagcatgaaataaactcacatcactaaaatctttttacataagttgtagatcatgatttccttaattattttcttaatattgaaatatccttgtgtgtaaagttatttccacaatatatattcttggaaatggaattagtagggtgtagacactataaaagctcctgatatatgttgctaaattggctacacaagccctgcactaatttacactccattagtgttatgtggcatgctttacactgggcctatgccaaaatcgaaatttattatttcaatccttgctaatgtacagaaatgaagtactgggtttttttcttgaagatgttgaatccacttgttaatctgcctatgataatttttattttctatgtcatttgctaatatatctttggggcttttagcactttttaattatgttcaatacgattagctcttttatatagtaaggatgatagccaggggcacattattaaacatttaacaataagctccccatatgtcccatgctgtttgactccacttttgttattagtgtttccactatgactttaaccaaccatcatggtgccccagcacacaaagatgaaaagacctgtgcaggtcagcctcacaaacaggtacatggtagcttctttacatcagtgaaacacttggaaattacatttgtcatgtcttcttgtacttttatagcttaattgtttttaaagtgcatttacatggttttatataaagttaaacatttaagtattctgcattggaactaaaaagtaactaagtactgatatcttttgacatggccctgccctaatgtgcaccacacacacacacacacacacacacacacatgcactctacacacatccatcacacaccctacacacacatacacacatactcaaaccctactcacacacacacatgcacacgtatgcacatgtgtatgcacacatgaacatccatgttttagtgtagctattcctttcccagggttacagaagccttcaatatgttgctatgttatagtacaggacaatactacattgtgctgagattgcaatatgtcgttgctatactgatttacttggttttgttctagaaagtactcagtactgagcagagctggttccttttcctctgttggtgtttgcttgtttgtttttgtttttgtttttgtttttgttttttgttttttgttttttgagacagtcactcttactgtcctagaactcactatgtagaccaatctggcctcaaactcacagaaatctctgtctccagagtgctggcattcttgctggattaaagctatacacaccacacctggctcatctctggtctttactgaaggagaagcaatgcaaaaaacaccgaaaactatgctttaatgtttacctttgaaaacatacacactgttttattaaattttcactttcatacatttaattgattttgtttcacttacatttctccccacacatctttccatatgcagttccctttcttgtcccaccctaatgtttcaacccctttttaaaagtttgaaccctatttaagtccactttgtgctgcccatatactgaagggcatggggtggccacagccttacagaaaactgaccatcctcctccagaggcctcctttagtctgtgtctgatgttcaggttttccatgctcctagattgtcccaatccatcagtcagaaatggggaaaatctatatatagaaggtctttttcaatcctagcactcactttttaaagactccttttggtttgtaaagtgcatcaaatttaggcagagttcaggcatttttcagatggaaccaaacttgagcttgttttgtccaaagtactgtgctttctttctcaactaaacattttgtttgtcatcatctactgacgttagtcaactaaaacagactgttaatagataggcatttttttttcattttacgttaatagttacaaattggtgtaagatacttttaaaaccactattcctagcacaccaccttggtaccaacttaattaaatgccaggatacgattgagatgtgactactagggataagttttttttaaatcactatagaatgtagagtagacactctttaaaatgacgtctagttggggttttgtctcttccattatttggtaacttgttttacacttctttcctgtgtatatattttgggctgtgagcctagcctttaatgactgcgccttctctccagccctatgtgtatatattttacgaagcttccactctactaggtgtccatataagattcaaatggcccgtgttgttatttgtccctccaccataattcctaacactcctgtgccagactctgccacatctgaccataactatatactttctcttccttgagagattttcccagactccctagaccctttatccctaaactgggttatatggattgttacatgtctattgaatatttaaaagctactctccacatataatagaataaataagtatttgtcttttggggtctgagttgactccatctatttatctgagaatttcatgattttgttttttatttaacacctgaacaatattcgattttgtaaagttaccacatattcattatccattcatctgttggtaatcatctaggctctttcctctttctggctattatgaatagaggaacaatgaacatggatgagcaagtgtctctgtggtaggatgtagagttctttgggtaaatgcccaggactaatacagctacatcttgaggtagatctgttttcagcttcttgaagaactactatactgacttacatagtagatgccaatatttttaaattttctggctagcgttcacaaattattgagatctcatttactcctggcagcattcaactgaaactacatcagcttccctcacttaaagcaaaattcagtttctctctctctctctctctctctctctctctctctctctctctctctctcttttccatccctctccctctcatctcatctgtgtaaccagtttaatatggattttagtgatgtttccttatcacgagaatttggaaattaatgatggtcttacctcaaaattacagctcctagaagaccaaataagaatccgagaccaggtgaccacaggaactaactttgcagtgcaggatctaaacatcaaacacttacaaggagttggagaccttcggggaagagtagccaggtgagaagaagcatgtttaattcaggtttgccagctagctgttggctagtgaatatctgtcagaagaattttacattaaaaaaacccaaactaccagtttatgtcaagctaagtgggtgacattgcttgctgtcagttccattaacccttacatagaatacccaggtttcttttgtttttgttttgttttttttttctactagaagttaccagagtcttgtctttacaaacttttcctgcccaggtgccaatagttattctcagaacacccatataaagacacaaaatcaccacatgtagtacttctgagaaataaagtacttaaagtatgcagtgattacaaatcagccaaacagaaaaaggtttgagtaacatcttttgtatgacaattaaatcaagagttaataatgcgtgaatcaggagaacaatctatagataatgacaatggtagaaacacagatggacacacatcagaaattagggaatgtcatacgccaggctaagattcacaacacatcccttcttagtagctcttcagtgtccatcgggcaaaaccagctatatcaacagctatatcaacagcttgccggcaatgaggataatactgtcctgcaagcctggtgccctgtgacagtgttcaagtcagactgagcagaagaggcagctcaagaaggcaagactcagaacagactccaaagtatttgcagtaatgatccaagagtggtgggaaagacacttcacacaggagggaaaggtgtggaggagagtaaagggaaggtctgctgggcatgtcccaagtctgaccttggggacagtgttccagttataatattgttggcatatttattcaagtaaagatgggagacaatgtccacgaaacaataaaaattgaaaatgaggaaccttgtaggccaaagtaaagtgtttgaacttcatgtagaagactgtaaatagctataaaaggattttagatgaggtaatgtcattctaataatatatgagctggtggtacatatagaacaagggcatagaaattagatgcattctatggcaggagcccagggtagaggtaggtaggccctgaactatgtcattagtcatggctgttcagtgcagaggacagacataggaaaatagaacctatagaattactacatgaatcaacattaattaggacagaggaatacatgtcaaagtttttagaatacacccaaaattttgatctgcaaagtaaaaaattatgaaatgagaggcaggtaggacaaataagtagaaggtgcattggtcccaaaagtgtcccatctgagaaaccagtaggatcttaggcaatgagcaaggcattcaacggggaagctgtaggggcagagataggggaggtgccctggatttttgttgtcctccaatacaaataacttagtggtactaggaaagattctatggttctgaaatgttgctttattcccctaaaaattcaatactgtttaggaaataatgttcatggttaggaagtcatcagagaaaaattaactgataatccagagacttagtaagtaaatacaatatttatatatcattctatgtttattagataatatctgatacatgcaaaagaatgtttagatttgggtgggttatacaaaaacataatacgataaacatgaatgaacctttggccagccttacttaatatgtttttgaaaaacttaagcaacaaacacttccttttgaatgaaatatgatttggttcagtttggtggtatactgataacatttaaatgcttatttttttcttataaattctattttgtatataaagcaaagaacaaatagattcaaagtagctaagggcctgagagatggtccagtaggtgcaagtgtttgtagactaagcccgtagacctgaattcaatctccaaacccacagtagaaggggagaagtgatttcttaatcttcacaggtaagcattagcacatgtcatactgacacatgcatacacacacagagacacacatacacatatacacacactggcactcatacacactgacacacacacacagagtttgtttttttttttttttctgtaagtaactcagagatcaatagaataacatcgtgaagatgtgacattctttttcctttgctccaatttaatttatttttaaatattattttggagtcaaatcccagggactgttcccaggctaaccatattctctatctactactgaactccattcctctttattgccctctgtctctctttctttatgtcttcctgtctctctgtctttctctatctctctctgtgtctttctctatgtggtaagacagagtcctgctgtattactaaggagagctgaaacgactaatttcccacttgctcctctcaaggacctggatgtatgggtacttgccagtacatgccactgtctccaatactttctaagccttcatcctcaatcttaagtagtatcctcagggcaaggtcttgtttctccttgaaatgtctaatatctgtggaaaattctgaagactatttggttacctgagacaaactctggctagaattcatcacacttagatttgtcctccctctcctgcttcttttctgtgttttttttttgttttgttttttgtttgtttttttgttgttgttgttgggtttttttttgtttgttttttgttttttttttttttttggccaggaaaaaaaaaaaagaaaagaaaagactaatggacaagccaacgcatcttgattactgcctttccacattcagtcatttaaattctaattagcattttgccataagtgaaattaagttaattattttaacataattcctggcaagcactttactgtttcataaatcagcctcaatatttaagtttaatatttaattcttaattaaagttctaattccttggatttttacatctcccccatcccaatgtattggtattttaaaagctgatacttcctttgaagtgagtttctcactgtggtacagcctccctatgatatctctcttctggcagattaatcttgagtacaaaacagataaaggtgagtgagcacggggtacccacaggaatggtcataacttacagcctgtagcagcagcagccagcggccaaaccattgccatgcttggttcattaggactacaaatcaaacttgtattttttaaaaaatgagaaatcatgttgacttgtgattcaaagcaataatcatgtacctcgagtataaaagttgagagagaacatttctgtccatacaggacagaatgaagacattttgctcaattctccttcaagatatctcagagctaatggaaaacttaaaaggaaaaaaactttcacttttaatataatgtggagtagaccgatacatagatatgatagatgatagatagggagatagattatatatagattgatagtgatagatgataagtaggtaggtaggtagatagatagataggtagatagatagatagatagatagatagatagatagatagacagacagactccaaaaggctggagaatatacttcatgaacagaattgcccagaaatagaaattaagacaaacccaatgtctcctagtttcaaagaaactaagagaaatgaaaaacttgtgaacttatatgtgactctgtctaaaggtgacacataaattcttttcacacataaatcttcaatgaagttatttttctctttaaaatgtgaacccattaacatgagggatacgagcgagttttagagttgtaaaacagaagggcatgtgaaagtggccttaggaagcttaatcacagcacttttaaatctctatatcaaaagcagagggttatgggacagagttgaaagaaggtgcaccttagccttctagacaaaataattataaaagaaaaatactgtcataagtcatttttccatgtgtgtgagagcagacaacctcctttaaaaacgcaagtatccatgtatgcttgtgctctccttttaaaatcagaaaagcaaaatctgaccaaccaagaaattaattaaaggaatggtgggatggcggtgccatgatgtataatgaaaatgcagtaactgtagaatttttagttagagaacacaactcaagtaccatacaatttgacattctagaagagcaaaatgtttacagaaatgccaaaggggtagatatataaatttatttttatctcacctgcccctgctttgggggaagtatgggcaacagaccctgtctgcagttgagatggcaagtgtagaacgccagccattccagtctgcgatggcttttgaggtaccttattttagaaataaatatctcctgtaataaagaagtatacagccagccctcatatttgtgggttttatatctacaaaggcagccagcctcagacaacatggtttataatgggcttgtagtagtaaaattatcctagaaaaggatggacacaaagaacagcccgagggaatagaaagccctgctctcagaagtctctggtcaaccttggatttcagctttgtggttaggctttgtgaggaagtcaggagccactgtcaaataggtaaataagttgccaagcccatatccctgctctcagagtgccaagaactgtttaaataattcactcatcaccacctcctgtccttaaatagcaccagtaagaaatactattgggaaggctacttagagtcctgggggatgagcaagcagcatttcagtaggcataggcacacatctgctgatgagtctatcatctcctagtagtgtggggtaaaatttatgtatctgttacaatgcatcagtttagcattattggcccctgaacaactactttttcagtgtagaaaatcaaaacttaagtgttaagaaactcattccatatcacaaacctaagaagtagcagaggtaaggcccaaagcctggtctatttgcttcttagtcagcaacccgcattgtgcacaccagctgtcccagagcttgggaagtaaggagagggtggcagaagggatcaggaagtagtggaatcggcatcaactcctttgtactcttgggggttattggtctcaacatggattcacatgagaacattctaacaaaccaacaacagaattgccattccaacgattatagattctatacacaactctgtacaacagttttgaccgtgacatggatgcatagtatatggttcttgttcttgatcagaatgactcctaattttgtctcccacagcctcctgtctcccaaccatagccttccttcacagaatgctaggcaagattactatcttaattcacttttggttccaaaactcttaaaaaatattagctctggggcttacaaactattagtagtcctaagatattatgttatttgacatgataaaaattaaattgcagttcctagtaaatggctatgacttgatggcagttattttatagcatgacaactgtctgagtgggtctgggagctcagccttatagaagggcagttctttggtgctctttcttcaaattcattcaaacaggagcaacagctgaaactgatccttaaggcagaaaggagcatcccaaagagaagcttgagacacagaagagagatgggcagttctgtgttttctctgccattctcctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctctctctctctctctctctctctctctctctctctctctctgagtgtgtgtgtgtgtgtgtgtgtgagagagagagagagagagagagagagacagagagagagacagagagagagacaggaacccagacagacagacagacagacagacagagaaaagaagaaagaagaagagaaagaagaaagtaatgactgaaggaaagaaggaagggaaaagaaaggacaattttgtcaagctgaaatgcagtctccttccactccccatggtgttcctacagtacctcagtgctgtgactgagccagtgtgaccaagatagcctctctccatctctccatgccccttctcatatctgccaacatgttattcaaagaactggagaaatttggtgttaagtgaatgcctagatcatactgtagattttacagattgtgagcctgctgatctcacacagatttccatcttgaccctagatgtgattcaagcattgtgaagctttccggagacatccagttcatcagacatgagtgccgacagatggagaaatcagtgcaagaacttgcttctgccctagaaaccatttccaagaacttggatgtgaaggtaactggaaagagacaggatttgtagggcattgcaagctactatcagcagtattgtgatagctcatcaaaaggcctacacagaaaagagaaccctttaccttgaaagatttaacatgaagcttattcatatacattattagttcagtcagttgaaccaacaaacattaaatgagtgcctcttgtgtcccagcacaggcttccactgtgagcatgagttgcttccatcactgctgatatttgctcacttgctggcttccttccacactctggagctcaggattatacacaaaagcagttctcctgggagatattattactaaaggcccaacatttgtgtcactgataatgttacatatttgtttaaaccctgtggtgggttagatctttttatacttatacttagatcatagacactgcttctttaatggacctgcctagtacctgggctttcagactcaccctttctgcccagtgatactgagctacctgcaaatcactacttaactagatttgactctttcatgtcctgtcagtgggtgacacattcattttcatttcctaggaaaactgtagttgcagaatgggtttttttcactgatacatgttattatttcagaccctttgagaggcaaatataatgaaggagtcagatgagcaaaagactcattaagggacatctgtgaagaatagtggagagagagctggatgggacagagaaatagaaatctgactcttgtgtcacagacaggaaggaaggactctgtgaggtgccaggaagaacgtgtcatcaagttccatgaatgaaaagtacctatgtgaggagtggcacttctggtgctgggatggagggtgtgggaaggacactcagggtacacccaacactaggttttaagcccagtagttgaggctttgggccaagtatgcctttcatagtagctatcagaggcatatgagacactataattaaaaaaaaatctgtactcaaatagctggaatttgatttcttcatatgcactctgttctatcaatttccacttagcaaagtgcagacacatagccttggcttttcttcttgcatttgaaacatttttaaattccctttggatcacagtgattacttgcttatgcatggatgctgggaaagaatgagccagtgctagttgtttgtgagcatcatgggctggtacatacatctattaaataatcattgtgtgagggttagtgtatgatttaagctgtagtagtatttcttttataagctggtatgctcttgttttgaggacatagatgttaaggactcaaatgtcatcttggcagatttttcacttgatgaatatgttgtgtccttccttatctattttgattagttttggtttgaagtcaattttattatatattaagaaagccacaccagctagcttggggttcatttgcttggaatatccttttccatcactttctccttaggtaatgtctatccttgatgttgaggtgtgtttcttatatgcagccaaaggatgggtcctgttttgcactcattctgttagtttgtgtctatttattggggaattaagaccactgatatcgatatctcattgagtaatgattgttgattttttgtttttttcattggtggtggtggtagtgggtgggtgtgtttatgcttcccttcctttgattttgctgatgtgagattattttctgcatttttgtgggtgtagctaacttacttggtttgtacttgttcttatagcaccttctgtagtaccagatttataaatagatattgtttaaatttgaatttattatagaatatcttattttctccatttatgatgattgaaagttttgcaacacatctgttcacacctttctggattttagnnnnnnnnnnnnnnnnnnnnnnnttttagagtctccattgagaagtcatatataatcctaataggtttgcctttatattttgcctggtcattttcctttatagcttttaatagtcttcctttgttctctatgtttagtgtttttataattctgtgctgaggggactttttttctagtctattgtatctgggtttgtatgtttcttgtacctttataggcacctcattctttaggttaggaaaattctcttctatgattttgttgaaaatattttctaggccatgagattcttctcctctctctattcctatgatttgagcattggtcttttcatagttttccaggtttcctggatggtttatgtaaggagtattttagatttagtattttttgatggttgtagccatttcttctatggtatcttcaatgactgagattctctcttctatctcttgcactttgtggtgaagcttgcctctgtagtccctgttcaaattcctaaaaaaaattcatttccaggattccctcagcttctgttttctttattgcttctctgttgcttttcaggtcttgagcagttttatttgtttccttcggttgtttttgtttttttcctttgcgctctctctctctctctctctctctttaaagagacttattcatttcctccaattgttttcctcgatttctataagggatttattcatttccccattaaggatatttgtcatgtccataaagttggttttaaggtcattgtcctgtgcttcagctatgttagcatattcagggcctgctgtggtgggatatctggactctgatattgctctagctgtaattgttttatgtgtgtgctgacatctaggtatctgggtttgaggtgcttataagtctaggtgttgatttatgggtttgccttggttgtatgatagtttttttgcttggtttctatatcttctatagatttttagagagtgcatttattggctgagtgttgcctgttttacttgtctgctagtctggtatgttcacaagaatggttggtgagggctggagggatacttgctggtgttggaggcgataggaagagtaggcaatggggagatatacaggaggcataggcagggagtgggggaaaagctgctcatggtattctgttccagtgctaggagcaacgatgagagttgtgtatgagataacagaaggatgaggaaggtctgagagcagcctgcctggtgtggcaggtgaatcatatt

SEQ ID NO: 1610 - DNA, 341 bp, Mus musculus
atgcctagcaaccaaacaagtcagctagaagacaggctgagtcaccaggagcgcaccgtagccttcctccttgaacaggccttccgaatcaaggaggacatctctacttgcctccacggaagccaggggtttcgaaaagaagaatctcttgccaggaagttactagaaagccacatacagaccatcaccagcatcgtcaagaaactcaaccaaaacattgagctcctagaagaccaaataagaatccgagaccaggtgaccacaggaactaactttgcagtgcaggatctaaacatcaaacacttacaaggagttggagaccttcggggaagagtagccag

SEQ ID NO: 1611 - protein, 114 aa, Mus musculus
  VARIANT (1)...(114): Xaa = Any Amino Acid
MPSNQTSQLEDRLSHQERTVAFLLEQAFRIKEDISTCLHGSQGFRKEESLARKLLESHIQTITSIVKKLNQNIELLEDQIRIRDQVTTGTNFAVQDLNIKHLQGVGDLRGRVAX

SEQ ID NO: 1612 - DNA, 56098 bp, Homo sapiens
  misc_feature (1)...(56098): n = A,T,C or G
tgagatctgaggaccactggggcattggccctgaagaggagcacagatggttcatctgctgaacaggaggaggcagaatatatggacatgggtgcacgtaggtcacggatagatgtggaggtgggggtggagcttgtcaaaatttccttccgattatttctgtttaattggggaagtaaaacggaaaggtcagcaggtgacagggttgttgatggcagtttgaggtcagaggaaaaggcatgagagtcatctaggcaagtaggagagtgatgaactaaggaaatctgatactataattgccaggaagcattaaggacccacttaaggtttgtggtcataaattttgagaccagtcaacatggttgcatgttttctcccagccatgttctgctgcaaaaatacaggcagagtgagcagacagatggatttagcctgggtttggtttagccaagaaagtttgaggaagcttgagaagcacaggatgatggaagtgtttgaccatataatgtagccctggctgccttgatttagagtcagctgtgggctcacccctctcccctacagagaaatgaagtttcttgagaaaaggagactttcaacattttcttaatgttcccagaacaatcaatgccttaaattaggaggtgctgagaattgttcttcaataaatggttctagaaatcttagagaattccgttgatgctgagttagtggtagaggttcctagaatgagatttgtggtaatgggagacgggccagatccacgcactaggagagaggctggggccgttcagaaatagtgcatggaaactggcctctggctcctttcacaggctggatctttcacggctaaagtacaaagtctttcatttattcatttaacagctattgagtccctgctaagaaacccacctagaaaattcaataaaacagacatggttagacctaagagaacatgagctaagatttattgagtgcttactgtgctctagcccatgttttaacagctttacatatctgattaatttctataatattatattgttacagaatcattaatattgtgctattatcatcatcccattctataggtggaaagcaggattatatcattttgcaagactatccagctggtaagcagcagagaggagagttgaatttggtagtctgttgccagagaacatgtttctaactattttaccacatgatccatattatctccctcaagactagagaaatcagtcactcagcttgaggggaatgaaaatataccctgcctcaaaaataccccattaactgaaatagcaaccctagtctctccactgggttcaaacacagaatggaagagaatggaagtcaaagccctacacttgagtggaattcggtgtgatgcatcccgggaggaatggtacacaagactaagggtcagcaggcctgaggtctactcagtcagagttttactagtttcttcagtgagtcacttgacttctctcaacctccttgtattcttatttgtaaaatcaggatattcacacctgtgcagcctcacctgtaagaatgatgaggtgaaacatgaagaacatcgcctaaatattaagtgctaaacacattagagattactagaaggccagagcagataaaatcagaatagcacaaggaaaggtgaggagccctaagggagacccaaaggacaccctaagagctcttgagacaacaggtaggaggttaggcaaaagtaagaaagaaataaaagagagtcgaggaggacacagcctgccaatgacgactggctgctttggcccatgactagttaaggccggttcaacagaggacacccagggtactggctgtcagtggcccaaatacagttatgtattgctttacaaaggtcaaacaatggacagattctgagaactctgtcaagtgatttcatcattgtgtgaatgtcatagagtgcacttatacaaacctgcatggtatagtctaccaaacacctaggctatatggtatagcctattgcttctaggctacaaacctgtacagcatgtgactgtaccaaatactgaaggcaattgcaacacaaaggtaagtatgtatgtatctaaagatagaaaacgtagagtaaaaatatggtataaaagataaaaaatgacctacctgtgtagggcacatatcatgaatggagcttgcaggactggaagttgctctgggtgagtcagtgtatgagtgatgagtgagatgagtgaatgtgaaggcctaggactttactgtaccctacagtaggctttataaacactgtacacttaggctatattacatttatttaaaacctttgctttctgtaataataaattaaccttagcttactataattttttacttaacattttaagttttaactctcttgtaataacacatagcttaaaacacaaatacattatagagctgtacaaaaaatttttcatcctttatatcctagcttttttctatttttaaaattttatgttttctaatttttaaacatttttgttaaaagctaagacacacacacattagcctaggcctatactgtcttccatttcttgtcccaaaatattttgttgagaaattttgcatttatgtgcatcacgcatacaacaagccaaatacaatgacatgccaaaaagatcatatgccatgatcaagtgggatgtatcctagggatgcatagatggttcaccatatgcaagtcaatacatgtaatacatcatatcaaaagaatgcagaaaaatatgacatgatcatcataatgtattcataaaaaacttttgacaaaattcaacattgcttcataatagaaactctcaacaaactggcatagaaggaacataccttcacactctaaagaccacatatgacaaactcacagctaacattatatgctattgcccctgaagattttccagtgggacaagagatggaagacagtaatactgatgatattggccctgtgtaggcctaggctaatgtgtatgttagtcttagtttttaacaaaagtgtttaaaaattagaaaaaatgcagttaagttgaaagccgtttttctaagaattggaacaagacaaggatgcccacttccaccactcctattcaacataatactgaaagctttagccacagcaattaggcaagagaaagaaataaagtgtatccaaattggcaaagaggaagtcaaattgttcctctttgaggatgacatgattttatatttagaaaaacctagactccacaaaaaaactcttagacttaataaataaattcagtaaatttgcagaatacaaaatcaacatacaaaaatcagtagcatttctatatatcaataatgaactagctgaaaaagatataaaatagctaacaaaaaaatcaaatgtctaggaataaatttaaccagaaaggtgaaagacatctacgctgaaaactataaaacactgatgaaagaaattgaagaggatacaaacaaatgaaaagacagtcaatgctcatggcttggaataattaatgttcttaaaacgaccacattacccaaagcaatctacagattcaatgcattctctgtcaaattactaataacattcttcacagaaatagaaaaaaaaaaaactcctaaaatttggaaccacaaaagaccctgaatagccaaagcaatcctgagcaaaaagaacaaagctggggacactacagtatctgacttcaaaatatactacaaagctatagtagctaaaataacatggtattggtataaaaacagacacataagccaatggaacaaaaataaattcacacatttacagccagctgattattgacaaaggtgccaagcacaatataatggtaaaaggatactctcttcaataaatggtgctgggaaaatggaatatccatatgcagaagaacaaaactagaacactatccatcactatatttaaaaatctactcaaaacaagttaaagacttaaatgtaagacttgaaagtataaaactactagaagaaaacataggggaaacacttcaggacattaggcaaagattttaaagacttcaaaagcacaggcaatggaaacaaaaatagacaaataggactatatttaactcaaaaacttcttcacagcaaagaaaactatcaaagggtaaaaagacaactattagaatgagaaaatatattggcaaattattcatctgacaagggattaatatccagaacatataaggaactcaaacagctcaacagcagcaaatcatctgactaaaaagtaggcaaagcgccgggtgcagtggctcatacctgtaatctcaatactttgggaggccgaggcaggcagatcacccaaggtcaagagttcaagactagcctagccaatatggtgaaaccccatctctaccaaaaatacaaaaattagccaggcgtggtggcacacgcctgtacttccagctactagggaggctgaggcaggagaatcacttgaacgcaggatgcagaggttgcagtgaactgagatcacaccactgcactccagcctaggcaacagaatgaaactccatgccaaaaaaaaaaaaaaaaaaaaaaagacatttctcaaaagaagacatacaaatggccaaaagaaatatgaaaaaatgctcaaatgctcaacatcactaatcataagggaaatacaaattaaaaccacaatgagataccacctcaccccagttaggatgcctattatcaaaaagacaaaagttaacaaatgctggtgaggatgcagagaaaagagagcacttatgcactgttggtgggcatgtgaatgagtacagtcaatatggaaatcactgtagaggcttctcaaaaaactaaacatagaactaacatatgatccagcagtcccactactggaaaggaaatcagtatatcaaagggacacctagattcccatgtttgttgcagtgctattcacaatagctaagatatggtttcaacctaaatgtccatcaatagatgaatggataaagaaaatgtggtttatatacccaatggaatactatttagctatacaaaggaatgaaatcctgtcatttgcagcaatgtggatgaggctggaggacattatgttaagcaaaataagccaaaaacagaaagataaatactgcatgttgttacttacatgtggcagaaaaaaaaaattgagttcatggaaataaagaatagaaacgtgaggctgggaagggtaaggggaggagagaatgaggagagtgtgttaatgaaaacaaaattacagctagataggagaaatggattctgatgttctgcagcactgtagggtgaaaatggtgaactataatttactgtatattttcaaaaagctggaagagaggattttgaatattcacaacacaaaaaaatgataaatgattgaggtgatgatatgctaattaccctgatttggttgttacacattgtatacgtgtatctaaatatcactctgtagcccataaatatgtacagttatgtgtcaactaaaaattttaaaaaatgataacaagtatactgtagtaaatacataaaccagtaacatagttgtttatgatcattagcaactattatgtactgtacagcattgcatgtgctatacctttatacaactggcagttcagcaagtttgtttacaccagtatcaccacaaacacatgagtaatgcattgcactgcaatgttatgatggctacaacatcactagataataggaatttttccactccactaaaatcttatgggaccaccatcatatatgcagttggtcattgacagtgcctcactgtacactccttgtgtgagttaaaaataggtgccgctttctcaaaaccctttacttccatgtcagaaaattatcctgactttctttggtaaaatgagatattttcttgatatatgcctgaaaaattactgtaacaaatatgaaaatctacagtgttaccatgagtgccccagagggttgtgtagtgcacaacacatagcgtttctgtctgatgaccttcaacactgactatcccccatcactgaccaccatgtcaggattatgtctttagatctatattaaatatactatagtataaggccactttaaagattgaaattgaacatttttaatttctgtgcttttattagccctagattagaaaagatatatgaagattattgacttctgagaaggattttacatatgcattttagacaagtgggaagctatttgagtccatcttcttctgctataacagaataccatagtctggggcctggaatggtggctcacaccggtaatcccagcactttgggaggctgagatgggtggatcacttgaggtcaggagtttgagaccagcctggccaacatggtgaaactccgtctccactaaaaatacaaaaattagtcagatatggcagtgcacacctgtagtcccagctactcaggaggctaaggcatgagaattgcttgaactttggaggcagaggttgcagtgagccaagatcgcaccactgcactccaggctgggcaacagagcaagactctgtctaaaaaaagaataccatagtctgggcatttatttggctcatggttccagaggctgggaagtccaagattgagaggatacatctttatattacatcataacatagcaagaagggaaataagaatgcaagacagaaagagagaaactaagccaaactcatcctttctatcaggagcccactcctatgataactaactcattcccacaataagggctttaattcattcattaggagagagccctcatgacctaatcacttcttaaagcctccacttcctaatactattagaatggcaataggccaggcacggtggctcacgcctgtaatcccagcactttgggaggccgaggtgggcagatcacgaggtcaggaaatcgagaccatcctggctaacacgatgaaaccctgtctctactaaaaatacaaaaaattagccgagtgtggtggtgggcacctgtagtcccagctatttgggaggctgaggcaggagaatggcatgaatctgggaggccaagcttacagtgagccaagatcgcactattgcactccagcctgggtgacagtgcaagactacaactcaaaaaaaaaaaaaaaagaatggcaattacatttcaacatgagttttggtggagagattcaaaccagagcagacattaataatatacatatatattatgtgcattgttatgttaaaattgaatagccatttatgtttagagaacaaacctaccaaaattgtccattttagtagggcccatttttctaaccaaataccatggattaaaagctgaatttaagaagagaaagaatcttaaaaagttgttaagcaaggttaaatctagtttttctttctcacacagactctgcttgtgactgtttcttggataattggcaccttgtgaaataatcgctaataatagttatcttttagtggattcctggcaccgccctcagctgagcgctgtaagtatattattacatttaatcctctcaaccatcttatgggatcgatattattagctcatttcacagaggagaaagttgaggcttaaagaggtgatgtaattttgtccaaactgaacagctggtaggttgaggagtcagggttccaatccactctctcagaatctgtagccacctgctcttagtcactgctgtgtgtcagtctcccttggcactagatacaatggtgattagggtagcataatgagccttttggactgcttgcaaaccatgaactactgcatctttgagttttaagggcttagcttaggactaggggatatgcatggaagcccaaatcataggtgtcctttatctgtgggatcaaagtttgtcactcagcatcctgaacattgtgtgcctttaaacaaggcaaatctgataccataatttggacaacaacttagccaaagcatcatttctgtatatggaggccaagtagtactaacaaacatgcaaattctaattttaaaactcagacaaacattttacagctaaaacaatccacccccttttggctaaataactgaacaaaatttcccctacaaaggcaaagttcaatattttcatttctgtaaaactctgacccatgtcacttttcatcagtgctgcactatctgtgaagtccccttctaacctagaagagttagcttcctccctaacatacttggagaaagatttgggcataccgcagcatttcatttcctctttgtctagcttgatgataactcgtcacttttcaaactgtgaagatgaaatcaggagaagagtgtgaaatatcagtataacaatggtcacttcccaccccatgagacaaagaagtgaaaggcttagtgatttgtatgatgatgagcactacagaaaacattcaaagcttctaaatcccagggatttcctgacttcagttgtgagggccagccacactgacatcatagatccttcctgcagtcacaatgctactaagtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcaggtacttatggactattcgaggtctctaaatttctcctacttcactatctttcttctgtttcttattacatataaacaaaataatgaatcccaatgaagaccctcagaaggcttgggcacaacagagtaataacttaaacaaatgtacaagaaaaaaaaaccccatcaaaaagtgggcaaaggatgtgaacagacacttctcaaaagaagacatttatgcagccaaaacatacgagaaaaagctcatcatcacttgtcattacagaaatgcaaatcaaaactacaatgagataccatctcatgccagttagaatagtaaccattaaaaagtcaggaaacaacagatgctggggaggatgtggagaaataggaacgcttttatactgttggtgggagtgtaaattagttcaaccatgtggaagacagtgaggtgattcctcaaggatctagaactagaaataccatttgatccagcaatcccattaatgggtatatacccaaaggactataaatcattctactataaagacacatgcacacgtatgtttattgcagcactgttcacaatagcaaagacttggaaccaacccaaatgcccatcaatgatagactggataaagaaaatgccgcacatatacaccatggaatactatgcagccataaaaaaggatgagttcatgtccctttgcagggacatggatgaagctggaaaccatcattctcagcaaactaacacaggaacggaaaaccaaacaccacatgttctcactcacaagtgggagttgaacaatgagaacacatggacacagggaggggaacatcacacactggggcctgttgggggttgggggctagaggagggatagtattaggagaaatacctaatgtagatgatgggctgatgggtgcagcaaaccaccatggcacgtgtatacctacgtaacaaacctgcgtgttctgcacgtgtatcccaggacttaaagtataatttaaaaaaaatacattcctgattattttagagctgtctgatcctaaaaaagtttctaaaggtcttatagaagtatctgtaaagaaatgctcttctagctaactatagatgttatggggggatgggggagaattgggataagtgaggagaggggaaatgtaaagcaaattgaaagcctccctttaagccaagctatatgtacagaaactgccctcaattaaaaaaaaattagcagcactgcaaaaattcacttgtcatagttcctgacctgattcagcattctggttacctagatacaaatgtaaacaaaagtgcctctccaactgcgactgcagaggaacagccagttgaacctgatggcccccttcctggctcagacaataaccaagaaaagaaagcaagtacttttcaatattcacattaaaattagaatactttgctcagcttctttaaagtttagagtgcttagagagtttaagaagttctggaagaatagttctcccacatttcctgtttgttctgtcttggcaaaatggctgctgaaaacacaagctgaaaagaaaaatgacctcaatttacaatttcattaattagactgatttttaatatatggggctaaaattcttttaagttgatcattatgtatgttttatgatgattcaaaaggaaccatgataaactcaaggtgcagactttatctttatctctaacatgaaaaccggtatagctaaatagaatgtttcctttattagaacttgtcgtatcttctccgttaaaaagaacattttttaaagcagtgtttttagactttttttgcacttctcttaacaccttgtaatttacataacaagaggcagatgcagtcacttgttacataaagcactagcacaatatcaaacattgatttttggtatgtattatataataggctgtaccacatactagctgtgggactttggaatgattacttaacctctctgtttcttcttctgtaaaatgggtgaattaggcttatcatacaaagttattgtgggtttgaatgagtcacttaagtaagtgcttagcaagtaggaagggctacagtatgattatcatcatcatctacatgatcttgggcaagtcccgtacttctctgatcctgaagctcctcacctataaaaaatagtcatcttaatttctttccataataagggtttcagcttcttaaggtaactaatgtcatccttacactaatgggaaggtaatgatatccactttatagggcattcatgtcaaataaaattatgtcatatacaagaacgtatttcatagcccataaaaccaaaaagctataacattcaaagcattattatgaaatggataaaactgatatatgtaaaaaaattcccatagtggccatcaagttgtttgtgagacagtttttatatataataacatcctagcttataggaatgaggataaaacagaactgactcttatgttcaattagcaaagatataaaaatttaaatactgtcttagatacctaaaaattacatttaaaaaattgcaccaaaagccaacatcaatggcttttgttctaggtagcaaaattacaagcgagaatttttattctgtatctttaacttttctatacttttccaaatattcctccattgttatgcttaacatttgtcacttaaatagtgtgtgttgtaggtgtgtttttaagaagatgctacttgtggtctttcaagtaagacttaaaaattaataaaataaaaataaaacatagatctaattgttacacttcagaaggagaaaggaggacaagttagtgcccttggacactgtattcatcatacactttaattccacaaatacttggagaggactactctccaaacatataaggagggaccaaccggttgctgaggaaatgccaaaaatagatccccacacagaccagagggagcagtggaaaggtgaggaggaaagaactggcaatgaagtaggtgaggtctcaggactcagtactgtttcagtgggaaacaggagtgaaaacactctccacggcagaaggcatcaggtcctctgacttaggaaagtttccataacgtggccacctgagtgcccagtgaatcagtagatccattctctaggggaagacgtggcttaacagcattagacccattgcagaccccattcagcaatgcggggagggtacaagctctctcctgggggttcacaggctccctcgtgagcagcctcgagccttttctgcctgcccaccaccaacagggctgggtcaggagagactttgtcaggcgttctttacagcatccctgaaaatggacttcacatttttttaaggttttttgaaggagtgaggtatccagttaagtttcttaaaacttaagaagtagtaattccttgggcatttgaaaaaggaatgctttctgtatgtgagtcttaacatattctgcccaccattatagtacacagtaacataaagcaagaaaaaatatcctaggaatatattttgttaaagtttttaactgaggtggaataccactcatattctccatattgaatccagttcaccaataggctattaaaattaggataaatctgtcttgtttttttaaacttaaaagaacattagaatttaaggcattttcggctgggcgctgtggctcacgcctgtaatcccagcacttcgggaggctgaggcaggcggatcacaaggtcaggagatcgagaccatcctggctaacatggtaaaaccccatctctactaaaaatacaaaaaaaaatttagccaggcgtggtggcgggcgcctgtcgtcccagctacgcaggaggctgaggcaggagactggtgtgaacccgggaggcggagcttgcagtgagtggagattgcgccactgcactccagcctgggcgacagagcgagaccccgtctcaaaaaaaaaaaaaaaaaaagaatttaaggcatttttgagatatgaaaaacagtgagtacattgggtatcttctttcctgtcataaaaatgctgcaaattatcaactttcatgaaaatagaactttctagtagtaccattttattgaattagaagttgccagttaagtgtacatatggccagctatacttaatgttggtaaatcatgtgtatgactgctctggctataataatctgacatccaggtacttggataggctagttttctagttcggggctttgtgtttgaaaattagctgtttctccttagaaatcagcatgtcaggaatcatccactctgtgaagacttctttagtaactcagtcaataatcattagatatttcattttaaaattatctaagaataatctatggctttgacttttccaaaaaggttttcttgactgtgataccaaatctatgaaatacagctctctagtatctccacagaacttaattttgtttttagtcattagcaatacaaaggggacatgtgtaagattaactgagctgattatctggtctatggtatacattttgtttaaaattaaaactctttaaagataaactgcatagaagtaatctgtaaagaagcagatgatatattctgaatctgtaacctttgttttaggtaagattatctccagccaaaatgtcaaccaagaattctacagatctagttgaatatgttgacaagtaagtgtgtaaattacaactagttttaactattaactgcatttattgtgacaaatctcacacgcaaaaaagaaaaaatcctgtgtttaattattcagtcagagatgaatgtacctgaatgaaacctttaagttctctgcattcagaagagattaaatcatgtcagaaagacaaacctgatcctgttcctttctgattgacagaacaagcagatttaactaccttttctttaaatgacctccataggttcctgtagatttatgtgaaaagcaatacaacatattgcatattgcaacaatatcagatatagctaactattgacttcaaaataaaccaagtaaagctgttaacatttcatgataaaaactcaggaaattttgagatatatttcactaatcactagaagatgttgtttctgctatttacagtgccatacctggagctcccccaggaaaggtgtaccacagagggacaactccaggcacttggaaatagagtaacacactgttaacacatgcacattgtccaaaatacccaaggatgccagtgatgaaggtggcattgcaaaggcaatgcatattaatttgagttgttttctattccatatgtcaaagcaggatttggtctaatgctgtcattcatgttttcagggcactggggatttagtgtcagtccttctactactttgctgtgtaacaccagtcagttccataatgtctctgggctttagttttttcatttgaaaaacaaagaggttggactagaaactactgcagctttaaaataattctgattttaataatcatgaccacagaagaaaaaaatagccaaatgaatgaaatgagttcatgtgaagagaaaaatctaaatacacctggaacttcgattttttaaaaattatctttaacaattaagatgataagatttcttcactaatttttactgcatttttttcacaagaattcccctgtcccttggccagttaaatttaatacattccaaatagttcaatcacagtatgttagcgttagccccttttttcatgttccacataacttgtatttgtttatatgactatgagtctatgatttagaaaaaaataaaactaagcatgggaaaaatatttttaaatgtttaaaaaatgcaatatttggacagatgacttttcttctgagttaaggacaatgaatgtagtatgcacaaaaataattattataaataaatgtattagctaaccttatcttccaaggagaaaagggaaacttgtccccacctgactctctacatgacaaatggaaaataaaaatcattcttctgatccgtcaaattctattacaaacctgtgtggatttctttagctcaagctggtgatgtacatcccaggagatgagaaaataaattcctggaaaatggtaacaaacttaagcagcagaagataaactttttggatttctttggctttcagataaattaaaatgaagacaaagaggaagaaatagtctataatgcaaagcaaaagcatgataaagattacttcactccaacatttatttctaccttaatctctcccttaccccttctcttactatctaaaccatatatctggaactttctatttatgatttcacattgttaattgtcttttggtctctctcttcgcatctctcagaacaggctgcaaactccctaaaggaaggcactctatggccttatgatttttgatatccctccagtagcctatcatgatgtactgaatacacttgatgaactgtagttgacagatttaatggaaagtaatggtagaacaattgaattgttatagctttgcttaaatcagctgattaactggaaaagcaaaatggcatttgggcatttcagtaataagtgcagacattttgaattgacatattcaatccaataaaataaaaataaagaacaatggtttttaaaataacttcactggccaggcacagtggctcacatctataatcccagcactttgggaggcagaggtgggcagatcacctgatgtcaggagttgaagaccagcctagccaacatggtgaaaccccatctctactaaatatacaaaaattagccgggcatggtggcgtgcacctgtaatcccagctactcgagaggctgaggcaggagaatcacttgaacccgggaggtggaggttgcagtgaatggagagtgtaccactgcactcctgcctgggtcacagagtgaaactcaatctctaaataaataaataaataaataaataaataaataaataaaaaacttcagccttcaactcatagttttcattgggtgacaacaaatggattgacatgcaaacagagtacttaagtaaaagtcattatcaactcattaaatggcctgagtttatattacaggttttcagaggtttggccttaaaacctatatgggtatatttacaggtaatactatgagcaaagaataacaactcaaaaagtaaaaatccagtccctcagggagctatctaataatgcgtttggagccattctagcaggaaggagagaaatgaattattagatagctggccggggtaggcctcattaagaatctgacatttgagaaaagaccaggaagtgaggaatttgtccatatggacatctaggggaagagcaaagtttcgaaggcaggaatattcttacggtgtagcaggaacagaaagggggcaaggatggctagggtgaaaaggagggaaatacaaattggaactatgatagcatctgggattctatttgaaagtctctggagaaaatgaatcctgagtttctgctgcccatgaggcaaattccaactttcctgaacaaaaaggaggccaaggaactgaggatttttactgagttttccaggctgggctatagccaatatataactcaggaattctctcaagagtacattttgtgaagatgagggtctggctgacagccaaagaatgatatttaaaatctggatacataaaactttcagcaagtcaaatgggcaaaataataaatgattaatgacttcccctcatgagtagaatatggaattcagggtctgaaagtattcattttcaaggtttttcttagcaccatggcagacactttattattccgtgatgcattgcttttgttactacatggtgaagagagatatttcacattacaatgcatgagaaaggaagacaaaactctgttggttgaactttctatggatagatcatgttaggttggatggtgctactatcagccacagtgcagtcttttggtctttctctttcttcttttcatgcccccccccacccacctgtgatgggcaaggctctgctgagagtgggcacagtcacagggattgggcattacccatagggacccccaattagtaagggaaggggctgcccaaatgatgatcagtccctcctaagaggctgtctggattcttgtcacatttaagaccttctgctcaagcgtgagaactccactgaggtcaggctgatgctgatctcagttctctagagcacagagggagcccccaccaacctctgggcctctgagaagacccttaggactccgaggagagatgggagccaggcaggaaaggtgacttggtgaaaaattacatgatgttggcagcaagttacatatgaagaagcagagggaaagacacacctttctcctctgagaaaagtgcaaatgtaacaggaagagccactaactggcctaagcaaagctgctgtgatgtaggagaaagaggagaggctaactaaaatgtttcgctgctgagtgactcatagcctccatgcctcagtttcctcctaagtagagacaaattttactcatgccacagggtagtggtgggaatgcaatgaaaatgatacattgactataagcactaaatagaaataagatagtgttataataaattccttacatttctcctgggctaggagctccctaccacaaactgcgtggctttaaacaatagaaatgtattacctcacaattctggaggttggaggtctgaaatcaaagtgccagcaggactggttccttctgagggctccaaggggaacctgttccttgtctcctgcctagcttttggtgacttttgggagtccctggcactccttggcttgtagatgtgtcagtccaatctctgcctccatctttacatggtatctccctgtgtttctgtcttcctacagccaccttcacatacatacatacatacatacatacatacatacacacacacacacacatacatacatacaggcatcttcacatcgacaccagccatgctggattaggggcccactctactccagtaggacctcaccttaactaattatatctgcaagacccaatttccaaataaggtcacatactgaggtattaagctttaagacttcactgtttcttttggggggacacaattcaacccataacaatatttaataattataaattattgtaagaacacatatatacaacattgtacaagacatatttacaagacattgcagagtatttcaggtacacatcctttaacttgatctcgtcagccaggtgggagggtcaggagtccctctctccacagaacagagagggagccctcttccgggcaacctcagagaggttgaagttagcttgtgacagagatagaacttgaacccaagtcttctgactccaagtacagcgttctttcccctggagactcacattaaacactccccacccccacccccaaagaccaaagtaatatgggaaggtatctcaagagggccacaaatgctacaggaactcccaacatcatcaaaacaatttgctactgcagtttgcatatgcttcacctgtaagtatgacccagacatccaccctgccctcactgatacagggactctgtttggaacctttgtcaaccttgatgcctccacatgaaggaaaaccaatcgtaccaggcacatcactcattttgcaatcttactaaaaattttgctgaacatgaggagtctgccttatagagcgcatcacttttcactggaaaagaatcacaaccagttctttctccagtctcttctggaccgtgccactatatggagttctttttgggcccttcctgatgctctgtgctggcccagccctgttggcctggtgtacttccttctgcactgggcccaccagaactcaaattgcctgcctcaccccccagagcattcagccctacctaaaactcagcagtggaagtctctccagctacaaacatccacttgccagggtggttataaacaagcaacacagaaactatagaaaatgttttttctatttcatcactccccacacacactcatagattatttttgtgaggcatcaaaatattctctgagatttcacttcaggttttttttttgtaggactctctgcactcagaccgtaactagtcatatattagatctcataaaaatgtagaaatctttcttcggtatgcctttttgtgttctagaaaaaggtttaaattttcaagtttgattctctgagtattacaggttgccaaaatggttaccagaatctccccagtaaatttagggctctattcacaagaacagaacaggcagggaagtgagaggctccatgtaccggctgatctgccagctacagcacagctggtgtaagtcacaccgaattacagaaaaatagaactcagagtttgtggaaaatctgttcagattcagttgtcagctacataatcaatgatctatgtgaagcccaaatatctctctgaaaaggccccctaggaatttttcctcctgtggttggtgactccatctgcactagtctggaatatccagttatttctttcctttcatagttaaatttagatctaggtcccactgacatacataacatactaagaaagcagtgaggttcttaaatttacatcttactactagggaaagccctcagtttttatcccttaggaatacctaatgatttgaataatggcctcgtcaggaatctctcttagaaaattgagacatgctcatgtgtttgttcttccatggttgatttagaaaggtcaattggaaaacaatattctctgtccttgtggcaatgcaaatagggaaaaaatataagctgtctgttgatcttcaggaaccatgtaaataaaaccaaacagagccatcatttggtgcttcattaaaccttaagaattagcaataataataagactacagttaatagtaaatcccaggcctgaaaaggaatttcaaaaaggaaagctctccacttaaacataaaataaattttaaaaataatctttaaaaatttaggagaagaaataactacagtccagcatttgcatcccacttaatgtctccatggttgcaggcaaatagctttgcatagcagtaggtgataccctcctaaaagtcttccttcgatgggccaaatagccacagcattgaaatcagccctgacagacaagaccacagacctgctggcttgggtctgccctcgcattgctctctctggatataatcttgacattagccaatagcacctcacccgcaagagtgaggccctgggaccctcttaacctcagacatacaggtgtgtggcattggtttcaccaccctctctactgcatgcatctcacttattgtctcagaacttacaaccacacagcaaaataggccttgttggccctgtttacagatgaagcaattagaacactcggttggtaagtggtggagcctgtgttctaccctcagtctaccttgctttccaacctgccaagctgcttctggatgtctacagaacttgagagctcatattccatagttcactactttagcacttcattatatatcctgccttatattattcgctgattcacatgaccagtcttgaacaaatcagtggtgtttagtctttaggatacattagaatcacctatgcgcttgcttaaaatgcatattcttactctccccgcctaccctaaaattttgattcagtaggtttgtgttggagtggagtaatctgtattttaacagcttccctccctcaccctcccctgtgataccaattcaagtataagaaatactgaattaacttaagttccttgaggaacagagccattatatgtaaatatgtagtattacaggtatggactagagtaaatgtgtgtatggactagagtaaatattgtatatgaactagagtaaatatttagtaagtacttaatgtatctttatttgaaatgacatttttattggtaagtgactagatacagacacaatgctttcagctgcacataatagaagcactaaccaaaaatggtttaaatgtagaaatactgattagctcatataacaaaaaaaatccagagtttggtaaatttagtagcttcagaacatcattaagcagccaggtggttttttttattctttctctctgccatttcctttttcctcatgatcacaagatgcctttggtagttccaagcatcatgcacagacaggacaacattcagcgaagaagagggaagtttcttctgtgtatcccttcttgaaggcaaagacactttatccagaagccccatagcaggtttctctttgcatctcatgggccagaattgcttcacatgctcttaccataaccaattgcatctcaacccagaagaatggaatctttatgattagtttgcccctcagaaggacatgggggacaggaaggatgaatcaagtcaggcagaagttgggggtggctgttgggagggtaaccaatggtatctgccatactgagaacatctaggagaaaacaatttctaaatttggggggaaatgaagcataatttataagtgtctgtacaagactgaaaaccgggagaccaaatacctttgctggcaaatctgggatatagattgtctagaggccacaaagcagcactggctcaaagaaaataatgagcaaatctgcagtccaccactaggctatgtgtcaccttcagcagagcctggcatcttcttcccttctgcctctgactcatacatccaatccagggtagcactgacagcatggtgggggttttaggggaatggattttatatatggtaggtaccatttggtgattttccaaaagaacatttttgaaccaaatgagtggtaaatgcaatctgactcacaaaaccccttggcaaagttttctttgcacctcagatttccaggtgatagaaaagaagaatctctctgagtgtgcgagtgtgtgtgcacatgttacaaaaactaccatgttaatgaaatattcaatttgaaaaaaaaaaaagaaaagaagaatctcacccaggctgagactattttatattgctcaagagagtaaactatgtcttgaggctccaacaagctgtgactttatggagccacttttttttggtccagttttccaacaactgagccttaagggaacagtccaggtagagaaatcagtctgtcaatcaacaaatatttattgactgcctactatgtgccacacattcttctcaatgttgggggactgtgcagaacatgctagaaaagtgcctcacatagggagctctcattctagtgatggaggatagacaataaacagaaacaagtaaataagataattttagataatgacaaatgctttctagaagataaaatggggtattatgagagaaggcctatgtggttgaatgagataaatggagggaagaatgggaggaaatgaggttagaaaggagagataagattttattctgagagaatggataagccataggaaggttttaagtagtcaagggctaccatttacactttagaaagaccactctagctgctgtatggaggatgtgctatttgttaggaggaaaagtggaaaagataatggtggccaggatcaagaaaggaagaaagaactaaaataactgtgggtttggagcctaagaatactgctgggtgttatttctgcagctaccctattaggtcacatgactagcattaatgtccccctgcttattgttggaatgatgagaaaatgtgggagctaatgttaacatttgattttggaatctgtgagtttcaaatcgtgaccctgaatctccaagttgtgtgaccattccttgttctgtctggtaaatttcctcagtctggtcttctaaatcactaattcattctttagctattttttctgttatatttatcctaccttttattttttatttcaattatattttccatacctaatggttctacttactttttacgttttctagtttttcttattttactaatatcttctgttgtcttctctcttaatatgtttaatagccttttagaaatttattgtgtacattttaatatttctcttctgtgggaatctgtaatctactaggttgtttatttgtaggttaattacttttaaaaaggctgtgctcctcaaaagtcctgttaatctggcctttgaactcatttcccctgggcatttcagccagatcctggtctccaatggagccttgtcagctccagtgagtccaggggtggggtgtggatgagccccaggcaccagaaaaccactccctattccacaaaataacttctcctgtcaggtcttcaccttttgctccccaggaagaagcaggtttaggagaacacttgctttcccaccctgtggacatttagaagtgaaacaaggtggcagcaactccccaaagtcaattgttccccaagtttcttgttattgttactgctccaattccttaccaacacagtccctctgccctgcctaatctttctttagaggacacctagaatagtttgacatttcaaggagtcagaacaactggtcccaaggaaatagagaagaagagcagacttatgttgttccctttccctattttatcttcccacagccctcccaagctgtctcttgtcccaggccaacgcagccatctgattcaggttgggttgcccagggaacagactctgagatggagattggcgaatagaaggcttattacagagcacactgggatcaacacctgtggaagggaagggaaaggaatggaactgaacagaaggaatagttgaactatatgaagtgagttgagccaactaacttcaattagttatatatggattttatatatattaggtaccatggctccaacagttgagccaaagaagacttcaaccaacttcacaggaagctctggagctgggacagcccttcaaagttgtccagagttagaccaagcatgccaggcctttatacccacacactgtccaatcactgaataaagctgccccagaaagtgggcatgaccttgacaaggcagttctcagagaaagctaacagctgaagtctgccagctggcagcactcccaacagttggggggtataagtccttccttcctgaacggggagctgggtggcacatcacggcatccacagcaccacccacacacgcaccagtttaaaatagcccccaccaccccaggggtttttcactttctccaagtccttcaggattttgtaagggagacaggatgggaagccacatttattcaacatttttgtcaaaaccatagtcagcccgggattttttttaacctctgaataactgtctaactcatttcctttctttctgcactttgtctcacatgagctgtcatatccctctggggccgatttactttagctcccatgttctcactaactctcaattctgtattgcttgctgaaagctttattttcccaggaggctgaagctgaatgagtcctctgaagacccagccagagccaagtagaggtgtgctggctctgcagagacaacaggacccctgggcatgggggatggcaatattttccatgggaccaaagtctgctctgtgagtcccacagaatcccccatcatttctcaggtcctaggcccccaccccaccagacagttgaagtatgtgggatggggtaggagccaaggtgagcagtggtggtgcaactcttccttttgaaagctacctgagtgattccaaaaatgcctgttctcttttacacacacacacacacacacacacacacgcacatctgccagctcaggcaatctcattttcttcacctaagtcttcaaccaccattgaaagctacctgagtgattccaaaaatgcctgttctcttttacacacacacacacacacgcacacacacacacgcgtgcgcgcacacaaacacacacgcacacctgccagctcaggcaatctcattttcttcacctaagtcttcaaccaccatttacttctctgataacatccaaatctctgtcttcagacacatttcagactgttcaaggggcatctctagagagatgccatatactaaatcccaaatttgttttcttcccccaaaacctaactgttttttgtctgaattttcagtgttgatgaaaagtggcatcatacattaagctcaaatccaaaacatcagaatctctccctccttcaggctcatttccaatctatctcaaagttctacaacttctaggtttataatatctgcaacatgtattctccttctttatgtccaagatcaccatctgagtctcagaccttcctcattttttcatgtagattactgtccatgttagttatccattgctgtgtagcaaagtatctcaaaactcagcggcataaaacagcgaatatttatctcacagtttctcaggatcaggaattctaggatagttcactcatatagctcttggtcgacaccccagactcttgctggctgttgtcaggagttttcagttcctcaccatgtggacctctccacagggctattcaatatggcagttggcttcccccaaaatgagagagagagagagagagagagagagagagaggagggaaggagggaggaagagagagaaagagaagaatctgattatcatagggtgaggagcaaaccacacatattgaaaggcacaacaaaactagcttgcttcttcaagaaactgatcagtgaagggaaggagtaatatattaaggccaagagagggtatcaggatttttaagtttctttgcctgtacatgaaatagccctggcctttgtcttctcccatttctaatttactttgtttacttttcgttgaacttctgactcttttgctcatctttgcctttaatctgtgatttctttcatctgttagtaggcagccctctcctcaacatagaattatcaggtattacatttgtatggacccggaaatcatccaacttggtttgttagaatagtgggtaaattgagcaggaagcacattccagggatgatttggaggcagagtttggaggggacctcttctctgcatgtaatgtagtatgaacttcagactgcttaggcttgaatactggtccactgttgttagctgggtaaactcggacaaaagttattcaatctttctaagcctcagttttattatcgttaaaaacagggtaatattaatagaccctccatggtgttatcatgaagattcaatagatgactcatttaaagtgctagccacaaggtctggcttgtattaaatgctcaaagatactagctataactatttataaagtgcaggagtagtgtatggacacggtggtaatgtttttgactgctcagtgacgttttcttccctctttctgattctcaggttctagaattatgttatcccaaacagtagccactggccacatgtgcctgttgagcacttgaaatgtggctagtccaaattgagaagttgtgctataagtgtataatacacactggacttcaaagacttatctttaaaaagaatgtaaaatattccattaaaaagttcacattgattacatgttacaatgacattttagatataacggtttaaataaattatattgttaaaattaacattatcagtttttgttttgttttattttgttttctgagatggagtctcgctctgtcgcccaggctggagtgcggtacctcaatctcggctcactgcaacctccaccttgcgggttcaagtgattcttgtgcctctgcctcccgagcgtctgggactacaagcgtgtgccaccacatccggctaacttttctatttttagtagagatggggtttcaccatgttggccaggctggtttcaaattcctgacctcaagtgatctgcccacctcagcctcccaaactgctgggattacaggtgtgagccaccacgcctggcctgtcatcagtttttaaagaatttttctttttttttttttttttttttttgagacggagtctcgctctgtcgcccaggctggagtgcagtggcgggatctcggctcactgcaagctccgcctcccgggttcacgccattctcctgcctcagcctcccaagtagctgggaaaagaatttttcttaatgtggctattagaaagtttaaaattgtctataaggtttacattatatttcttttgagcagttttataaagatgaaattacagagctactaaattaaaaagaagtaatatatttctatattttatttacctgcatagcatgagcccctcttcttcctttataagccaaccagattctgctgaccttcactgggcagttgaagcctcgccatccacacacactgatccttgtgagcaaccatccatcactagggtaataaaattatatctgtggccaaactttagccagcttctggcattgcccaaaaaaacttagctacagattaatcctcagaaagcaaacaaccaacagggaagaaacaaacttcttattttttaaattcctttggcagagatacttgatatcaaattggaggtaaaaaggaggaaaattgcatatggcaaataccaccagtagtcaatccagtagacgttttctccttcctctttgctaataaaagtcccaattttgtttaaggctacaaacaaaacaaaataaggtataagaggtggctatatgacatagcttcagccaatgaaatatagacaaaagtgtcatagtgagtcttttagaaaggctatctcgatttaaaaaaggacgggtggggacaaactcaacagatgcacacattttattttactttttgccttctgtcttttctatcgggaatggggacacaatagttcaaggtggaacaacaaccttgagacctgagggtaaaggtcacatactatgagtgggccaggaagccggaaggagctgggcacctgatgacttcctcagtcagctgctctacctctccacttcttgttacttgagccaaacaaaccctacttgcttcagtcactctctctggatttctgataaacacagctaaacacaaccccagctgaaacccgcagtccagaaaatgctaatgttcacaatctggccctaaaatctgctgtcccgaggacattttcacttccaagaaaatctgtcactattggcctaaagcaaatagttattttggctcatgcaatgggaacaagcatgaattatttggccttggctttttatgatccagcatatataatagtcatttttaaaagatatatactatatatctatacatctacataagtatataggtacaaatatatatttccaagagggcaggggctttatctgtcgtattcatcattttatttccaggccctaataaaggccaaatctccttttccttaaggctgacttctctttccagtgatcttcacaacataatttgctaccattcagaggcggcaacatggaaaacatcctaggctaagttacaggtgacctagagctaatcctggctctaccaaataaatagttctgagacattgaaacatttcttcaaataaaaattcgtgcagaaattcagtgtactaagcaggtaagattaaagagagaaaacccgcagccccttctactgggtcacaggatagtaagaaatccccaagaaatttaatagcattaaagacaaatttaaagtaaacctctcactcagttatatagatttgaaggaatgttgtcatgttcatgtataaaaaatgtgacttggtatagggtcagaaatcagtacacataagggctttggaaataacctgtatttggggactatataagcaagtgttttaacacatgggctttggatgacctaggaccagttaactattccattaacgggtttgataatcccaaaaaaacacaatcctgaatgtcataataccaaatgtggaaatcccaaaaagatctaaatccccaaaatataattctggaaaaaataatttaaaagacatttcttcacatttataaaaggagatttattttagaaacatataaaaacatgacagagcatttcacaggccactttacataataaaataggcaatagtaacatttgtatttttacaagcataaacatacaggtatactaacaacagtcatatgggtataatgttataagtggatgaaccatattcataaagaaataagtcaagattcaaaatgtataaatgcataacactatggtaattttatgcaaccagctttataactgtagtcatctgaaacaccatgacgataacctaagtcttttgataagattgatccaaaacttcaatgagtcactacggcatatgcaattgcacaaagagctgagatcttaagaaattttatctttcacaaatgcagttgtacaaaaaaggacatctcttcatttattggggaagtttcaacatttttacatacacaatgcttacacacaaagtcaatgttgtgataatgcacttttgtggagtcaaattgacaaaatatacataaaacaaattagaactttctgaaagtctttatacaatttatactccagtactgcaaatgatgtgaagatgaaatacacagcatagcaaattgtgaaaagtaataataacaatgctgacaatttaagatagtgggaaagaactagaaagaaaattcaacgtttgaaaaagtatattacagggatacattatgggcaattgcctggaggtagtccattagagctggccaacattcacagtcatattttgaagtcttgcatggcaatgaattgctgcttttttttttaagacatgactctcgtcagagaatatgttcacatttcattccttttccacatagcactgctctttttgaaattcttctatgattcgacatacaccaacatgagcaatccctattaaatatttccatctttgcataatttttctatgctgttttcggtacacagaaattcattccacatgcactcatatgcagaagcaatactgataatcaaatagtcacactattgtgtgtcttcttatcttactatgtgcataattatatttgaaccagttggtaactttgctggcttcttcaggcaaatgtggctttaattcattaaaacttcctaaaatgtcattagctgggaggaatgccactgcaaacaaatgaaatatttttaaaccatatggggtggccaattcacttgtctgaatttttcaccatatgcattgggctgaatgacaaaaacaaattttattgatgacaccttgagattcacttttagaagccttgaagggacttaattccaaatctgtcatggtttggggattctactaaaatccattttcttctgcaaagtccaccaaatcttcaaataaatgtttataaagtgctttactttttccagtcattaatatataaagaagcaggtaagttcaagaatgtttggatccaactggggcatgatggcatacagttgataagaaagatggggacgattttcaaagtgtcattcctcagccaaagtgaaggatgcactaggttgtctatgttagatttagtggcaaatataggaagtctatcttctttgacagtcaaatcccaaactaagaatatttcatcactcaatgagtttcagaacactggaggaacctctatatcggcaagcatctttggttcagaatgttgctcagcttgtggaattctttttattctctgatgaagagtgttttttgaaggcaagcatggcactatgtgtgaaggggcagaagtcatacatgattgaatcatttgacaggggacatttgttatatttttcacctgtgtttttactttttctatgattttcgaaacactcaaaacattgagaatagatctttctcacgttgtgcactcagactcacacactaatctcctctggaaacaccctcacaagatacactgcttcaccaggttctaggtatcccttaatccagtcaagggattttaaactttaggaatttcaatgtttgagattatgtcttttgggattatgattggtaccattcatgaactaatttccttaactatgaaattagaataattctgttagacaatatgaaaatgtacaatgtgaatctctaagggagagacatcatatgcaaggttttctaagtgtatttgatcatagaattcttttgtggtggcctatcctcctgactcctattccaggactcacaccttggaaaactctctaacacagtcacttttgcatctttatagttataaaaacttaattttttctacgttaaagtagaattttcataaggggtatataaaggcgtcagtcttggaagaaggcttctaacatcttctttcatgaatgcctctacccactcctaactaccaccaattggcttgaagcatgaaaagtgcatctgcttcttagatgagaccttcaccaaattctaaccatggcaagtgcttaaaatcctatcaaacttctcacagggcaaaaataaaggatcagaagtgaggattctagttctggttcctggctcctccagctcattcttgtaatgccctggtgtttccttttcctttttctgatcaggagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgaggtagttctctttttgttttattttgtttttgttttgtattttggcagcattgcttgataaagattatcaaccatcagtgtcatttttcaagtgcagaaatatatcactattgcttaagtttagatgattacattttagtggtctaagagggaaacagttcaatttttcagctgttcatttatgccaaaaagtagaaggaacttctattcaaaaaatatttactgtatatttattttgtgacaacaaagacattatgtcagacattgtgctaagatgcttatgttagcctaaatctccaagattctattaatgcaataacttcaaatagaggttttcataatgcacatcagtaacgctccattgtatagccattgcaatctgatgccagcaatttctctagccccgtcttctacccttctttccttcactctggccacactggcctcccagctgttcctaggacattccaaacacattctggccttggggtctttgcactcataattcactctggctggatcatcttcccctagatattcctatgcaacgtgcttcattcctccaggtttctgttcaaatatagcctcgtaacagaggatttgcatgacattttataaaatagcacctctacccacatggtttcaatctcccttaaagcctactttattttttttgtcacatagcactcattgcaaactaccatggtctatatttgattcctgtttgttttctctttctaagatataatctctataaagtcaaagagtttgttttcttcatgctaaatcccatatcccataccagacaacagtggtgttgtagtcagcactctaaatattccttaaattgatgaatgaataaataaattaattttaaggcattagagtaaaaatagagtttctcatcaaaaaaagaaaattctttgtctaaatcaagagaaacatgcttgtgtaagaggtcttcgagagttgctagggtgcagatgtacgtgatgaatctgggttaacaattttcatgcaagggctacagatagtgtactttaggaaactggcccaaaacttgtggagttatcatgagaattgacaacaatgcagtctcacgatacttgtccttttctactatcaaagagaatactggattttattaaaattatgggattgaaccagcaattactcctttgtgaatttgttcttaagggcaaggatattgattaattcattttccatctgcagggtttaacagaccccataatgtacctgaggcagtgtgaaaagttaaaactctcagtgaacttttaaaaagcactttattggtatttagcacattttgaattgacctcagtgcttcaaaggtcaatgccactctcaaagtgattaaaggtatttccatgcataatgaagtatcatgaaagtgacaagaggcaagcagccctgtgccttttgaaatgactagaaaatcaagtaagtacagcatagtgctaaaataagattccaatttaggagtcaaaacttcttggtaattgaaaaagccaacaacattcttagaaacattgaactgtttctaagaatattctatattttgatctggattgttatatggttgattacattacattgagtcaagatccgcccagatgtacactttgacttgtgcgttcaatacatattataccccagtaaaatactattagcaataaggagaaagtctttctttcaaatctctagaaatcttgtaaacagtttatttttctgtaataattgactatcttagattagctctctaaaaaaagacaaatccaaaacattttccaaaagacaaagacaaaaatctcaaaatacctacaatcctattaagggtttggcatatataggaaaatgaaaaggactggattgagtttgtggaaaattgaactagaaaatattttaaaggctgtagataacatagttaaaacattatgaagaagaaactattcagctacctttagtaaataactatatgcactttatagagaaatggatgctattcaagtattttaaaagaacctaacctcattaaccaggtcagcccatttgcaagttggctatcaagatcaattcaagtgtgagctaaagcttgacacaggtccataaatgaaatgaaaaaaaaatttttttaatctaccacaattgcatcaaagtgcttgtttctttttaaaaatcaaatgattcctttttttaagaaggcagttgattacaagttttagaattaatttatttttaactcaaagaaaattttatatatagcattgttttactgtgggttttcccctcaacttacaaaagcaatacttgttcatcataattattttgaaagtttaggaaaaaaatgtttaaacttggggaaaaaatatctcacaattcaaccaccaaatggtgatctctacaaatacccagatgaatctccctttagtccttccaagtattccatttaggaggctgagactatgtttgtaagcatgatttttattctaacattcatcctaaactctatcatgtctcattaaaatctctttgcatggtgcatacaccatgatttgcttaattattgtcctaatgtcgaaatatcactttggggggctgaggcagtaggaccaattgagcccaggagtttgagaacagcctgggtaacatagtgacaccctgtctctacaagaaaaaataaataattagctgggtagggtagtgcacgcctatagacacagctccttgggaggctgaggtgggaggattacctgagcccaagaggtgaaggctgcagtgagccatgatcatgccactgcactccagcctgggcgacggagaccctgtctcaaaataaaaataatttaagaaagaaatatctttgtgcataaatatgtatctgcgtttggattatttccatagtatctattcttagaagtggaattactaaggtatgaatactgtgaaagctcttgatacatgttgccaaattgttttccggaaagtttatactaatttacacttccattagcattatttgagtgctttttttccactttacctatgccagaattgaaatttatcactttaatttttgctaacttcatggaacagaaataagattttttttcttagtgaaagtgttgaatccacttttttaaagtgactatttaaagtaacaattttggctgagtgcctgtggctcacaactgtgatcccagtggtttagggggctgacttgggaggattgcttgaggccaagagtttgagacagtgagactctgtctctacaacaacaacaacaaaattaataataataaagtgacagcttcatttcttcttctaatgatttatgtcttttgttaatttatcttttgagttttagtacttttaaattttgttgatttgacgagctcttttattttacatattagaaataataactggtaatatggtagtaagtgtttaacaatcagcaatcagttcttttctaggggaaaagagagcctggtttgtagtatcttcctatttctatggtgtaaatactcctatgatttcaaacaaccagcaagatgacactgtacacaaagatgagaagagatgtatacaatccactttcacatacggctccaggctgcttgcagtacatcactgaaacccttggcaatagtatatgttacaaatgttttttcagtttgctttttctatcttaattgtatttacagtgtctttacaagttttacacaaaggtaaatattcaagtattttgctttgtaatttctctcattattgcagtcctcccaccttcatctgtggtttcactttctgtgatttcaaaagtttacagaaatattaaatggaagatcccagaaccaagtaattcataagtgttcaatcgtgtgctgttctgagtagcgggatgaaattttgcacatcctgtttcatcccacccatggtgtgaatcatccctttgtccagcacattcacactgtcaatactctctgcccattagtcactcagtagcctgttggttaccagatcaactgttcagatgaggtatcacagtgctcatgttcaggtaacccttattttacttaataattccccaaagcacaaaagtagtgatgctggcaattccactatggcaaggagaagccgtaaagagctttcttcagggaaaaggttgaagttcttgacttaataaggaaaaaaaaaattgtatgctgagtttgctaaaatctatggtaagaacaaatcttctatccatgaaattgtgacaaaggaaaaataaattcatgctagttttgctgtcgcacttcaagctacaagagttacagccacagtgtgtacgatattatagtacattgttataatagttctatttttagatattgttaatctcttactgataaataactttatcataggtatgtatgtatagggagaaacaatatatatagggttcagtactatatgaggttttgggcatccactgggggtcttagaacgtatcccccttggataagaggagactactgtacttctaagactagaaagttcctcattcaaagacaaaataatctcctcaattatctgtgacttttatggcttaatttaaaaaatattttagatctatttttttctgaaatctataatgatatatgacatgaggtaaggatctaaattaattattttctgagtaattagagcccccagcccacttgtgaaattactcccccattgatttatgaattgcatatagagtatattcctttcctacacttaccaaggtcttcatggcattacaggtagctatatacctttactacactgatttacttatccttattttagaaaatattttagcatatagtagagtaagtttcctttcatcactgtctttaccaaaacagaaaacaaaatacctgcatacatgcaaaaagataaaaccaaactctagttagtgtttttgacacttttacatcttcaattaaggcttcatttgcccttgggttgtctcaatcccagttaaaaaatgagcaagagtctgtctgtggtctttgaaattcttgtaatttatttgctataaaaattcttcctttcctagtaaaattcataaccatagtttaaacataatttaggactttgtcaaatataatacttaaactggaatgtctccccaagtaacagatttgtgtttttcaaaggcctacacagaactctcactttttttcttagtaaataccaatttcttatatgtcttcactctacattgggaatttatttgaatgtcaagtataatacaatttttttctatggacaagcagaatttttttaaattttttaaatcaatacttataaatgggtacaaaaagttaaaaaccannnnnnnnnnnnnnnnnnnngaccactaggccctggtggtacaaagaaagtcagttctatttccagaacaccaaaacacaataaagatgtgactaacaacactcatggacaaaatctggacacaaatgagccagaaatctctcatattctctaaaaaatctagataaactctttttcattgtgtatgaatcaggttgattcagacttgcttgcgctgtgttaacttcattgtggttctggttcaatccataaaaaatcttgcctgatgcaatattgaaaaaaatccttttccaaacttatggcaccaattgtgaaatacatttttgtgaaaagcttttatgtcagtgatggccaacggcaacccatgaccatatcaacacaatgcatgttctgtttggtccatatatggtttacaaaagatcttgaataatatgccaatattgttaatttgagcaatttcatataaaatctggatttctagcttcctttaaaacactattgagacatcttccccacctggcaataatcacctagaatcaaaccactgctgcttccctcagataaattagcagagatcacttctctctgagataggactctctcactcatgcacaccatcagcctaattacaaaatgcattcatttaggtaacccctgctttaaatgatgtttccttatcatgtgtgatgggaaattaatgggaaatttgactcaaaattacagattttagaagaccaaataagagctcgagatcaggcggccacaggaactaactttgcagtacacgagataaacatcaaacacctacaaggagttggagatcttcgaggaagagtagccaggtgagaagaagcatgttgactaatgtttaacagtgaattcttggccagtgaattcgcattcctaaacaagctccatgctgtggaaaaaagatattgtctacacattaagctaaactaatgagatggcatttgagaaagtgtaccatagaactttcaatgcctcacgctagcggtgagattcaaagtttctgtaaagaccccttacacagtttgattccaatggaagcgaccaaagttctgtctttgcagcctcaaccatccaaatgccaacatccatacatagacgcaccttcataaccatgtacgaaatccccatatgtgtcaaatgcgaatgagtaaaacatttaaaatatacaagaattataatagtctaatgggatttactgccaaatggataaagttttgaataacatcttttgtacaagatttctaaatcaaaagaattgatggtatgcagttcagcaaatatgtgtaggtattgagaatggcaggaccactctggcagacacatcaaagatgacttgtgaatggctgactgtggacacctttccatctctacatcttctgccagtacctcattcctctctcctgaaatactcccatctccatctggttaatcctctcggaattagataattactacctaagaattagataattactacctaagacaaagctctcttagggtatttacccatttaattcaacaaaaatgtattaagcactcatcttatgccaggccgtgtaatgttagaattcagcaacatggtctcctttctatagctgtttacagtctaccaggaaaaacaagctgtatcaataaccaatacagtgaatgctgtactaaaagtctgggatgctatggaaatgtccaaatcagacccacacagaagagaggcttcccaggggaagtgacacttgagctgagttttgaaggatttataacagttaactagacaaggaaaagtgagaaagacaatttacctggaagaataatatgtgcaaaagaactgagggaaggatcactgtgacatgttcatgggcctacctgggagaatggcattttggttatggtattttggagaaggcattttgagaaagttgggacaggaagccagagaagcagtccagacctggaggatgaggggtcttgtaggctaaggtaaagagttcgaactttatgtagaaggttataaatgaccatggggggattttaagtaagggggtggcatatcatattttgtgacattctagttgcagtgaattggtagaatacaaaaaaaaggttgtggagatcagaggaaggctattgtaccaatccaggtgagaagtggcagggcctaaaccaaggcactagccatgaaagcccagagtaggggacagacaacacagacattagagaaatagaatctacaggattactgcatgaataaacatggaggatgaattaagcagggggaggtcaaggatagtgaccaaagtttctgggcttggagactggttgaatactcatgtcatgccacagagaagaaaatatgaaacaaggagcaattataacaaggaagtggaaagagaaacagagtaataaaatgtttggcttccaccatgttgtgtatgagacgccatcagaatattagctggaatgggcatggagctcaaaaggggaggaagggaggaggtgtcagggatgcccaagtttctggttggcccacaacataaatgactttgtggctttgggaaagacttgaaagactttgtagttctggagtgtgacttcatttctgttaaaaataaaagatgccatcttggaaataatacatatggttgaaaaacactcatccaaggaaaaaataactgtcagccagtccagagaataaacaggtgaatttatattatatattaatatataaataaataatatatagaaatatttatttcattaatattttatcaataccaaagaagttttataacatttgggtaagttatgaaacaagataacaaaacaaatatcagcaaacccacaaccctatttagatgtgccaagattctgcaaagaagataaaaccaaacatggtttctttgtttgtttctttttcgagacagagtctcgctctgtcacccaagctggagtgcagtggcgcgatcttggctcactgcctcccaggttcaaacaattatcatgcctcagcctcctgagtgcctgggattacaggtgcacgccaccatgactggctaatttcaaacatgttttaaatgaaatataatttggttcaatttggtggtatgctgatgacactcctaccaactatttctttctgcaaaccacttacaaaccaattattttatttttgtaaaccctgttttatttacaagacaaaatagcaaatggatctcaaagaaactaagagatcaatgaaattacatcaagatacgcaattctttttgctctgcttgcgttttgcttaccttccccttcaatcaaaagcagtgattttaggacaaggtcttatttttccttgaaatgtctcccttttatggaaaatttctgaaatctatttggcaatctgagacagaatttggctaacggccatgagacttaaattcaccctccctctcctgtttcttttctgtgcctttgccaggcaaatgactaatgtacaagctaaggcagattgattactgtctttccacatagagggacctctattccaatgagcattttggcataagtaaaattgattgttttaacataattactagcaaacattttactgctccataaatcagtctcaatatttaataactacaatgagatttgaattttacactttatttcccatggcaatacattgcagtttaaaagtaagtcctcccaatgagatgaggctcccaaagttgccagcctgcttttgataccctgtcctttatttaatagactaggggcttgcgtgggtcatcagagagagaggtcacgtccccttagagattcaggtgaagtgcaaaaaaggaaaaggcgagcatgggaagggcacccctagggatggatatgacttacaatccgtagccgcagtcagaggcgaactctctagccccatttggctctttaggactccagaacaaacctgcatgtgggtaaaaaaaaaaaaaaaaaaaagataaattttgttgatttgtgattaaaagcaaaatcatgttctttaaagaaacataataatgtggatattatgacaggcctggtcagagagggcagaataaaaacctcttattccactcctcttacttgagacaactcaatgccagtgaaaaataaaagaaggaaaacaaaaaactccatctttaatataatatggaagttgctgtaaccactgaccacaaacagagcacacttaccaaatattgtgacatttggactgatacagtccttctcagatttaaacataatgattttccactagtcaacagtcataattttgagagacattggcaaaatggaatcaagcagcattacttagaggctcgggtgggtcatcggagaaagacaacatgtccccttagagattcaggtcagcaacaccaaacagccgggaggtatagccaaggatgcaaccgtgttctttatcatttctatcatctaggacctccctccttgcccgcttatacctgagagaaactggctgaagtgcgacaggctgaggaaggagagagatttgatactgcaagcctgaatagaggatgctatctaccagccaccaaacacactcactgatcctctgcaggtagcagaaacattcaaagacataatagttattgttagaatgcagtcatgcatatgaatcacttccactatcatccccagatagacagaagacagacagatagatgatagacagacagacagataatagatacataaaacataagcaaaagactagtgaatacacttcatgaaggaactgcccagaaaagtataggaagagttcaagccaaaagttctcccggtttcaacgaaattaagaacaaaagacaaagaatttaaaaaaaaaaaaaaaaaggattacttgtgaacagtcacatgtaatttggcccttccaaaagccccattgaatctacagtaaaaagattttctctttaaaatataaacccataaggaccagggataccagcatagaagtcttggaacctagaaagcagatggaaacatgaaaactgccttagcagaatgaaagccaattttcaagttgtaggataagctgagaacaacctaactttatgcaacagaattttcaaaaggcttcaggcccttgccactagggagaggaactgagagaggcagtgagaggaagggtcagaaaccactgtagtttattattagcttattaactttcaaattacaggcatcttttactttgataaaataaataataattttaaaagtaaggtataaaaacatttccctccaaaagagactatcagataacaaaaggagatagatagactggaattgctcgggatagatgaaagaaaaagtcaagatactatgaagattaatctactttagaagctcttaaaatagaacaaatgcaaccaaaaataatgagttataaaaagtaaaaacatgagtaaaccacaccaaatgaaaagagatagttacttttcaatataaaaatgattgtagaaaaattgtcatatgacaggcaaggaaaactcatccaatatagaactaatagaaggccctgaagaagaaacagaacgaattcttcaaaaaaaaaaaaatcatgcctataagagaagaaagtgttcttgaaatacagatgtgaatctatagattaaaaggaaaaactgtgaccatggaaaaaatgatataagaacaatgaaaccaagatatcctggttgaagttgctgaacaataaggataaagactgcaacgagcatccaggtagacaaagcaagtctcataaaaaaggaaagaaatgtcatcacctcagacttctccacctcaaccaatgctagaaaagaatggattgatgtttatcatgttctgaaagaaagaaaaaaaatgttatctcaactaagttacctttcaatcacaagagaagtcaggtattctcaagcactcaagaacttgagaattctagtactcctgagccctgcttttaaaatctggatgacaaaatctggccaaccatggaataaatcaaaataaggatcttagaaaagaaatcatggtttgaaaggattatcaatgaacatctaatctacatataaagtgaacattaaataaccatagacattctagtgacagaacacagtgcaaatgtcataaaatttaacattttaaaattagcaaatttttttttaaatgttgaaggcacaagtatataaacttatttattttcttattttttggcatatggtcaacagataatatctaaagttggtattgagatggtagctgtgacaagtataacaattccaatctatgatagctttttatagattcttttttttagaaatctctctcatagtgaagaaatacatatctgaaactcaacaatttcttcatttctcactacatttatcttttcttaggttaaagtaaaattaaatgtaatattttaaagttgatgcatataatataatcccagtattctaaattatgttttcttcctatctctgtgtgtatatatatatatatatatatatatatatatgtacacatatattttaagtatatatgtataatgatgaacagaatgataaccaaatattaataatgttactttttaaaagggatttggaaagagcttaactttcctctttgttctttgaggcatgatatgaaattttttctaatggtgatgtactattttaacagaaacaataaaatcattctaaaggaggaggaggcagaggaactccttttggaatgtagagtgcagctttgaaaagccatgaatcaatccttgacttcaacatgtgggattaggctagtgggtggtggttaggggaggtgaaaatgaataggcggcaactctcaagttgagtaaataaatcatatctgctaatcttatgtgggtactccccgtgtcaggcactggctaaatgctttgcgtgcatcacctccttccatccctaaataacctacaaagtaacactattcaggacagccacttacagttttgaaggttgagcactccaggagacattattcgcattgtcaatcacgtgtttctggcactcctggagtcgtgtggtagacaagttgtacaactgtatgcagtgaccatggcatcatttcccctttttttcagatgaggaaaactgaaatctgtaggcattaagaagcttgtcccaggccgggcgcggtggctcacgcctgtaatcccagcactttgggaggctgaggcgggccgatcacgaggtcaggagctcgagaccatcctggctaagacggtgaaaccccgtctctactaaaaatacaaaaaaattagccaggcgtggtggcgcatgcctgtagtcccagctcctcgggagggtgaggcaggagaatggcgtgaacctgggaggcggagcttgcagtgagccgagattgtgccactgcactccagcctgggcgatagagcaagactccgtctcaaaaaaaagaaaagaagcttttcccagatcataaacctaggaagtagcagaagcatggtctatctgacaccagaaaccacatttttaaccagtagcctccactgcacagaccctgctgtccctgagggtgggaaacaaaagaaggatagaagggagatggcaggaagtggtggtagcagcagccactcctgagcagtctttgggggtcttaatatggactcacatcaggacattctaactaaccaacaatagaggtgccattctgacaatgacagtttgtatatgcaaaggtgtaaaacatcttttgatcaggaattttgtgcgtaccatcctgctcccattcttgatcagactaattcctaattttttctcccagcagcttcttcacccccactacaaccatttttaagggtgatactaaagggatacctttagtatctttttaaagaaatgctcaggcaaaattgccatcttaactcacctttgcctcaaatcttttgcaccaaaaactttaaggaaaaaagattcattctgggatcctaaaaatgttgacatcataaagcaaacaatatttatatcacttagcataataatatgaaaatgtatttcctaattaatattatttgatgacagtcaaaacagttattttataaaagtgacaaatatcaaaataatccttgataactcagatatacaaaagataaagtccttcagtgctcttcaacctatccttcatgcatatgtgaaagtatacagaaactgaccattaatacactgtgcaacctgctgtcccccaagagagtcacgggtaacagttgtgggggtgtggttctgtgtgttatctttcctaacatactgggaagataatcttcagcttacctcactagctccttctcaccagaattccttccctaaattatcacatgcaactttatggaccaaagtttcattcatatgttagtgtgaattggttttgtcctaatatgacagtgcctgactgagaccattcaaggaacaggagttttgtttgaggctaaaacggtgagaaattggagaagatggattggaagattttgatttgctgggacaccttttcttgccaacggagaattgatagtctgggggccaagaaaagaggataaagagaggaaagtggatttagaacatgatatataagaggagcaaattttaattttgcctaaccataggcagcagcgtatatttccaaaacatcaaaatttgctataactcctatgactaagttaatatcaagctgaaaatgtaaaaattccctcaatttaccacaatatccccatgtaaactatttcaagttggtgctctggtttgagccaatgcattcaacctggtttctctctcatcagaaagagaagggaaaaatgaagaaagagattcctgaatacactcctatatctaccaactcattcttcaaatgactttagaactttggccatcaaatgaatgtgcaggtgtctactatagtgttaaaaatgttataaaggtattgatccacaccaatttccatcttgccattagatgtgattcaagcattgtgaagctttctggagacattcacttattcaggcaagagcaccggcaaattgagaaagccattcaagaattcgtgcccgccctggaaactctttccaagaacttggacatgaaggtaattgaaaatagatgggactcatattacgtgttactgccagaagtaagatcattatagcttatcaaaatgcccaatcaggtggtaattttttaagagaactcttttcttccaaagggtgtaattctgacagctcactcatatacgccatggaaacagtcaattcaatcaacaaatgtttaatgaatgtctgccgtgttccaacacagccatctactctaagcatgcactgcttgagtccaccattgctgttatttttttactctctggaagtagtaaaattatttttactcaaggactatggaaccaaggaatataaacaaaagaacttcccatggaagctattattattaaaagtccaacataaatgtgaattgttcatgttacatcccacttaaagccctgcaatgggttgtatctcttacaaaataacatgtaagtcctttggttggtctggattttaaaggccatctgtgcttcttgactcaccctttatgcccagtgatactgagctccctgtaggtaggtccccactcacaccaagatattacacatcttcctctagtttgtgctcttttctgcctgaagtgtctctttttcaccttcccagtcaatggtttcactaaagtggagcccaatgcaaagttttctgtgctccactttgtcacatcttatgcaaaacaagcacttctcttctcctctgaagtcatttgggcagaacaaagtagacatcctctggaaattggaaatatgaaagtctggcgtttgattatttgttggtaggcgccagttaatccagagcaggtgttactgagcacatagtttactctagtcccatctggctctccttatctacctcctactcacccatcttattaggcccaataatttttaaactctctttgtttttcaaggtactcaatcatatcaataacatggcaattttatctctggttttctgatttaagacttcattgcttttcttaaagtcttgagcagaaattccagaatactgttaaataaaagtggtcatagaaggcaacttatctggttcctgattatcctggaaatgtctttgctgtttgctgctggctattggttagaaatattttttaatcatgttaaggaagtatccagtgattcctacttagtttttatcaggatggaatatctactttaatcaaatgccttttagatatcaacaaatatctagaaccaccatattggttgttttttggtttggggatttgtgtgatgtttgttgacttctttggccttctaatgtgttaatacatttcccaatactgaaacattcttgcatttctataatgaaagctatacagttattgtataataattcaatatttaatttggcatcaggattcaaaagtgacattggactataattcctctctgtttagtatatttttaaagataatgcatacacatagctcaaaaacaaaactacataagaaaatatagccagagaattttcattcccaccccttaaccattcatcacatttttttcatgatcctcacaggtaagcatttttattagtcaattgtggatgcattcagtatgcccttatgcagatatgagcaaatgcaaatacatatttttattccccctttattgcacaaaaatagtgtatatatatatagtatatgtaaataaatagtatatatatagagctatgcttttaaaaaaaaaaaactaaacaaatatatcctgaacatctttccatattgatacacagagaccttccttatctttttttacaactgcatacccttcctttgtatgtaatagttcagttaactgctcttgcatagatggacatttgggttcttttaaatattttgctctttcaaacaatgctgcaatgaataaccttgcacatatgtcattttgtatgcgtatagatatatctgtagaataaatatccagaagtgggatttcaggatcaaaatagaataaataaaagcagagagaattaagcagagagagtacatgtgtgttgttttgaaagatcttgccaaattgctttctatatggctttcacctcattgcacacccaccaacaatatgtaaaatgtcctgtgtctccattgcctcaccaatgcagtattgttcaacttctgaattttgccattcttataggaaaaaggcagtatctttttgttttaattagccttttttattatggatgaagttgagcatcttttcacatatttaaggggcatttgtatttcttttttggtgaactatctgtttatgtcttttgcctatttctctactgggctatttttcctctctatctctaggagctctttatatggtaaggagatgagctgttttctctatgacacaaattgcaaatgcatttccccagtttgtcataggtctttggtttttgacatgcacaaatagttctctagttgtagttgaatttatcagttcttttgtggctgctggaatttcaaatcagttagaaagagcttccctacacaaagtcttgaaagaattcttcatatctcttcaggcactttcatggctttgttgtttacacttaaatccttcgtccatttgtagttttcctaatatgtgtcttaactactgttttaattattgaatctttatggtatttttatatctggtagggctagttccttccactacgttcttttttcagtttcctggtataattagttgtttttgcttataattttaaaatcagcctgtctcatttcaataaataaatcaaaaataaactattttaatctttattaaaatcatgttaaatttgtaaataaattttagaattgacatagtcataatgttgagtgttctatccaagaatgtagtgtgcttcccatttgtctgagtttgcttttaagttcttgaggagtattttcaaatttttctcatgtagatttggcataatttcttattaaatgtattttgagattttgaaatctttttctttttagtttattgtaacaggggcttcgatatgccctctaatttcattgttagttgtatattatgaagacaatattaattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgatagctttcattttttatatttatttttttgagacaaggtctctttctgttgattagtctgcttaaactttctatctcttcagaggttagcttctataaattactttttcttagaaaaaaaatctatttccttcagattttgaatttgcataaagttatgcaaaatgcttttagggtggttttaattctctctgcttttatttattctattttattattttgtatatttgtgcttttctttttttcccccttgattaggttaggtgtgccttaacaatgattttacaattaacaaatccttttatatattttttattttctgcttctattgtcttttccaactctccaatttcaccttttatcttttctttttccttgcctgcagggtattttgttgttcattttgcaactttttaaaaccacatgtatttgtagtcttttttgctgacatgagcatttatggctgtgaatttttcctgagcattcattcttcttccttatatcccccggagtttaacatgtagtattctcattattatttcctagaaattctgcaattgcatgtggtattttcccttaaatagttaagaggagtgtattagtctgttctcacactgctaataaagacatacccaagaccgggtaatttatttttttaaagaaagaggtttaatggactcatagttccacatggctggggagacctcacagtcatggtgaaaggtgaagggtagcaaaggcatgttttacatggtggcaggcaagagaagtgccaagcaaaagggggaaaagtcccatataaaaccatcagatctcatgagaactcactcactataatgagaatagcagcatgcaggtaattgcccccatgattcaattacctcccacggggtccttctcatgacatgtagggattatgggaattacaattcaagatgagatttggatggggacacagccaaaccatatcaaggaagttttttccccaccctctgagttaaggactttttgttttgttatgctggtattcatttttagtttcatctcattgtaggtaaaaattttaatatatgtaagttttagtttttggaatattttgaggattgtttttggtggctggatagtccattttcatacatgttctaaaaaaagtgtattctgtatttttagggcacaaagttcaatcagtacttatagggaataacttactggttaaatcttctgatccttacttattttttagtctactgctgtcttggattgagaggtgaattaaagtctcctctggttatcagacttccatttcacctataatttcagtttttagaatgtttctgctatgttatttggcttacagatattcataactactcttttttctttcttaattttaatacttaagtttcctcacttcacatgtagagtagaacaaactttgcctattaccttttcgaaaaaccagcccttggattacacatcaatccccataccttttgtttttattcatttatttttaaaatatttgttttcaattgctgccttaacaaattaccataaacataatagtttaaaacaacacaaatgcattatctcatgctttctgtaggtcaaaatttgggaggggctagactggaccctcaggatctcataaggcagaaatcgaggtgtctgcagagttgtgtttctttatggaggctttgggaatgaatcctgttcaggttcattcaaacttttgaatccagttccttgcagttgtagtcctgaggtccttgcaggctgttagctgggggttggtccttgctccagaggccgcctaccttccttcttgtgttttccatgtggcctttctccagcaacagcaggtcaagtccttctcatgcttcaagtcattctgacttcaccttctgctgcatccctctcacaccagctggaaaaacttctctgcttttaggagccctgtgattaagttaggcccacttggataatccagaataatctcccccttttactttaattacagctgcaaatcccttttgctctacagcatcgcaccttcacaggtttcagactgagggcatggacatcttttcgagcccattctgcctcccacaatttgtcaatttcttcatcctgctttcctttgattaggaattttttattccttttaaacttcgtgaaatgaatgattcacttacattgccttattctttcttgtataattatgaaaatatttaatgccacaaatttacctctgattatatatttggctgtgtccttttgatatgtaatgtttccattatcttctcctaagtaaatttgtaattgcagtgttgatttactcttcggcacttgtgttagtccagatcctttgcgaagcaaatgccataaaggaattaaatgtgcaagaaatttattgagaggaaaattgatgaagaaaaattgggagggagactatgacagaggtctggtttctgtgaaaaagatggagaaagaaggctttaggattgcagtgccattctaagattatttcagtgagttcctttgttccttgaacaaaagtcacgcatcaaaggactactcagacattggctaggcacggcctgtagaaagcatggtctggacactcgtgatggattttgagcacagtagtcacagcccttggccaattatgctccttgcagtaggacatctaagaggcacattttcatgtgaaacactaaaatcaagagtgggttttttgttgctttttttttactcaagtgactgggtttttgtgggtttttattcctttatgcttccttattaacttctagttttagcacagtgtggagttatggcctgtgcttttcctgctttttggaataatttgagattttcttaatgttgcatatgtgcttggttgttgcagatgcttagtgggcactgggaaaaaatgaatgctgtttccaagttacatggtttgatatataaatctatgaaatacatttacagtttttatattttcttgtatcattatttatattttacttacttgaccagtaaagagtcaagaaaagtcatttaaaatcattaatgtattgtctctgtttatcctgaaaagctgttgcttttttgctcaatatataaatattcacagctctctactttcacaatgagttttactcttcatctataaagatgaccatctttgtcccatttttaaatgtgttttgctttaagtaatattttacctaacattaatattgctctgctgctttattttcctttgcctttacctgtaattgcctattattataataaattgcctattattttatttcaaacatttccatctttagcctgttttaagtgtatctttctcctgtaaatagccactcaactgctgttggttgcccacccaacacttacctattcaaatccttccgttactcccctctttctttcataagaactcattttattaaatgcccactctcctccatatgaccgtctttattaggagctgaattctgtttgaccaaagccaatcatgtagtttcattctccttaaaagtgactagtttaggcatgattatgggttgcaattctgcctctattttttaatccagttcttttacataaagaaactttctcaatgtttctggcagtttgaaaggtgctctaatcttaaattctaaaactggaatttgtttttttcctatccttaaatgccctaagtcatttcacttgggattcacttgtgctcatgtcagaatactatctggaaatcttgggccagtcatgtgtgttttcctcagagcctgattgtgcatttaaacatttattcaataagtatttgttgagcatttaccattgatcacctaatgtgcactgaggatatggtggtaatagcataccatatcttgtattgtaacgggagacaatagagaagtagaaatataatcaaattaacagactaataaacaaactaatggaaacagcatgtttttgttatatcattagatggcctatgatcaaaaagaatattctagacaacagaatggaacactccctattattctttccttgaagatagtgtaactgtaatactcatttgaacacaaggcattttcaagtgcaatcatgctttaggttcaagtctgtttcccagctccttaaaggaataaagtatattaatctgtttcccggctccttaaaggaataaagtatattaatgtgaatgctggtggttttgttcatatgcacaaaccctctcgtactttgactaggtgatgcagctcttaggaaagatagaaactgccagttctgagcaaacctcgaatttaaagatggtccagggggattatcgccacgaaatgaaccttttggaattcaagtaagtgaatagaagatttttaattctgttaagtgcattccaaagagttttgcctaatgaaagcattggcatgaaataaaaacctatcccaggaatttgaacctggccaagaaataaagcagtgaactaacacagagaatattttacactaaagtaacttatataatatttataataaaagaattatgaatattaatcttatcattcactttgactgcacaatatctcaactgaattgacacaatcatttttacccttcctgtaatttttacttattatcaattgcatattaaaatgtctcaatgtaaagcactatggaaaataatttcattcctcaagattatcaaatatttttaaaaacaattttgatacacaagcttttcctttaagattcttcctaacatcctctatttactcctttacattatcattattttattattattattattattttgagacggagtctcgctctgtcgcccaggctggagtgcagtggcgcgtctctgcttactgcaagctccgtctcctgggttcacgccattctcctgcctcagcctcctgagtagctgggattacaggcatgtaccacgacacctaattttgtatttttagtagagaccgggtttctccatgttgaggctggtctcgaactcctgacctcaggtgatccgcccgcctcagcctcccaaagtgctgggattacaggcgtgagccactgtgtccggcctacattatttctttttaagactggtctctaccccatcttaaactgaattttttcctccactcaatggagaaagcagtaaaggagacagctccacaaatgttcaaattactggcttccttattatcaaatctccctttttttctttttttaaatgatcatcatttccagggtcatggtgcaggcagagggaaattctagttacttggatactatcatactgtcccttatgctcttattctttttactctatgtctcacaacatttgggtttaatgccttaatcaaatccagtatcctgataatactctactttctccattttttcccatctctactgtattttattaaatctaagtgccattgaatataacatgcaccattataattttgtacctgtaagacatgaagctaacaattaaaccgtagcatatcatcattttaagatatttcttgattttggagatgctaaaatgcgaaatatgtgtgtcttacaagttgatgtaaaacaattgtccttactaaaacttggagaagtagttgtcaagtaaacagaaaatattcatgttcttcatagtctaagaaagcatttctactttcttaaattctagcacaatgagggtgttcagtgagtagctaatctaatacctttagcttggaattaagacaaagaaaactgtccaaaggaaaagtagaacagtaatctgtttctagatatacagattaagaattgactgtatagggaagggatgggatttataaactgaaatggaaggctgacttaaagggatgaggtatattaacaagtggaaaagagagaaaaaggaaatgtttgagatccagggctaactgctgcattactgatgatgctcattttttctgtctttggtattatgggaatttggcttatggaaagtcatctgagtagttaaatctgaatctggacacttttataacagtgtaaacttgactctttttctcactttaaataatgaagtcttaatatttcagtagtattacagtaggtggcagtgactctataaaccatgcttttcccccaggcaaataattctaataattcatttagttacacaactgacttttatatttaaattttctccaattttaaaaattaaaaatatgcattaattgtaaaaaaaaaaaaaaaaccaacaacagtgaaaaaagaggtcatcatctcagccttctgttgtaatcaatattaacaccagggatgtagccatcctcaatttcctccttgttaatataagtatataacagagaaaggatatgtatatattatatgtatagaggaagcatgggttttaaaaataatttctatacctattactcaattatttgatttttctagtacatcctggatatctctccagatcagtaaatgttctaagttttttatagctgtacaat

SEQ ID NO: 1613 - DNA, 659 bp, Homo sapiens
acaaatgtaaacaaaagtgcctctccaactgcgactgcagaggaacagccagttgaacctgatggcccccttcctggctcagacaataaccaagaaaagaaagcaaattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaag

SEQ ID NO: 1614 - protein, 190 aa, Homo sapiens
PRKESKLSPAKMSTKNSTDLVEYVDKSHAFLPIIPNTQRGQLEDRLNNQARTIAFLLEQAFRIKEDISACLQGTHGFRKEESLARKLLESHIQTITSIVKKLSQNIEILEDQIRARDQAATGTNFAVHEINIKHLQGVGDLRGRVARCDSSIVKLSGDIHLFRQEHRQIEKAIQEFVPALETLSKNLDMK

SEQ ID NO: 1615 - DNA, 72314 bp, Mus musculus
  misc_feature (1)...(72314): n = A,T,C or G
agctttaatgtatattccaaaccaacagctatggaactaaacccaggatgctcagtattacatgcattaatgccatgggctgtttagagagaaaatctgttcggtgctctgtcctgtcgtctatgttaactctaatgaatcacacatgtaactgtaaatgatgagtttaatgcagtagatctgggcgagcactgagattctttgtggctaacaagctcccaagatgcgacaggtccggagcctataattggagccacaaactccgagacaaatatcctgatttgtagccattatatttccagatactgttgggcatgctggcacatgcccacactcccaggcctcagagttttgagcaaaggtggcgcggagcggcagctccaggctagctgttccaggctctgcctcaaaaccaccaccgctaacacattgttcagatggaggagcagcgtacagagcccctgtctttgtgtctcctggcttactaattggaaagatccatatattcccacccagcatgagaactatagagtttgcatgttaactgacagttcttcccgctatgagaagatgtctaatagctgtctggcaccagagcagccaggggctttccatagctttgggtacctatatggtgctggtaattcaggggactcacgcagacctgttagtaaagcttgccacaagtaatcgacagtgagaatgtgaccacaggcatgcaaatcagttgtcgtcgcttgtgtatatttgtcagttaactttaggctggtagtcctaagcaatagagaagatgacagtgatatttgctatttatagcaccctttctgttagggaagtaaaatgctaaaaagggagaatcccaactaattgttgttgttgttgttttctttttaattgcttctgtgaacattgactctgagaagatggcaaagattacatagtgatttctgccgacagtagctctggggagttacagaaagcatgcattggtgatgtttgttctttctagagatgctgctggctgtaatcactccctacgagtgtgtcagtggaagaggatttcatgggaagaagtttgtttactgctttaagctgcagattgttcattgatttctgcccgtggctcatttgcagaagaacatacttgtgacccattacggctgtcatctctgctgtcagtccagctaacgtgtttctctgaggcacctggtcttgaagctgggtcttctgtgctactataattatgtccctgttccatgacactgtccgagcacgcattataaacagtggcctatcttctactggaatccacaaaatcaggaactagggcaaattttgcttgtttagatactagcatttactccctttatgactaagtaccaaggagtgttttgtactgtaaaactcccaagtccctacattccttttaggagtcatgaatatgtggcagagtgggaactgcagtcccccgcctagactgtaagtcaaccataaggtgtctggcctggaaggggggctctgggcataggcaggaaggtgcgtccatcgaaaggaccggagtaagagcaggctatagaatgaggcttttgcaggggcgagtgtatagaagaagagcaggagtgagaaccgagggccacgggaacggtgacaaatgagacttggatctggagttcagcattaccatcattttattctttgaaggagtagtaggcagatagtaggcagcgacctttgaactgctcagagccagcttggcaccattaaaacagttttaagtccaaatgctcacttacttttcccagtggaaaatggctctgcatgcaaatcacaaagagcttaattgcctggacattttctacacaggacctcctgagagattagcaaacaggagaggaaggtgttcagtaaaagccgaagcaaagagttagttttcagacagttttctgtgatttgctcctttccacccttgctagatttctctccagaggaatgctccccaaacattttcacacagaatgctccatcagattcttcttcatctcatctctgaggatgccccaagggtcggggggaatcagtatccaaatgtagtgcattttctttaggagaccctcagaggctttggaaacagaactgtcccatgtgctgggcagttgatctgttttcactgggtggatcatgagttggcctctgattagaagttcaggtttacactatcactagagaggttagagtcaaggctgtgccttcaaagttgtaagtctgtgagactctcagggtgcactgcgctgctcagtgtctctctcattcccgtttctctttcttctcctaatttacaggttcactgaggtctgcatttccagtgacaagcattatttttacattgccacagaatcacttagcattagcttgtgcatgtggccatgtgttgctagctatccagacaacagatgcatacaaatatctacgccaaagtacagctgctttgtcaagagttctgtagcagtgcatgcgagatgagttgctctgggaagtttttctgtacacatcatgttttgtgcatacttaaagatatcagtcaaagagtgtatcggctcctctttcggatgcttttctctggtttgatctttcttcttattaatcctttggccttggttaaattaatgatcagttctatagcctccagctgattcatgcttctctctcctttgtggtgctcaaattgagctatttaaatgattttatttagctgctaggaaggtgcccctgagaggtgggaaataactatgtgggttcattacccaggatattgaaaacaaaattttggatttatagtatctaatatattaatataccccatattcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgagtgttgtgtgacattgccagtgttctgaggacagtatcacattttcatctctatattaccattttaacaactcacctggggatttagtcctcatcggggcagtatgtgcttatttttacgtgcagaagattttggaatattttcttttttaaggagtttgctatgcatgtgtaggaagaatgacattattttctgtagactgactaggaagatgtgctattgaagtcgccttggggtagccccttctcagaagagactaatgccctttagctgagcaaaggacatctcgtttaagtaaataaaaatatgtcagaaaatgcaaatctagaacggaagggaaatttagaatggcttgcattgtttgttctttcatctaaacaatgagcgaagacgtctccatagatgcccatctctttctaggataagaaaaggaatagtaacttaaaaaatggttatacagcccttatgtaatgcaaacaccattctaaatgatcgtctcacacattttgtcttttggctctgttgaaagcacaaaaagtagtgtgttagctggactaccctaaaatgctgtgcagtggtccctcctcggggtagttatgttctgttttgacattctggagataaaatccaggaccccatgcatgctcagtaaggtcatgtgtggctttgtttgtttgtttgtttgtttgttttctgctcattatatactacacgttgctgtctgacacagcctttaacatattgaagctgtgacttctgagacttggttttaaatgctgttgtggtttctacatcatgtattcctaactctgatgtaagcttagctactacatttaaacgatgtttgagcagcctgtgaagagactcacgttaagactgaaccaaggcctccatccagctgttagatagctgtcagtcagctgtcctatcagtacatgccttagctcagctgtcagatcactgccacctctaccctttactatgtcatcatggtagaccctaagaatcgtccagctaagtagcatatgagttcttgaccttcagaaaatgtgacacaacaaatgtttactgtttccttctaatctttattgaaatatgattgacaatataaattgttacatttgagctgtacaatgtaaaactttggtacacatattgaggacatttgagtacttaatacacatgatggtttgaatgacagttttatgtaaaagccgagtttttctcccagacccaagttctgtgattcaaaatatgtataaaaacaccttggccataggctttggctattttctgaccatcttatacactaataacctatttattctgatctaagttctgccacatggctggtcacctctgctcagctcccatggttctgacctcctccatgttcctccgtccatcctcctgcctggctccatccctctgccaatcagatgccccacctcctagttcctgcttctgccacaggtcaatcagctttaattgacaggtgttgcatccatacagtacagaaggttttctcttcagtttccctcatggtctccagttgatggtgctaaggtaatgtgtcttgttgaaggaagtatgtcattggatgcgaaggtgttttatcccagcaagagaaaagaactaatacaatgtacctgcttcctatagtcacattttaaaaatgtttgctttaggtaacatacaaaataatttgatccattctgatatcttacacatttatatcttcattttgattcatcgtcctctctgtctcacccccctctctcattctgtcctcccatttcccactgacctcagtcggataccgtgtactttgacatcatgaatttgatatgcatatgttgataacatacctagattttgcatatgagagaaagcatgcaccatgtgtcctgagtttcttctgcttttaacatgatgatcttcagttctgttttcctgaaaatggcacagtttttaaactttatagctgaacagagttccactgggtatgtgtgtgtgccatattctctttatcagtcatgttaatggatatctaggctgtacctgtgttttggcctttgtgtacagagatgttgtacaggtatttcctagtatgctgactttagtccctttgggtttatacccaggaatgataacctgcatcatgaattagctctgattttctgcacccccccccttttagctcttaatttggagtgatggaactactaaaatctatgctctttgaaaaatatcaagtatatgacacattattgtcacttaggccccatgctgtgtggtaggcttctggaacttactcacctcagagatctgaaatttgttctctttaatcaatgtctctgttttatctccacctttaacctgtggtaactaccttctactttctttttcttttccttaaaaagaaacttttttattgattttttttgtgagtttcacattgtgcaccccaatgtcattcatctctcctttcccttgtacctaccctccacccttgcaacctccccaccaaaagagaaaaaacaatctcattgtagaagttgtagtgtgtcacagtgtaagtgtgccacagcttacccatttgtccacttgtctttgcttgcaaatgctcattgcagtagctcattggtctggggtctctgaccagttctgccactctcatgacactggggctagctattttgtcggccatagtgggcaagggatgagtgagaggaggagggcatcttcccctctcccacattgctccaaggcagacaagttgctaggttaactctcccatgctcacacccttggggctggctcacctgggccctgccagctctactgtgctgcccaggtgaggggcagggccaactctcccagctgctgctgatggtgaggagcagatctcttccttcccaatgccatcacagcaggcaaggggcagggccagctctcccacaagtatcccctccagccagctcacctacaaccctcacatccagggtttaactctcacattgactatgcagcccaggtaacatgcaaggtctgcttttccaagtataatagtaggtgaggggaaggaccagttctccccttctcaggacccaggggcaactcacccacaactcctgctgtgtcaagtactgcagctggctatggattaggtcagctttactgctaagaagcccccagggtcaactatcccataatgcccaggtgaggaatggggccagttctgcacagttctcagacaacacatccccaggcagcagaccagactggggacatatgcttggcctttgagcaacagacccctgctgcttcaggtccatggactgagttgtggctggcagtggtagcatagtccaggacccaccatggtcccaggtagcaacactgagcactcacatcagctgttccccaccaccctcaagtccacagttctgcctctcatcattgtgaccacatctttttattttctttttcccatttctgcactatttactgaggtgctaacctaagtatcagagtggccatgaaacttggattatacatatattcagaggacttaaaattggtgaagaaaaagtaacttagcaatatggcagccaccatcttggtgctccctaaggcattgctggcaaggctgctggcaaggcattaaagggggaggaagaaaatcctactgggaattgttttgcagcaagagataactagcccaagcagtcatgtttctccttggagtatttaatttggatccattgaagttatgaaacagatttcaggcatacacaatctgtgaatatttgttgctttatctttgaactagttacttttaagcctaattactttcaccatattattgagagagacactaatgcttgaccatagaatatcgactgtttgacaaatgtctggtacctggggattggccaaaggtgaattaggattaaggatctcatgtgagtgacaggactaaggcagatagtgaattgtgatgggtgatgaaagtactgagtgttaagaatgtatttagaggcttagaatcccatgtgagaaaagtggccaatacttctagtatttatccagcacagcatccctgcagaccatggggaggctgtaacatcacaaagcctgaaatctgggttgattcccaaccttggtccaaggtcttgaaagttgtatctttgatttttgatatgtaaaatggagagaatagctccagactcataataggatgaggagttagtgtcttagtacatgggaaataggtaggtccatgcctagttcttattaaatactgtgttatctattcttcttataaataatagaacctgtcatctatattaatatatatatacatatatatatgcatacatatacatacacaatcacttcagacacaaaacaattaatgtaaccaccagaaaaatttaaaaaatggactagtttcatctttgattttagtaaccattactgtatactcacatgtctatttcacagtatttaagctcagaatctcaattcaagagtaatagttccaaaaaactaagcaaccaaccaactgaaaaaaatcatgcccctaagactattgcaagtatttattattatttccttgagtgtaaggttatgttaaatatttcattcgttactagagtaacacagcatttagagttctcacagccgcacttctagaactcctggttgctagaatcatttttgtaacaatattttaggcatttataaaatattgaatcggttactatgttagtttatacatgctaagcatttagggaaactttaagcagaacttaattagaaacctagatgtatttcaaaagtagagatttaagttttattcgtgtaaacgttaatgtgtctttcacttattcctcaggattagtgtgcctgctgtgtcttcacttacaatacctgcagccaagtaatgctctgttacaggatgaccatttagaagcttttgaaaattcagtttttattcagataattagaaaagttactattttcttacagtttcttgtttattatgtgagagcttgcacacatatacatgttcaaatgtgtatatgtgtgtgtgtgtgtgtgtgtgtgtgtgtgtgtgtattcctttgtgtaagttcagtcatagtcatgccatggtatggagattagaggacaacctccagtatctgtacccgctttgcacctgttatgagagggtgactcttgttcactgatgcccttctagccagctggcctttgagccttccatcctgtttgcttttatgtgggttttgagactctgaacaaggattttcatgtttgcatggccagcacactacccactgggtacacacctaaccttctttctaattcatgttatcttaacgatattctgtacttttaaaatactcatagaatcaaactgggaattataagataatagtcattcaagcagatataagtgtagatttctatggactaattgaaataatttacatctaagtttataggccttatgaagaaaaagggttgaaaattaaattatatctatttacaagtttcatattgaagtaattaaatcaagtactgtatttgaagtcaagtaattttaatctaataacattattccacttttttgcatttaaacttgacaaaatgcttagaggtcaccataacggaaacatcggaagatgaatgcgaatatgaagaggtaacctatcagctttgtatctcaatgagttcgctatagtcatccctatgagtggttggtcttatttcctggagcattatagggactttatttaagataagctaggttttgaacagaagttatgtattggctgtgagctggggaaatgccttttaatgtgtgcactgtctaggacatctgcctattttggttccctcagcatcactgcttatgctcagctcctgtgacctcccttgtctatggctccatagatggctattcccacataggaaccttcccatcgtcctggctgttcttagtggggattgccaggttgccagtaccagttgaaactcaggcctctggtttcttctatccttcactttagctctgcaaaacatgctcctgtctcagcattttcctttaattctttgttctcatcaaaatctgccattacgtctgagacttggatataaagtcatttttaggtgtcagaaactgaacagagcaatgtggaagagagcctggcagcccgtggcttaggcaggcaagaggcttgttacttatacatatttatttgaactcggcaatgaaaagctttatttagaaagaaattttctgaaattaaatgtagatatgtttccttctgtttccatatcaacattagttaaaagtgatgctttttatttaattgcataatttacttcctcagtacaagatcctgtgtgagacctgctcaatattgtgccctatttcttgatttttagatgggtggtcaactatagtataaagattggtctggaaaactccataaataaaaaatatgtttaaaattactttattgtagttggttgttatgattgttatgttaatattatcatcattactgatttctggttttgtttgtttgttttgttttgttttgttttgttttgttttgttttgttttttgagacagggtttctctgtatagccctggctgtccgggaactcactttgtagactaggctggcctcgaactcagaaatccgcctgcctctgcctcctgagtgctgggattaaaggcgtgtgccaccaccgtccagccattactgatttcttattgtgcctagattataaattaaactttattgtatgtttatatagagacaatagtatctttaaggttggtaactaaacatagtttgaagtaccgttggatgtttgagaatgtattcctcatataggttggggactgctgtatgtgacttgacatctctgtccattcttcctgtccttggctagataccagatgacaatttcagcattcctgaaggagaagaagatctggaaaaagcaattcacatcattggagagcaagccagagacatccatattttggtgagaatttgaacactactctagctcatagtacaaagtgaatacatttacatgaagctttgacagtcgcaacatcaaattatgaaacagaatactatcatctgaaatatcttttctcttatattaacctttataacacccccccacttaaagcgagctttagctattctctgaaacatctacatataatgtctactcttacatgagtttccaacaactaataccttccctgagaactgattaatccaataagagattaaaccaaaattattcaaatctgatactgaatgtatcaactgtgtacagatcatgtaagctgtacaatgctttataagcattttgtgtcctcctttgcccagaagaatcaagaatatatgaaatgtataatgtttgataacactttctttcctgggacatgaactaatttgttaagaataaataagaaataatgtgtgattataatatgaattatagaaaacaagactcttgccatctttataatactgacaggaatattaaaaaaattgatcataatttagttagcctaaaaccacttcacaatttcataccgatattaatttaaaaggatgtgaagtttggctttttcggtggagaaggtctgttagactttgttcttcctatgttcatgtatcctctttgtggtgagtagacttccttggttttagaaatacatcgaatctcccaatactctctatacataacaatggaaaaccaactgaaaatgaagaatctgtgagttcacaagctattagatcctgttatgactgcagtgatgtaactcatggtgaagaattttgtcataaagtcggtggatacgtttcctctgggaagacagaacatggggaggcctacatattgttattagttggttggatatctcaatgctatgacttatcagaaaaaaattaaaacacaacattttggatgaaataaaagacatgattaatcaatggtcatcttgcctcttaatttatcattctattaatagagaccatgaactggactctaaataaaatgtatgtgtctcatatttaaagtgatttttaaaaacatggaaatataggtaatgctattgatctattagttatactttatactacagtttttccaagtgttgacataagtagttagggatatatatgcatatggatatatgtaggcatgaatgcatgtatatctctgtatgtattccttagagaaggtcagtatataattttacaaaaggaaagtcttacttacagtttagttgaatttccttatctaaagttttcttgtaagtatagtaaattttttataaactttgatccttgcttattttactatcttttgtagtatcaacatatctaatgattttcaatttttataaaacttagaattttgatttttaaatattagaataaaattatgtttaaatttctgacagtttggccttctttccttctttatcgccttctctgagacatttagatgaaagggatttcttgaggatgtttgtgccgttttttgagcagtgtaaggggtgactggcccctgttacagccttgtagtcacaagtctccagagcccggtggagacctgaagtgctgcttttctcactcatcattttattctgatttgtaaagtgtgtttattttccacgggatctgtatgttagcatataaaagctttattgtttgccaggtgtggtggctcatacctttaatcccagaaaagtggaggcaggtcgggctctgtgagtttgaggctagcctgcttttcacagtgagttccagcctagtcagagctacagagtaaaccatgtttgaacctccccaccaaatttttattgtagccagttatgatggcatactatggtggtatatgtggcaggagtatcatgagttggagcccagcctgggctacactaatgaaattttattgtaattattttaagagaaataagtacatatttcagaatttaaattttcatatcataactcttattatagctcacataaacaatctgtccggagtcctctatcgtttccaagagtataatagcatgctaaataaaaaagtataaaaagccccctgggcgtttctaggaactacagagaatgcatccctttagtatgtcattctatttctccgtttttcccacttccttctctcatttatcttatataaaatgactcttcacatttattgaaaagttatactctaaaatattttcaattactttaagaattaacaccagaaaaagtgatactttagtatactgaggattaaaacctcaggtattgtgtttgctatgccctggcatttaaaagctcatgtcaaaataaatatgtgaagcaattttaatagttatagactcaatgattaaatcacactgagcatatttgttattgagttcatttgttcttgatgtatacatttaacttgaattaaataacaaggaaccatatggccaaagtctggaccatggcttatccatgccagtataattgatgttatatgaattaaggagttgatggagtgaaagcctaaataaattgagttttatcttttaagactgcttgggttgtaatataactctctttactcactagtaaaatgaacattagtttttaaactcattgactctacaacatttaaaaacataccagcgtactcctacatgactcagtgcttctctgcaatttaatagttgatgagtttttagatctgtaaagtttgtacactgaggaatcttttatacttttcttctctcccacttagcatatctttgatcaacagtctgtctctttttcttaaactactaccttttgctcattccaaccttcctttaatttccatctaaaactatttccaaatgaaaatgtcaagcttatgtcttatgttttgaaatcttcgtttttttctagccttccacttaccatttggcttccaggctagttttccaagcatggctaagtctacctttgttttcagtaggcttttgggtccatgtgagtagactactggtgtgtagcagcctcatgggcatttttagaaacttcaaagaatgccctccattttagtgtgtttttctacttttgtagttttcccagttcttatccatcttatatagaaatggcttttcacatttattgaacaaaaaggtgaataaacatttattattatacgatgaatgattatttctagaaataatattgagccctatcgtagtaattatgcagcttttctgttgtagttattattatactactatggcatgacccttgtcacacggtccttagcttctgcagcaatcctcaaggacattaattatggaggtttagatagttttatgcactgtttaaaaatacctttatgaagggtagtccaagctattgtctctaattaatcaattaaacagtatacatttataacaatttactttgaaatgatttatttttaattatgtgtaagagattgtgtccgtgtaattatgtgcacatgagtgcaggtacttgtggagggcagaagagttcatataacttttgaagcttgagttacaggaggtaacctccccacatgggtgctgggaactgaacttggggtcttctggtggagtagcacatatcctgtttgtggggcccaggatgtggggaaataaaggggatgggagagatgacccgcgtcccgccagagctcctgggttctgggcgggcagactcaggggactgctgcacactctccatgcagcctgggtggacatctggctgtgggaagccatggaaccccagttcacaggggtagagagggagcagtccgaggtccctggactttatgaaagccagggacgacaggttctagctgttgggcatctcaggactttgattgacagcacagaagagctgagaatgggtgggggccccaggcgtggctcggtctgtgctggggccgaaggtaaaaggggctaggagagaaggcactgggtggttcccactcgggctagagtcttcggtacgacctggcagttggaaatgctgagaggccttcccaacggagattagctgcaggagattagatgcatctctttaggggaaggcctatttcatcgctccagcatggcggtgagtctagatgaaaggaggcagtctatggttttagagctttattgtagaaaacagagagagagagaaaaggtagagaagtagaggcccgccatggccatgtggagagaggggagaagggaggaggagagagggagcaagagggctagagagaaagcaagacaagcaagagagagaggattggccaagcagcctcttttatagtgggctgggctaccttgctgttgcagggtaactgtggggaggagcatacctggctatgggcaggtaactgtgggggtggagtctggacagactacatgactgatggccacagaatggagctgggtccttgtgtcatatgtttgggagcatggcagatgggctttccatctcttgcagattaatctgatgggtctccagggtttgaacctagctcaaccagaaaacaggctacctttcatggtcccacgcctgttagccattattattaattttttttttgagcaattgtcaacattttttttaatttaaaattttacttcaccttgccacttcttttagtgtcagagcaactactggcaatgagaatctgtcttcaattttgcacaaggattgtgaaagggactattcagaagtatggggatccttcttcctcaatgcatttctatattaatatcctttacattctatgtaacatttctagctaagaaagagaaataggaaataagtatactactgagtttttgtaggcctcctttcccaacaatcagtaaatgaactagtgatttctgaataatgacttgaagacagtggtgggtttatagttgtagctttcttgtcactgtgacagaatgcttgctgcaaataacctaggtgggaactgtcaaatatggaagggaaggcatggtggaacagctcacataatggtgggaaagaagcagagtttatccctactttcaaggggccaggccagataaagccctctaggacatgcttctggtgacctctggctttaattcaggtccctacttccaaagtaccatcccctcttgacaatctactcatccatcttgtatagttttattctgttagtgaatagactatttattaggacagaggccttatcattttgctgtccctggaaacaccctcacaaatattacctgtctcctagacccttctcactctcacctagttgacaatcaaccttaacagtcactcaacccaatgcacttatatgtgcttttagtgtaattttatttgttatttttaaaatatctccatatttctcataaaagtactgaaatttgttctgtcacagtagttaatattatgggtctggataccttaagtaactattcagaggctccatgcagtatgaatgttattgtggacagcatgctgaccaaaggccaatctctgctgaggtgctggatccattcacttccattatgatggaatcctagtacatgctcctgccatcaaatgctaatcctgttggagtattttgaaaacacaaggtaccaaaattgttatattatttagtaatatttgaaagagtcaacaggtctcttcatttcttttccctttgttattcagtttgctctattgtgccgaaaggaagagtttacctctgtgtagtccttcagagggcctaatcttacttttatcatagtacctttgtaattgctgatgctgtttctggattaggtatcagattgtgttcagatactccttaacccagtattgttcatagtttagaaggacacattcagggttagactggtgaaatcttgaaagttcaaatccccaggatacttgctgtcttgatgttgttactattgctgtgataaaacactgatgaaaagcaaatttggggagaaattttattttagcttacagttccacatcacagttcatcactaaggtaagtcaaggcaggaactcaaataggacaagaacatagaggcaagagctgatgcagaggctgtaaaggagtgctggatactggattgctctttgtggcttgctcagccaacctttcttatagtatccaggaccaccaggccaggagcaggaccacctacagtgagatctgagtactcaatggcttttctagtccaaagtttaaatgctaccatcactagtcccccaaatagtctgttttgtcatagaaacttcctgctcccagtaccaatttctgttttatttagggattctgttgctgtgatgagacatgatgaccaaagaatcttgagaaggaaagggtttgtttaatctaacagcttgtattttattatccgggaaacttaagacggtgacttagacaggaacttggaagcaggagctgatgcagaagccctcaagagtgctgcttacagacttgctctcatggcttgctcaacctgattttgtataccatctaggaccacacacagagtgtgtgccacccctatgatctaagtacacccacttcaattattaatcaagaaaatatcccaaagccttgcccactggccaatctggtaggggcacttttcttgattgacatgatctcttcccaaatgattctagcctgtgtcaggttgacttaaaaaccagcccgcacagttgtccaagagctaatcatgtgctaattatatcccttcatagatctccatgcatccttcaaaaagctcacgtcatcagaaaaggcaagaatctgacagggttagcagctttctgaatataagaagctgtagtagtggaaattggtccagcatcaccgaatagtgaactcttctttaggatttgattgctgaggaacatctatgctgatttcctgctaagtaagacagagctcatgtgtgcttcactttggctggcacatgggtctttaggaactgtcactacttttaatgtttttatttttaagaattatttatttatggtatatgagaatactgtagctgtcttccgacacaccagaagaggccattggattacagatggttgtaagccaccatgtggttgctgagaattgaactcagaaccattggaagagcagtcagtgctcttaaccactgagccatctctccagccactatgtttattaagtcagctatatagaatccatgctcctgctgtgtcctaaaattctagaacacatccatttatttccatattagtaactgaagaaaatgaagcatttcacaaattattactcatggactgtgaaatttgcaaaaataaaatgaattcaaattgaatcaccaagtcataacaaaagatttaaaattagggaaccaagaacgaactttaagaagtcatcaacagcagatactcacacccaaccttcagattgagcccagggaatgaatgagctaggggaagaactgagggagctgaagggggttgcagccccataggaagaacaatatcaactaactgcactacccagagctcccagggatgaaaccaccaaccaaagcgtacacacacagggctccagggctccagatacatacgtagcagaggatagccctatctgacatcaatgggagggaaggcccttggtcctatgggagtttgatgctcaaatgtagggcatgctagtgtaggtggaagtgggtgagtgggtggaagagcaccctcatagaggcaaagaggagaggggagactgggagggcatgggagtttgtgcagtggtaacccagaagagggatatcattgaagtgtaaacgaataaaataattaataaaaaagaggcaccccctttttttttaattaaaaaaaagaagaagaagaagtcatcatcgtttgttcttttgtgttagggattttgcttttttgtttttttcctcttcagcccagcatgtttccaggaatgttgatgggtggattggctccattagatggtaacaaggaaactttcatttaaaaatgggtcctttgtttgcattggccttccttcctgatgacaaaattctaggtatgatgcctgaagaagccagcctagttaccgcttggtttgaaatgtttgtgtgaatggcaccacgtgaagacactcacacggtggtgcttcggtcagccagtcattagtgttgtttctgctgggcctgtggtttggatatgtgtgcatgctgagtggatttcccgtgtccacacagcgtggaagcattacttccaagatgcacaaatggagtagtggatactcatcttagaacacaatgaatgttagaaaaatttcaaaagcgcaaagctgtatggaagatgaatgtgaatatattctctgaggagtctcgtcctgaaggagggagagcagttatttatagtgttgcaagatctcaaaataaagttaatgtttgcagatgtacagccactctgaaggactgcacatttataatcacccacaatcttttcttctaacaaacctttttatgacttgaagttgtgattagtcattttagttcactattttttaaaaatgttattatattttacaattttctctccactgtatctcacgttcacccaatttccacggttggaggtataaattgtgtaaaatgtttatgcatttaaaaaaaatcggagtgcaaaaatgtgtttgaacatggatgttttgaatgtgaacactgtacccagagctctgagtgtcctcactaaatgaaggggtcccttttgcagggctgtgttagtgatggtaacatttctcagctctgtagttgattacagagtgtgattaaaatagaccctggtaaataatacttgagaaaaatattgttaaaaaactaagtaagtctattgtttgcttaataaaaatcttgatgtttatggaataaataactgtacatttaaatttcaggaacaacaaaccattcttcctgcaaggaatgtaatgcaggaagccatagaagattttctctgcaatttcctgatcaaaatggggatgaccagaactctggactgcttccaggccgagtggtaaaccattatgtagataagtagtactccagaaatgctagcagcgtttacatgtataaatgtaacgttcttgaagaactttacagtactgagggcttcagttttttttcttgttgctgtgatacaatataaaagcatctaaaagaagaagaggctcattgggggcgggtttctgttacatcatgtttcatggtgccgtccatcgtgatggggacatcaacacagctgtttacactgcatctgcagccaagaagcatggactgttgaatgcatgccagtggtcagctcaccttctctgtttgtccaggatcccctgctacagcacgattctcccagagccaccagtgatataaataatgacacacagacattttaatatgtgagaagctttgatcttttagctagggcggtatcctagctactctaaacctaaccaaatggatcctggcactgctccctgcagctctgcctctctgccccactctggtctgtcagctttcctccacgtccactggcagaatctctcagctctgcttcttccagcagcgtccctctctctgcacaactatggaagattatatccttaatgtagcaaatcagatacacttcttgcttgctttaggtaggtgaggaatgactatttacagaatatgagactagtgatggtgcatagagataacaataccaagcacttaccagcacttagctctctgcagttaaattattaaaaagtgaatacacagagacaaacctttacaagatgtaccccaacatcctgctcggtaatggtctgtctataattaacatggatcttcctatatgaacacaatcaaaataattgtacacaagcatatgcagaggcccatctcctaggtgactgtagactccgtcacctttacaattaacactatcattgtgaacttatgtatatgaatagaaattgttccagtctccatgttgacaccacattaccgacactcaactgtcaggggatctttcccagcaaagctttatgcaatagccttctcagtattcagctttagcttctcttcaaatgatcaaggcaggaaaatgtcctctggagttagatagcaaaaagtcatttttgaaatattttcctcttggttttacataatttataccggtatcttttgtatttagatattcccctaacactactacattattattcatagtgaaaattatttttctctatctatacagttgactgattcttattataaaaatagtatttgatttagagcaaattaaattgaattttcaaatattaccccaaaataatgttgttgttaaaactaaaacctttagtgtctgattgattatgaaaatcagcaggcatgctatctttgtacatatattatcatttaatgatcgttgggttcctaacattctttaaaaaatagtgaatgatagataagaaacaagtgttatttttaccagatattccatattatagaaagtggaatttatataaaattgcttacagagttttgtggctcaattgtagtttaagaaaatgtatcagtaatacaagtttacctttcattttctttgtatactgagaatatatatgtagaaatagtttttttttatttttaaatttttgtaaatagcgtttttgcaaacatttgtactgtatgggcacttctcccaactccctcatatcgtccagatttcttctcaagctttgttacgttgcatatataatatactgcattttatgaggagaactgagttcttgcttgctctgtagcttatgctgaccttctgtgcatagctcttttgtgttagcctcccaaatactcatgattcggtcagtattggctgaatgtgttttaattgtagaaaaacaaaacacaaaaaatatagaattgttgtgaattcatgttctcttgtaaaagtagcacacaataccggcctgttaggaaaaacagaaaaaagctaacaagaatctgggcactaatttgacttacgttctttcaatattcaaacagtaaattcaataagtcttttaaatttagtgtcagaaagatatgatctggaagccacaactcacctgcttttgggttttataaataacattttactggaattcagctgtgatttcatgtacatattggaaatgactgaattcatgttgtaaaaggaaattttaattagtcacaagggtgtccatgtgactggcaaaggaatcattttataagttctaaattattagtattacagatattccaacaaaagtcctcaaattactgtgtattatatatattattttatatgatctaaatatgtcctatgtgctttatataatgacacatataagtatatatatgtcaatgtggtaagaaatgtatttgtggagcactaaaatgcttccattgtaggtctgttcaatgctggcttgtattcttttagaagtactcacatacaaagttaactgatggtttaaggcaacattgaagagattgaaaagagaaaagggcagtgtatgtctgaaattcctcactgctccgtgtgccagaccgctgtctgtgagcatgatccattgctcacatggagtctgtctcatggacttggtggtttgtgtcaccatcaccctctgactcaagcacaatgccttctccttcttttccagtcctgggtacaattcagtttggcctctgttcctatcatctcatcgatgatagagttgtgctaaaaattctgctcagggtattaagacatgaaattatttatagcatttaattactaacctaatttgtaccaaatgaaagagattataaattagtatattcctttaattgatgagcaaagataaatactgcagcttttgactaataacatttggtgtgactctggaatggctaatatagtcacaacttcctgggattgagtaggtttatttaaagctaaagcccagaattaagattaactttgaaataatcccttacactgctctctctgtgtgtagacaggtgtgtcctgtgattacacagcgattctcgggaaataccatgcagctctgtatttctccattatttaaactcactgatgtttcttcagttggtggagagttgatttctgggactttattgtccccatcaccattaaattaaacacaggaatgtcatgacaccatgcttactcttacgactcacagtatgccaaatttgagcagttaaatatatgtggataggtttatatactgagatatgcagaagtcagcctttcaggggaatatttaggttaaacagtcagtaaaaataaaaaatacactatataatgtaagtggcataaaataattaaaatggtgatgttttggactgcttgagaaatcatgttccttcatttttattaacagagtctgctcttgcttctcccaacagcgggatgtggcaggtagctgcttcatttcatggatgagggcttagagaggatgggaaatctgagtaaatggcagcaagtcacggccagtgggagagtcagccaggccagactgatctccagtaccgctctcctaacctcaattcctgaacagagcctgggcgagcttacagtgtgtctcgatttagagctcagatttgggtcggtttccattttgtaattacaaggacactactaacttcttcaactcgatggccttgtttggctttcatctatttcagcactgaaacctttcacagtggctttcctgttgctacttccagtgatggttccaagattctgtcagtgtgcacttctgttagtgttcatttcttctttcctgggatttttcttcattcgagcccttggccattgcttttgtggtttctcttgctgcctcagccttagtttcttctcatagtgtttgccttctccactcatcccaatggtgagatagtagagtctattctgaatcagtcgcaggcaatttttattggttggtcacatcattacccgaattagtctgttctagtgtcacaactatagcaacatttatatgcaggtgaggtgagagtttaaattgcctgcctggactttcccctaaacttgtgatgtgcctctccagcatttatcttcacataaatgtctgctaggcccactataattgatacggatggaaacaatcccttggtttttccaactgcctggttcctactgtctttgcttccacagtgttaatggctgttactgagctccagacctggacgccatcattgttaacacctggcagatgattcattagagaatcctgttagtgttacctttacagcaagtccagtaggtgcccttcttagaagtgctgctgttttcacgttgttcatcttactgttctccctctttcaggatgtcatgtgttcctttagagtctgtctcttgaaatagatttacccttttgaaacataaatctgatcactgcccatgcccatgcatcaattcctgatgcagagtcaaatgattttccatatggtgccttttgcgttggttctgacaactgtcagcatctcctttgttcactcggttggctccagtcctgctattctgcagatgctggctttatgcctctcctatacatgctgaacatgtctatatctttgggcctttgcatttacgttctgtcagagttgctccggtgctcgacttccacggacccacctgctgtcatcactcctctccctctgctggagtctgtcactcgtgcttgccagtcatggctactctgtatgaaacagtgcaaacacccgccaccttacttctccattctctctgttcctagaacttattaccatctctgcaacactgtaaagtccacgaacacagaagacagttttggcatctttgctaggaattagatgtgtggaacatacatgtcccattgcattttaaaaatctaaattcactgatgttccatcttaatatattaatatttgtttaacttataaatggaatatagcaactaacttttatcaaattttccaaggttgacattctaaattaacacggtcaaccctgttgtttgatttgtcctaggtatgagttaatacagaagaaaggaagtgactttaaagggctcggtaatgttcccgatgtctacagccaggtgatgcttttagagactgagaacaaaaacttgaagaaggaattgaagcacttcaaacaggcagctgagtatgttaagattgtgtttccctttttttatttaggctaagtaaaactaaagatggattaggatgatacttgtaacccactctgagaaacttaattctgggccattgaattatcttaagttccagttgtcaggacgtgtaaagcatcctaggtgagtcgattgggcaggtaactggagcccctgccaagcacagctcaccgatggagtgggacgcaagacctgtagcagatggggaatttgttgcacaacggctattttcttatgcgtgtgatcatgtgttgtggtctgtgaaattttctcttgtgtagataagctaatttcaaaagtaataatgaaattaatagaaagagtagaaggagccaatgtattctttgtgacatactttcagtagtttacagtccttcccaaagaatagtgttaactgagctctttgggtggcaataaatgaattgctctggtgggacaggcagtgcacatatggggagggggagacacatgggacttgtaaggatgctatgattgagttttctgtaaccttgacattttctctttaatgatatcacattaaaaaggaagtatcaacatgatagtctttcttccaccctctgccacccacctttacacttttgttctagtgtgcatgcacaaatttgaaagaaaaagttcagtgctgttgctgtcatatttactagcttacttttaagtcaaaagaagtaagaaccttttattctgttattttacttatattggtgttaacatagattttattctccaaacttaaaagcagtcccggaaagggccttgattgctttgtaatgtctaggcacagatgagtatcacagccacttaagtctaagttttcttttccttttgtctccctaaatttaaaataaatgttggtgactaattttcagtaaccagccaacctgtttctgaccaagagctgagtgagtgtactgagatgaggagagtgtgtgcatgtcagacagcaccttcagctctacagagaactcatgatttgttcagtgaccacttcaaacattttgttttaagtaggaaacagatttaagaagaatctttctctattaagcacatcaacacaataattagaataatagggccaccttgtggaagtataacatgtatgtatgtgtgtgtgtatacatatacatatatatatgcatatatatgtgtgtatatatgtatatatatgcacatacacactaacgaaacatgactatgtattgccaagtgagagaactatttaatatatttaatatagcctctccatttaacaagtagcagtaaaatgacagttttcacaccttctgcatagtaatcctgtgcatccatgggagtgctctgctaattaagcacacctcaccttttctatggcgaattttatgtttgacaaagatctgtgtgatcatccgcaagaatatgcttctatgacctttgccagtggcttccgttcctcgaagggctttccactctgcacctttgcttgctctgactttaatagacagtttggcgaatgggaatttgatgcaagccttccttacagtgctgcctggaagagtttcagccctcatctccttttagttcttgctttcatttgctaatttgctcttgagtagacacagacattttaggcaatgtgtttaactccaatagtactaagtaaccattgatgattacagggtatttatttaatagtatattaaaaactgtaattaaaattatgtaagcttttattcatgcaaattgttattttaatgttaaaagaaggcatcattaaaactggcatcgtgtgagtgaaatgtttctttggagttgctgaactgtcacagtgtagtttaccctcaatggtttctggctcttgcttgattctgtggcttggcaatgtttacaatccagcaagtggaatagcaaactggctgtgtgctttaccttccctttagtgtcagtctgaaagaaaaccctctgacccttagaggatgcccagtgcttgctgagtgaatcttcagtctaatgtggttctgaagcaccttctgttgaaatagtccctggagcacattttacagaaatactgtcagaaaattgtgaatgaagttttgcaaagtactctctggaaacacaattcatgtatgtttgttccaaaatataatcttttggaacctaggttttccacaatctatttttctaatagcaacttgtgttaaacatgagcttctttttatggaattttgttgaatgcttacatctttaagattaggctatttcttaaggcttggtaatcatagatgtgaactgatatttaatacgtgaagagaggcagcttgtagatatgccatatggcatctttgatcatacaggtagcatttaatgatacattgattaaagctgggggctaggtttggccaaatatgcatctgtaaccttgtgtggtgatgatgctgggaggcaggaggattgctgcagcttcattagagccaatctagccagcggttcccatagcacaagtaaagaccagatctatgagactaaggtatatatagagaaggacctcctctggtacctgtgtgcccacaacattgccatataacacacatgaaatgaaagggcatactgtgcaataggaatggtgtagttagtcttcactgacagtatcaatgaatgtagaattgccacaaacacacctttttgtgactatgtgtgtttcaagaaagatttaactgagccgaaaagaccctcatttaatttgggcagcaccatcctatgaactgggatcctagactgaataaggaggaggaagtgagcatttatctttcacagcttcctgcctgtgcacacactgtgcatacacagtgcacacactgtgacaagccactcacatgcgtactactctctttccttttctgctctgactctaatactatacctgcaaacttaaccctgataaactcttcctttttttaaggttgcttttgctaggtgtattgtcatagtcaacaggggaataaccaatgtagaacattggtaccatgtttgtatttggagagtggaatccttgctgtcgtaaacctgaccatgtagtggctaagctttggaaatcatttgaaaactattttgagaaatgtggaggactttggagctgtggcccaaaggaggcctagactatgataagcagacattaatgagcaaatctcttgggagcttgaaagtcaggcatgttacaagacatacagagagtggagcaaatctcatgaggttttcgaggggaaatcaaatgggaacttgctagagtccatttattttacattttggccaagaatcttgtttacatctgaatcctaagatctttagaaactgaattctgaagtaatggactgccttgtttggtggaagaaatcttaagccagtatagcacttcagatgttatagttactgctgtctgatcttgctcaggactatagtacaaggaacacttacagtagtatacagtttaatgaggaaagtggtgtgagtctagagttgaaggcaaagtgagtggcccaattgtacatgcgtttgatgttgtggcatgactttttcatacaatgttcatatttgagaactatgtaatttagttataataaaatctcaatgttttaagggagtgtattttttttccctgttgggtggtatttatgtctaccctctgctctctgctatgttcagtccatggtgaatataatagcatctgtaattgttaaagaggttatccttatcaaagaaatctggacagtactgggacaaaagaaaaggtaccccaaaggcaagacttgatctgccacagttccagcttgtcaaaataggaacccatttgtaaggagagacccttaattaagaaagctgctaatggttttcctttcttccaaatagcaacaaaggaaaagtgtttccctaatttttttctttttttcttttctttttttaagacagggtttctctgtgtagccctagctgtcctggaactcactctgtagaccaagctggcctcgaactcagaaatctgcctgcctctgcctccaactgctggcattaaaggtgtgtgccaccactgcccagtgtgttttcctaaaaatatctttgaagaaataaaaagatgcttctgaaaaagggtctgggttacattttgacctggcatcagaacttgagcatgccatctacatggtgctctctgtgcttatgccttttgtgctttttgatatacacaaaggaagatgaccatagaggcttttaccatggtttcagaaagtctttaaagccaggcagtgtaatgaagagcctaggttggtactgatgccagactgttcagtacccaccagggagaccttcaggtgtagagtagacttgagcccagtgagaggtcactgtgctgtagggggcagtgctggaatgatggagctacagaagaccatgggacctcagatgatttcatccacagttccagatgccagacatagaattgaaggatttggtgttttacctacggggcttccttcttgctttgatccagctcttcctatcttcctactactctcttttggagtgggaacgttttttatgtggggttgtatattggaagtctgcaacttgattttacatgggctcacaattaaaagattgtcttgagtttcagaaaggagtttagagattgcattttgaacagcattgagtctgttaataagctgtggggacatttagagatgtactaaattaactttgcattatatgataaaaataggactttagggaccagaggtagagagctccaatctaaagtgatgagctctggtgtcacgctgaccagtgggtgcagttgtggtagttcaccttcactgccaactttactggaattagagtcatgatggaactgcacatctatgtatttctttagtccaaaagtgtttaatggaggaggggagatcttgcctaagtttgcatagcagtatcccatgagataggatcctgaactgaatgaaaaaggagaaaatgtgtttaagtttcatctctctctgcctactacagaaatgatgtagacagcttgctcttccttcatttttttgtgcattgattttatatattcaaacatgtcagtgctggtaagatgaatcattaaggttctgttagctccttactggcagtgtgtgagaattctatactggcagtgtgtgagaattctatttgctccccaaaccccaaaagagaattggtagttttttctactttagcctttactcgatttgatagtgatgtcttgtggttttgatatgcgatttgccaagagcaggtgataataaatgcaatattttgtgcttcttgtcccctttgcatttttggtatcagtattgccctttcatttaaagccatttgcctaattttgattaggtttttaattttgttattggattttatgattttttttctctttgagatactagacactttgtatattgtatttcccttcagactgtggttttacattttacttcattactatgatcttttaagagatttgattaaaagacttatatgcatatctgtgtgctgtggtatttgtatctgggttcttccctcagatgtgttggttatttatagattctttgctttttcacataaaatttacaatcaatagaaaaaacacaagtgaggtctagactaataagggcttgaacatagatctcgctagtgcatttctgtgtgtatgtatatacatacatcttatggagggagaggtcgatgccttggtaactctgagtcttctttctgcatggcactctatatagttatttcagtctatctaatagtaaatatttatgaaacatcttgaaatgtgcacttttcacattgacttaacatctatgtgcttcatgtaatgaagggcggccctcctgactgttgtcccaggcagggcctgtcattgtgattttgctttagctgcagttggtgcttatatgatatgctactatactttatgtttactgttaataatgtttagagtagttgatgggttttatcttcataatacttttgggattaggctttgtttccttcccatggtgggaatttaagcaactttttctaaggataaatgttgttccatttagaggattgttttctatttcagaatctttacactaatgaaatataatgcagactagaaaggctgtataaagagccccaaatatgtgatggagaaatactgagaacccaaacagaagtgtactcttcttaaaacaaaacaaaacaaaacactttattaccttctaccaaagagtacaggactaaagaaagttaaaattaaatggcaattaatatggagaaaaaaccaaaacaagacaggtgctttcttaaagggccctgattttgagtacaaaattcacttctataaaaggtcaaagagtgtccagctttaagaagacccatttaatttaatgacttttagaaacaaacagtgtgaaaataaagataataacgaagcccataaaatttcatgctttagtgtttaggtaattgcttgttaaattaagaaggtattattttttttctggacatggctatatcccctccttttgcagttaaaaatataatgaagtttttcttctatctggctgaattccatttggcccttcaagaattattccaatattaatttttgtgggtcagtgtaattcatttatcagcaactgaagataatgaaatacttggtaattatataattattgttatcagtgagaaaaatgtgtggcaaggctggtctgctctggttggtgcaagtaaacacatatttctacgttctgtcttggcaagttatgatgatgatgatgatgtaatttaacaacttcattaccaaatatccatccccaagtaattgcttaaatttattataaaattgctttactgggactcttagcttaagaatgatttaagactgtgatactaaatcacattcatgatgcactgaaaaattgagtttcacattatgctaagaatacacatgtcttaatattatgtaactgaattatagatgggtgggttccagtgtcctaaaatggggaggcttgataattattgtagcgtctcattaagacaaggcatctatgaatattctctgtgatacacaagtttaaatagacagtttcacagaatagctcttcattgtacatgaacagaatctcagtgtttgctgtctatgttaataaacgttttttttctcttagcacaaagatgttgtactaatgtgatgagcagatatgatgaatttaaaatattaattgttcacatgaatattttatcctgttctttattccaacttctatttccttttatttagcagacaggcagcaggaaggtcataataagagaagcatcagcatgaaatgaatttaaattgttttactgagtagacttcatttgtgcaaacagagagcaagtctctgaaaagcaatttaatggtcagaaaaactttaaagtctaatacttcagtcaattcctatgctttatttcctgggacgagcacagataggtttctaaatgtgtattgaaaagtgaggtgcagtaatgcttcacatttctgattctgctgaggggcctttgcagtatttagtcttccaagcattctttaacctactgagaatttacatttcagataggagaagtaaagtatatatttgtggaattaattgagtgactaagaacaagactgtttcaatggactgtttaaaatacactttaatgaatgttaattttaaaaatttgttttaattttatcttatgtgtaggggtattttgcttacatatatgtctgtgtactgtaccaatggactccaaaagagggcattagaacctctggaactgttgtaatgaatggtggttagctatcacctggtgctgggtaaaaaacccaatttctttgcaagagcagtgttctcttaactgccaagccatctttccatccccatgtttattttcttaaagatggatagtattaattgtatactcatatcattggaaaattagaagctatgtaagtacctattgccacacaccttattttggaagacaagtctcttagaagatctgagtatatataactcatctgttatgctaagtattaattagttttgatcatgaagattgcagtggaagtctatgagaaagagctgataggtgagttcagaatcccagccatcctagttgtccagctggccttactcaatattagtaatttcaaaatctgcccaatcttgggtgttcttgtactttccttgaccatagttcatatgattgtgaacagtagactttggatatttgtgtgtaagtgtgtatgtgtgtgtttgtgtgtgtgtatgtgtgtaaggcaagaagccattttactgtctaagtgggcactctctgaggcctattacacatgtattttgcagttgttaactctgatatattcatagttcctataactccaaaggttgcattgctatgtagaaattttctatggcttgttgctggaaatattaaaaattgaattgtcatgttcttgtcctagtgctgccaactctctgccctggtggcctggctggccatgaaccggcaagcaatgcccgaccgacctgcttttatctcatagagactctgactcagaactccacaatctctccacccaggttgctaggttcccactggtgggccagctccgtgcttcaaatcccctaaggtctttgtgttgtacctcaggcaaacccatgctttgttgcccttaattttctctcttgaatccagatgagcctccacgtgaaggaaaacacaacacaaattagttcagaaacaatggtaactcaatctctgggcacaacaactaaaacctaatcttgtaagccttattaaaatctgattcctgctgggcgtggtggcgaacgcctttaatcccagcactccggaggcagaggcaggcggatttctgagttcgaggccagcctggtctacaaagtgagctccaggacagccagggctatacagagaaaccctgtctcgaaaaaccaaaaaaaaaaaaaaaaatcaaacccccaaaaacaaaaaaataaaaaaacaaaacaaaaatctgattcctctggagggagaatccttgtggattcgccatgataccttgaaactctagcagctacatcttatccctctgctatcctcattccaaaaggacctaactctctcctgcgtcctctcttcctccatctaacctggaaataatgcctacttgtccagtgattgactcctttattcattaggcgattggttcactggaagccacctgagtatgagactctttcctcattccagacagcctctcccaggagagtggaattaacataacaatacaagtagcacagagccatccacaacattggccgatgtcatctcttaatcatactaaaactattttatccagagttgaacccatttattgcttaattataaagatttaacacaagaattttaaattgaatttgttttctggtatttccattcatggatatagtacctacttcctctttttgagagcaattccttatatacacattttcatgtttttaatataaagtaaaataaggttttgcctgtgtgcattcttacatttcacaacaaaatcccaccacaagcatttactttaccctctctctgcatcctcatacttactatattttcacctactactcactggggtagtgtgaaaaccaggatgtggttttgtgcataaaagacagagttgtaagactctaggatgtatgatttgagcaagttacatatgtagccaccagctggagataaggatgttctttttgttttgaagagtatctacaagatagcctctggtgggcttacctagcaacaccactgcatcacctggcaacatagcaaaaccatgtcctaaggtcccaggttgagtaacaaggagaaagccagctgagcaccaacatttcacttgtcttggcttcctgactctaaatgcaacatgagcagctgcccttccgtcctgatgctacaactttcccgctgtggtgactgtgacatctaattatgaggcacaatacattccccatctttaaactgttttgtcatagctaaaaatgaggaaagcaactgatacacatgacttcttgggttttgctatttcttcttgtagccagtatcacacatatttgtgcacatggtcgaaagctgtaaaataaattaatactcaattattgttcatcagataagttacaaatatgaacatttgaatcataaattactgtgcataccccaaagttggcatgaatatgaagttgaagctggggtggaagatgatcattgttagtgttgtgtttattggaaagtgcttacttattttatgtgtgatgcgaactcaaaatttcttagtaaagatcaataaagcttatccaaaaaggaattgaaagattagggagaagaaagttagattcattaactctttgaccacacaccatctataattttgtttgatggccagaagtcctactgatcaacatatgttccatcaggaacctggagaccttacccacaaaattccttggcagtgccccagacactgttccttacagaatcttctgacatagcttacccctgaagcttatctgtgtgcatttatgtaaatctcaattttgtaatatttgtgacacataaaagtatatttcctcccttcagatcctaatgtagtgtgtctgctatccaggtcagttcatttttttcagagtgagaaaagctcaaggaagcagcatgttgttagctatccaatatagataaagagaattcatttgttgttgttcattataaaccatcctttacttagactagcctataactgtagtgagtgacatactccagttagtacatcacacagagctccactttaaacagaatttgcattcttgttctattcaaaggtttgcacgtctattcagtataggaatagttctattttgagtgaattagaagtatgctcaaactgtaatagttaatttttttattgagaattcatatatgttattaatatctgttctcacaaagattatatatatatatatatgtatttctgatcctctgtgtgcatatatttctcatctaacaaaacaaaattttatatttttagaatttctgtgccttccaatctatcagaagtaaatgatccagtatgtaatttgtcctaaaaagtggagtaagctcccttcttttatttctattcattgtgaattactctgttttatatgtattttaaatttgtaagccaaaattctctttggcaataaatgtgcactgtgcacatatcttgcaagcaagtcttcaagcttgattttaaaattattaagcataaacgactcacatttctgaagtccaggctttgtcctttcatgcctcagtgatgtagagtaagaccccgtcccccccacccccatgcctgaaatgctgggctctcagcagagtaccatatcttctatgctactcagttattgacttactcactctttgactcaacactaagtgcttttctcagtaagggaagacagtggttttgaaagttgcttgcattggtgtttttcagaaaggccaaagaagatctactgagaactcagaaggaacgggacttccatcgcatgcatcataagcgcatagtgcaagaaaagaacaagctcattgctgacctcaaagggtgagatgctcatgtgcattgactagagtagggctgttgaaataaacttgttcctttaagtttattgggtaggaagtttaggcccttgaattgaagccatattcacactattaaggtgtgtgattgagaagttaaacaaaaatatgagaaaatgtactctattgttgctttgtcattcaagacacagccttggtagtctggtatgagcagaggacctcaagggtgtatttttaagtgaggtgaattgtgaagagtgaataagcttgtggagtgatgtcctcaggctgccagtgtgaaacaaagtactacagagtacagagcagcagcactgatcatggaagaacatggaacattattgaagctattccagaaggctttattcttacccagaattcctccgtcattagcttccttcagttctttttctgtaaagcaagaaatcagttttatagcccttaaataaaatgatcttttgtttgttctatgataataccatataacaaaatattctgtgttgacaaggatattaaaaatatattatccattattatagtgcttaaccaatataaacactagatatttatgtttaaacatatatcacacccactaaatatgcaattaaaaagggcatactgaactagctacttttatcaatgctactatataatattgggcaagaagcaatttagggattgttaggcttgttctggcttatagattcattccttcatgcctgggcaggcatggaagcagagctagaatgctggctcatcgtattaatctgaagtcagagattagagagtgaacaagaggtggaaccaggagtaaaccaacctcttggctttaccagtgactgactgtttctagttaatctcaacctcctgaagattcctttgccttccccaccatcaatatctggagaccaagtgtgggagttcttgagactatgaataacagtttgcacttgaactctatgattctgtccatgtcctttatgaactcctgtctcatagtacagaataaatttttttgaactcgccatgtttccacagtaagtaatacttctagtactgttgaaaagtcccaacaggtttggaaccaaggcaatctctttactgtgaggcttcataaaatcaaaaaacaatttattatatataatgatatagagtaaaccatctcatcccaaaagggagaaaaggtggtatataacaaagcaaactgaagtccagtagggcaaacgacaaagtccgcatgcacatgtctgatatctggggcttgtgatggaatttactctactacaagcaccttgagtacctccagccttggtggtctgctgcctgcagcacatgtagcttctcctggctatgggattcattctttgcctatagatttcctcactagatatccctcagttttgacatctccaacatcttaagacttctattgcaatgtagacttaccatatttttatccatagaatgaatatatatgcaagagaatacatatatatgtaagagaatacatataatactgctcaccaatggaacgaaatacagctcccagtgtatgatacagaataacttgaaaaactgctgagtgaaagagaagagcttctagtgagaaaatattctatggcaccaaaagcacaaccccagagtttgctgggatgttacaagtgctactctattttgataatatatgttcttaatggatagatatattaatccaaatggataactttgacacttgggatctatatattttacttcatataatgtatacttcagtaaaaactaaagcatagtttgaagacattttccaattaaacaaaatgttgaaggtacttctatcatatattaagtagtattatcttctgtgagacatcaaactacttttagcattagagaaatggttccccactgaagagcatgctaaaaggacctgggtgccattcacagtacccatatcaggcagccaataagtacacgtacctcctgttacagggcatctgacaccctcttctgatctctttgggcacctgcacacatgcagttacagtcacggagtcatataagctcaaattaaaactatatttttatatttagttttcttaatatgaagttaatgaaacatgttttcaagattatcttttattttggtataaacaaaactggtttctggtttaattgcctattgcttgtgaccctgttttgtttgtttgtttgtttgtttgggtttttttttgttttttgtttttgtttttgttttttgagaattgcaagttgatgttaagtttcatgaaacaaggtctcatgcatcccagactggtcttgaaccgtgtggctgagactggccttgaacttctgatcctcctgcccctgcctcctgagagttgggattacaggaacatagcacttttctgcctggaaattatactctctaaatgtgaaagaactgcagcagtcctctgagtacatactcgagtacagaaaaaaatgtgctgctgggaaattagaaagtatggaaaaaatagagtttcctgtgtttatccctaagtcaaggtagatgaaattacacaggaaataaccctctgtctgtgattctgggctctggtatgttaacctttacatgatattcatttttattcataagcacacaaagatgggaggaaagaagaaaataaagcattagatgttagatggaaatcactgacgtagctattttaccctttcgggtgatacaattggccttttacttttataggctgaaattgcattatgcatcatacgaaccaactataagggtgttacatgagaagcatcatgctttattgaaggagaaaatgctgacctctttggaaagagatcgagctgttgggaaggtaaggaaagaggcagtcaaagctacctgaaaaccatttttaatcatttgttgtttattgtgtgtgtgtatgtgtgtgtatgtgtacatatgtgtgtttatgtgtatgagtgtatgtgctcaagggtgtgtatgcatataggccaggtacatatgtatgcatatgcaggccattatgtgttattctctgacatgctatctacctcctttgagacagggtctctcattggactgaagctcaccaattatgccagactgcctggtctacgagtcccagggattttcttgtctctatatcttaagtttggggatcacaagtatgtgtcaccatattgggcctttgtatgtggggccaagcagcttaccaactgagctgttgctccaacccttagcattcatttttatgagtaaactaatggttttgtttttgagttaagttttaaaacattgtccagcaatttgtatatataatttatttggaaacataataaaaataatctactaacagctcataatgattattaatgaattaattagcatgtatatgaaacatgaaataacatcttactaaagtacagttagaagaaaatatccagccattgtagtaaaaacaataaacaggatggttaaaatgtgagctttgaaagctatccatgggactggaaagatgactcagtggttaagagcactgactgcctttcctgaggtcatgagttcaattctcagaaaccacatggtggctcacaatcatctgtaatgggatcaggtgccctattctggtgtgtctgaagagagcaacagtatgctcatatacataaaataaataaatatatctttaaaaaatagagagaaagctatccacatcagcatacttaggtaaaacatagattttgagaatgacagctggtcaaattatgcatgctccaaggacctaaaatgttgcacacccatagttatcaaagagtgacatgggacagtggctataagttttctctatcccaccaattggtcttaatgatgcagcgtctcaggcgtatgcaaagtagaagcaagtcttatcaagagctattacagaataatgagacacagagaaagattaatagaaactctcagagaatgtggggtttccaagagtagaaagaagtgtattgaacttccttggtttgtatctttttatagggcattattagaaacttgacagaggctgagctactcgactgagtttggttaattttctggatgatcataggtcaaagtaatgaatagtccacaagctctatgcatgtccctgatctcacctggggatggtggtatgctatttgtgtgctgctcatctagtagaggtagtaggagagcacctctattcacttttgagtttagatatgttagtaattgaccttgactctctgctagctgttggctacttggccagcttctctacctcagaagttgcccatgtcttgctgactattaattatactgatttctttgactttgttagttgctgatatagactgctaatcatcagtcactggttggtgttactgtttttgacactgaaggtgtcctaagacttaattatactgagatctttttctcacagctaccaagaagtacctgcagacttcttggttacctctttgtctaggggatggtctaggtctcattcttgaaatgtgtccttatttacaacttagtctgtttgagtggccatgtaaaaaacaagaatctgtaataaacaatagtacctagcacaagtttcacaaactgtaaagttctcatggagttagccagctggtctattgtcactgacattgctttctagacccagtttgtcaacattaagtccatgttgcttttaaccaatggcattaaatcttttaattttattgtgaatgagtttctacagtgctggtagggaatgattaaatcaaaatttgaaatcaggtcctgtaggagttctctatgggaaaggcttaccttgcctgccccttgctattctgcattcattagtttaatgtcagttgccacactgccgcagaccttttgggtccctgtgtctgcgtggaacggggtctctcgacgcgggtgggcaaagcgtggatgaatgacagacagacacacacgcaggagagtttgtgtggaatctgaatgtaattttacaactcgagcatcagactttttatgcagaggacaataaggaagttgggtgacatattcgcaaggtacaattgaggtaaccggaatcttacataaaacagaggaaagtaaacacaaaaggtctaacgggaaccacccaggatagaatacattgataacagctgggatcgacaagggctccacctaaaattcactaatcttagaagccagggtcaagggcttcgcatccttgccacagtttctaatttagtctcttgtatagtccaccttccccttaggccattgtaaatacgtgtgtatgggtataactctgctatagtatctattctggtttcttctttggtctgaaacttccttctttttaagtgatggtaaattcctgtgtaagggagtgacttagcttttacaatcttgctgaattctaaacccttgatcttggtcaaggacacccttggactgttggaacactggcggaaggctttagccatgtcagagcacttataggaaaatactgaaagagagcacgtggatccatactctagactagcgcggtaatggaactcgggaatgaaaaattaatgtatgggtagagaacactagactccaggaggagagcttccttgaaactcttttgcctcatgagtgacttttaagcctttcggcttgtccagttgactcgaccagagagcgtagcagccacaccttctgcatattctagaaggctgaggcctttgctttggattatctctaggaaaaaaaaaaaaaaaaaacactgtttctaggaatgacttgcctacaatctcttttcaaaataccttatttaccataatgaaatcatctgatattttgatttttcttgaaatttttagaaattacttttatctgagtagcatcataaacatgggattcaatatcaaccatatttctaatccattcatctgttgttacagatcttgacttaaaagcctaattatcattttgccttccaaattagcatttacaaaagccaaagattcaattagtatttgtctgacttctgaatgtgctactattttatttatagctgaagtcaatctttgcaaaaacaaaaacaaacaaacaaaaatcagtgaaggcttctttttgggccttattataattttagtaaatgactcaaatttctttccttattcttcaattccttgtcccaagcatttaaagctgcttaaaaaaaaaaaaaaaaaaaaaaaaaagtagtgctaaggtgtggtcatcacattcaagctgcctttgaaactcagcatattgaccttcacattgcaactgatcttgggaaatagtaatacctctagccctactttgttttatggccctagcttcctctttccaccatgtttgacattgtaactaaggactagcttccaaaattgctattgccaaagccagtaccagtttggggataattttgttctgagttgcccatggatttaatatctacttcccagagggggaatgtgtaccatattaattgatcacttctgtaaatctcaaatctaatatatatctctaggattccatttaactttttcataactttggggatgcctgtcatctcctcgtaagcttttcatagtaactggataaactaatgttggttttctaacaaccttgggccaccactcttcagttttatcatgtgggagtgtggtaggttgttgtttaaattcctttgtctatgactattttttaaattttcatttgtaagtcttataaagcttgtatcttatgtaaccagtttttatactttggcacgaaaagtataaggatattattaaagatagcatatggattactagactgatagcaattataattgatattatgttaatctctgcttctattttcgagtcatctaaagtagcactatacagggttctaatatcttgtattatggtattttcaatcctctctttgaggacttcctaggtgacttatcaaatctgatggcttcttagcttatccatatctcacctaatttctctgtccttgtggttgtgccccacattggctgccaaatgttgttttgttacaaaatctcagtcattcaattttaccaatgaagacttcagagtcagatgctggggagaaagcctgctgtgtgacactttcacaagggtcacatatcagatatcctgcatatcagatatttacaacaaaattcataacggtagcaaaattacagatatgaagtagcaacaaaaataattttatggctatggataactagaacatgaagaactgtattaaagggtcacagcattagaacaattgcgaatcattgctttagagacttgtcttctgcttcaaaagcccttagaggtcagatatactgcgtagtagtagtagtagtagtagtagtagtagtagtagtagtagtagtagtagtccttaaaataatattgcttggaaatttctcttaagtatatatttagtactcttacttattggttgaattttctttattcatagtgagtgacaccctttccttctacaggaagttcttgtttttgtataggcctagggctttggggaggaactgttggcatagaatttaagaaaagaaaaagaaagcaaaatgttgatatgctgcattaaaatgcatggcagtttgttaaagaatgtatgaccgactatgcttaatgttcttttgttgctttttgcacatttttccttttgtccaaactcagaagctacaaaagctttcatgatggcaacacaactcatgtaatattattcaaattgtaaaaagaaatgttatttctgtctcttcattgaaatgcttagcctttaaaatataaaacatcaccctttcagtgctttttgtacttagattttaattttctgttcttgaatatttgaattatattgcaagtactattgaataaaatatgtgttctaatcattgaaaatttcatcacatgcatgtcaatctctaaaagcttaacatccttgattattttcacataagtagcagtaagtaaagtattagttacttttttcatccttttgataaaataccggagaaaaggaaattaaggcagcaaggttttggttcattttgaggatagagtgcatcacataagggacatcatggtacaggagtatgaggtagctgctaacttgagatgcacatttgggaagcggaggctgatgcctgctcattctcagcttacttcttcatttttattcagtcaaagacaacagcccttggagtaaagttgcctgtatacattcaacatgaggctttcctccttagttcttcctgtaaatgaattcatagacctattcagaatgtccttctatagtgattctaaatccaattaagtcaacaatgaagactgatgcttgcaagttgcttactctacacctgggtccttgatttctacttctgtaacttgagcagaattgagtgtcagagccaagttatatacctggatacatttttctgacccttgtctctaacatgatggtggttcataagctggtcaaagggccatgttgaggacatttcagagacacatacactctttggttttcagacctaattattgctttattagaaaaatataggaactgggagtgaagttctgaaactaagagtctgtaaatcagttctgcaaacatttaggtcttttacattttcttctgttttctctcatagtaaatagagacaaaccacttgcctttaagactaatatgctccgaagtgaaaacatggctaaaagttaaaataatattagtggtcaggttttaattttttatgtcatgacacagattcacagcaagctttatttactgtgcaaagtggttttatttgacttttactcttgctgaagacaatagataatctatctgctagaggtcatgtgaatccttctgggttaaaacagcatctttaagtttagcacatgatgtgtaaaaatgttaagtgcttagcagaaattctctcttaaatttcttaatttttataaatatgaagtctacttgccattttctgtccttaatttctggtgttatatgtcagccttggccagtttttgaagttgatgttcctttgaaggaaccatggaaccttccttactttatggtctttgttttagtgtttagtggtctatgtttctggtctagtattttaaatgttaccattcctagggcttgagaaatggcccagtagttaagagcacttgttactcacatagttgtgaataacatggtagttcacaactatccattagtctacttttggggggtgtgataccttcttttgacggagatgggcagcaggcccatggggtgcacatataaacattaaggcaaaacactgatacacattaaataaacctgaaataaaattaaatattaacagctctacgtacttctattgaagtatgatgaggactggatgtagagtttttaagcacgatctgaaatacctatagttttacagcataatacaaattgtaaaatgtctgtacagcatgtaatattcaaggttattcccgaggaagtataggtgtatgtattgtatttggatcaatttcaaactatgtgatatgtttctcctttccttcaagtcaaatcacctttctctgattgctcctttcttaggctttgtatctttgtacttttttgttctattgtaaggggctatatttttgtattatcattcactggaaaccatgccatggccctatttgtctcaacaataccacacccattctttttttttaaatttattttattgggtatttatttcatttacatttccaatgctatcccaaaagtaccccacatgctcccccacccactccccccacccacccactcccacttcttggccctgttgttcccctgttctgaggcatataaagtttgcataaccaatgggcctctctttccactgatggccgactaggccatcttctgattcatatgcagctagacacacgagctctggggggggggggtactggttagttcatattgttgttccacctataggattgcagatccctttagctccttgggtactttctctagctcctccattgggggccctgtaatccatccaatagctgactgtgagcatccacttctgtgtttgctaggccccggcatagtctcacaagagacagctctatttgggtcctttcagcaaaatcttgctagtgtatgcaatggtgtcagcgtttggaagctaattatgggatggatccccggatatggcagtctctagatagtccatccttttgtcacagctccagactttgtctctgtaactccttccatgggtattttgttcccaattctaagaaggggcaaagtgtccacactttggtcttcgttcttgaatttcatgtgtttagcaaaatttatcttatatcttgggtatcctaagtttctgggctaatatccacttatcagtgagtacatattgtgagagttcctttgtgattgggttacctcactcaggatgatgccctccaggtccatccatttgcctaggaatttcataaattcattctttttaatagctgaatattactccattgtgtaaatgtaccacattttctgtatccattcctctgttgaggggcatctgggttctttccagcttctggctattataaataaggctgctttgaacatagtggagcatgtgtccttcttaccggttggaacatcttctggatatatgcccaggagaggtattgctggatcctccggtagtactatgtccaattttctgaggaactgccagactgatttccagagtggttgtacaagcctgcactcccaccaacaatggaggagtgttcctctttctccacatcctcgccagcatctgctgtcacctgaatttttaatcttagctattctgactggtgtgaggtggaatctcagggttgtattgatttgcatttccctgatgattaaggatgttgaacattttttcaggtgcttctcatccattcaatattcctcaggtgagaattctttgttcagctctgagccccattttttaatgaggttatttgattttctgaagtccaccttcttgagttctttatatatattggatattagtcccctaactgcatggtactggcatagcaacagacaagtagaccaatggaatagaattgaagacccagagaagaacccacacacctagggtcacttgatctttaacaagggagctaaaaccatccagtggaaaaaagacagtattttcaacaaatggtgctggcatagctggcggttatcatgtagaaaaatgagaattgatccattcctatctccttgtactaaggtcaaatctaagtggattaaggaactccacataaaaccagggacactgaaacttatagaggagaaagtagggaaaagcctcaaagatatgggtacaggggaaaaattcctgaatggaacagcaatggcttgtgctgtaagatcgagaattgataaatgggacctcataaagttgcaaagcttctgcaaagcaaaagacaccgtcaataagacaaaaagaccaccaacagaatgggaaaggatctttacctatcctaaatcagatatgggactaatatccacacccattcttacagactaacttctaatgttttcttttgattttaaagtagaatacaaatttttaaaatattttctgatggaaatgctagagtttatttcttgatattaaaaatggagcagttaggatttagagtcagctttcctcttagctacatctgctgttcaaagctgaagactaattacagtttgagaaaatcatatttaaatagattcactaagaacaaagttggtaccaggcatctgatgtctttttcaggactgttttatagattcaaaatccaatattcttgggatatcttctacacgatacatgattactcacgccaacacattttattcaaacccaaaatgggtcaaatgattgaattcgcttacacaacaatgtgcttaacacagtttaagaatggttctgagattatctaatgtctatactaagaagtagataatttataatttgttgaactccatttactaagtggcaaaagactgccaaaaattattctgttactgtcttggaactaattatcttagtccccaaattagggaagaatctacagttttagtcataaacattttcttggaaagtaagccatgccttcagggactgaaactttcttagccaaaatttccaaggtattctaatttgaaagacagaaaccaatctgttgccaaaaaaccttttcttgttaaagcttagttatcaggtatatcctgactgtggtcactggttaatcttctgacctaaaccaattactatgtcatgaagccacagaattcattcattcaaagtatctgtacaatgaaaatctacttaagtatatgtaacatttaccaatgatttatcatagagggtagatcacatttatgcttatctttaaatgtaaagtttattccatataccctgagatttcactttcaactcctaccttagacccaccccataatcagcatccaaacgctgacaccattgcatacactagcaagattttactgaaaggacccagatgtagctgtctcttgtgagactatgctggggcctagcaaacacagaagtggatgctcacagtcagctaatggatggatcacagggctcccaatggaggagctagagaaagtagccaaggagctaaagggatctgcaaccctataggcagaacaacattatgaactaaccagtaccctggagctcttgactctagttgcatatgtatcaaaagatggcctagtcggccatcactggaaagagaggcccattggacacgcaaactttatatgccccagtacaggggaacgccagggccaaaaagggggagtgggtgggtaggggattgggggtgggcgggtatgggggacttttggtatagcattggaaatgtaaatgagctaaatacctaataaaaaatggaaaaaaaataaaacaaagcacacgttttaccactgaggaacatccaaaaaaaaaaaaaaaaaaaaaaaaaaaaaaggatgtggtgagttaaaagcagcagaacctcctgcttgctaagggaaccctggtcatcagatcctcagatccgcatcttagtggcatttaacttactatgttttcttcaaagatatataataactgcatattaaatgggaagaatttacaatcttccaaatgaaaaaagtccttgggaatttcatacacgagtactgtactaggatcatttccatctcttcctcactgcagattatcccatgtcccccagttctttctcatgttcagacttctgctttgattttgattgttgcgtgcacacaggaaatagttgcaattataaatgcaacctattaagtccgtttagtgttgttcgtatgtaaatgcatttaggattggccacttggggttgggaaacctatcaagggctcacctccgaaaacaagctattctcccactctcaggagctgttcattgcctgtctagcttgctatctcagagcggggactttgagatttgccccatccatgaggataggggtgactctcagaatttagacaatttatgctattcaatttataatcttaaagaatgaaagtacacatttactagataaaaatccagtaagcatttaaatttctttggtacataataaacattaaaatgactttttaaaatttacataaaacttaaaaatagactaaggtatttggcaaagaaaatttctctttaagttttataaagttgttataaaactaacaacttcataattctagttgttagttttgaaagtatctgggaaatattttcataatttttgaaaaattccataattcacaaaatccaaaatgcatttggtttgtaagtgcatagttatggatggttaatagtcattttgcaagttatttagggttgccatggaaacacatgtttgggcaggtctgtgaaagtatttccagaaaagttcaactgaaaacagagtaataataccagggcttggagtccaggactagatgaaaagaagacagcaagctgagcaccagaatttgtctctgcttcctgaatatatatatacaatgttgttagctctccccaggcacctgccatcagatctttctaccatgagggactggaccctcaaactgcaagatgaagccagcattctccattccgtaagttgctttgtcacttagttgtcaaagcagcagcaaagtaacaatgcagataattggtactgaagagtgagggtcattgctgtgataaacctgaggatgcggttcctagcagactgtaggactagtttctgggaatgatgtggaagcggttggaactctgggccagaatattccaagaatgtcaaaagtagagcttaatacatctttccagtagctggtaaagaagataagcatactaaaaaaaaaaaaaaaaaaaaaaaaaaaaaaaaagcaaataatggaggccagctaaggatacttaagagaactgagctagacacaagtaatgcaggtaattctgggaaaatctgctgaggtcttgttcctgcatatgagagaggttaaatgaaaagtaacctcttaggctcttactaatagaataaggtatttggcaaagaaaatttctctttaataattatagatgctatttctgctctcaccttgtctgtagctttaaattcatcctccccattcctttccttaacagttttcagtggagattgttgcagtgttagagacaacaggactgtactaaggagaagctgtcagcacagcgtggggcagagctcacctaagagaagctgtgtgttccgtaggcagccagacttggctgtggaactgcccagttccactggagtgcatgtatttccagcaatggctctaaagctaaaagctttcagtagccaggtatctagaacataactgagtcacgtttcttgttctgagactctgttaacagagtcagctgggaagaggggaactcaactgagaatgtctccataaaactgacttacaggcaagtctgtgggatgtcttcttcagtcaggattgatgtgggagggtccaattcactgtgtgttgttatcacctcttggtaggtggtcctggcaagaaaggaaacttagcaaaacatgaagagcaagccaataagcagtattcctccatgccctcttcttcagttcctggtttcaggttactgcttttgagttcctgatccaagttccctccaggttggacaataagctgctagctgaaataaatcttttacgctgtagtttgtttttgatcatggtgtttattccattaacagaaacctacctaatcctctatccagaaagaattcctggtgttctcgcctgtaacagtttgaccagaagattaaataatgaatttgtataattcaaactaaaaaattaaatttctcttgtcttaaattataaagatgatccagtgagtaatgggggtgtaataggctaatttcacatagaagaatcccaaatagcataagtggactatctttctctcaaggaggtagaactcagtaattcagttgttacatgttgagtgtacttaaagaattgcttccaaagccacagtagatccaggggaaaaggggacaccacacttcagtgtagtgaagaaatctggcaaacttcctctgcaaggtaccaaggttaactcatcatcttaggctgtattgaagacaagtacctgtgaggtatgtgtgccttcctaaatctctaattctagtttagccatgggggaagggaagcattcacactcatgtccatcctgtggggtacttcatgtatgtagggtgcttcacagccaccctgtagggtgcttcacaaccagtgcttctcaagtactcagggccattagcaaatgggagcattcccgaaatgtattattccagaggaagctgaggggacatagtgactcaatgtaaggtaatcttgtgcatgaactcaagggacataaatgaaaaacaaaccaatgaacgttactacatggtaatatattaacattgtgtcatcacttgtaaaaatgtgtgcgtgggtgtgggacacactgtatttcccagcactgaatcaatcactattgtatgatgtttacaatgctctgataagtttatatttataatccattcgccttccgaagaaactgatctgacctttactttaccctagtattctatcagtaccaatccaccaattacagttcatctgctatttattttattttattttttagatttaaatgtactggtatctagttatagttgagaaatacgtacatctgtatgtaattaaattgaaggtattttatgtttgggtaattatgtacagtaaagaatgagacagctttaacggttgaatattaaatttgattctgattcagagaatgtaggtaaaggcatgctacacagccaacaaatgttcttaattttaagatatggttaagaaaacagaggatatctatgtaataaataattattatgggcataaatgtagttaatcatatttttgttcctggataatacttcctccacagtttgtagatagaagcacaaattgccatagttaatagtcacaaagataacttgtgaggaaatttaagcagaggaaagccctctctcaaagtagaactgaacagttgtaaagtctttaaagcccaattttgtgagccattgtgtgtttggtggggattgaactcagaacctctggaagaggagtcaatacttttaactgctgtgagatacacacttcaaatactttgtatggtggattagtggttgcacgtggaattgaattttaattaaaacaatgctttctgctaaagtttatgttcaatgctttataacttaaaggcatggatacaagaacgattaatattttttgatattttgcaatcaatttttaaatgttgcattttatttaacattttagaattaaattactttataatgccacatgtttgcattatttgcttttagatttctgggcttcaagcaacactgaagaacatagacatgggacatattcaggttcctgtaattaaaggtaagacataatatttactaatactgacctgataatatttcaacctgacctatggccagctttctagatatgtttaagaggggataatggttatcgaatctaatttgtaaataaacagatcaataaaaaaatctagatgtgatacaatagacatttagtttaaaccaaactatgtttgaggagagactcctggtcagagtgagatgggacttcctggtggcagagtagccttctttccttatatcaaagtataactaaagtgtagctgaagcagcacatttggggcattggcaaacatacagtacgggtcaagaagacacatgacatacagaaaaatgcagactgagttccacagtcaaccatggaatcatatctaagaaaccttccaaaccaatcctcatagagatggattcctagaacatgtcagcctagatgcaatgaaaaggggaattcagagttgctaaaatgactgggatctgtagaaaatgctacagaggagttagaatgaagagtgtctgctcctgtgtgggagctgaatgatgttctaaggtgatgtcagggctacttgtataatgtatactggagacttgcagaaagggagatttctctaggactaaaaagagactagacatttttcacgtcaatcctgataggagatactgtaaggctagctttgcctgatagcagggcattattgtgcatctttaacatcatgataacattcagcatcccatatttgccctatagaatgaaagacaaagctcacaagggttcataggagactatgtttagagcagaattcttaccaagttagtggccccggaaaacttagggctttacataaatttaactaaacaccgtaaaattaatccttgaactgcaaattgatcagccaaaaattatactgcttttttaattaaaaatcatcacccttcagatgaagacagttgaacagaatctctacggtgtgtcattcctctgcccagttcataacttagcatttgactatgtgtagaaatataggactcacagtcaagccaggaagttttaattggaagccaaccctaaattccttctgatattgaatttaacaggtaaaaaatgctgaaggagcatttgtgatactattttcaaggacctaagacaaaatatatcagtaagtgaatagacaggactgtcagcaggaaatggaaatatctctgtacacacactcacacacacacacacacacacacacacacacacacacacaccccacaccacttgtatagacacaggaaaaaattgaaattatacaactgaagatgtaacaacattatataaatcatccaaaagtggtataacttagtcatcttttaatatatatttgttaaaatatactgaacaatacattttaaattaagtatcacttaacttgaattacttgttttaaaaatcgaaaagaggaggctctaagatttaggaaaatgctagaattagaatttttctgataaatgaaatgccctaacatttttagagacatattcattatatttgattaataaagggttaaaagtaacattcttatgtttaaactcttattttccttgaatttgcagtttctttctatatatatttatattgtcatgcttgccttagttattacattttattattctggtttggtataaggcagtaaattgaatacaagtttttttttttttgtttttgtttttgtagttttgtttgtttgtttgtttgtttttgtagctttgtagtttttgggtttctctgtatagccctggctgtcctggaactcactctgtagaccaggctggcctcaaactcagaaatctgcctgcttcagcctaccaagtgctaggattaaaggtgtgcaccaccactgcctgactgaatacaagatttatgtgtgtatctatctatctatctatctatctatctatctatctatctatctatctatctatctatctatttatttatttttgagatagtgcttctctacatatacctgactgtcctagaactcactgcatagatcaggctggccttgactcacaaatatctgccggtctctgcctcgagtgtgcttggattaaaggcatgcaccatcacatgagcccagcccccaaacatttattcctaaaccgttcaatgagggcttatccatatattatgatttatgataaggaattaagaaatctactaactgcacatttgacatgctcagtaatatggaaattatgggaaaaaatgattttagaaccccatagaggaaataagtatcatgtagagagcaaagtactgcctggtttagtactgcagatgaacagaacacagtactccttatcatattcctcactcaacagttcagggtactccttacatcatgcaggtttactaatgagtgttttctatgttatttttgttgctgctcagaattgttctatgtaatgctcgtttcttacattggcaggaagacaatatagtctatttttgaaagatgtaatattacctttcaaatagtgtttctagaacactgtgggctttttttttttttttttgactttcagttacatgtgtgattggcctctgcaattttgcttgagggtgtctttgtatcttaaatattttttaatcatccatctggaataaataacttcagtagcacttttcagataagtaatttgttcttgcacttgtgtttgctctgtagtggacttggagattcgcaatgttaggtgttaatagtttaagttagagagaagagtttgcaaacttatcccaggacctgagcatgttcagttaacattggttaaatgtgtatctatataaaggagagttggtgagtttagcatgagaaggaacaacaaatcaaatttctacaaattaatattgcttgttcacttgttttaaaggccttaacttgaaatcatagtttgcctttatatgccccagtataggggaattccagggctaagaagcgggagtgggtgggtaagggagcagggtgtgtggggggagggtatagggaactttcgggatagcatttgaaatgtatataaagaaaatatctaataaaaaaaaaaaagaaattatagtttgcttaaaatgttcattataaccatatagatttttccatatttttattggttattttatttatttgcatttcaaatgttaaaccccttcctcttttctctccacaacctccttatcccctcccctcccctttcctttatgagggtgctccaccacctgcctacccattcccacacagcaccttagcattcccctatgctgtgtcatagagcctccacaggaccaagagcctcccctcccactgatgtcagataagaccatcctctgccacatatgcaggtgcagccatggatcccttgatgtctactctgtggttggtgatttagttcctggggccttgggagcgggtctggtttgttggtattgttgttcttcctttggggttataaatccccttcatctcctttagctcttgctctaaatcctccattggagaccccacactcaggccaatgtttggctgcatacatctgcatctgtattggtcagtgtctgatagagcctctcaggggacagctataccaggcttctgtagcaagctcttggcatcagcaatagtgtctgggtttagtgtctgcatgtgggatggatcaccaggtggggcagtctctggatggcctttccttcagtctctgctccattctttgttcctgcatttccttttgacaggaggaattctgggttattaattttgagctgggtggttgaccccatgcctcaactgggggccgtgcctatctactggatatggtctctacaggttcaatctcacctttgttgggtatttcatctaatgccctctctgttgggtcctgggaacctcttgggtctctggcatctgggactttctagtggctaccccaagttccctctcccccactgctccacacctcctttcaaattccagatgctcttacttctccccctctgctccctattcaaaccagtgcctctttcccctcctccctccttccccaaacctctctccctcaacctcctgagattattttcttcctgcttctaagtaggattgtagtatccacactttggtgtggtcttccttcttcttggctttcataaggtctgtgagttgtatcgtgggtattctgggcttttatttttttagcttttggctaatatccacttatcagtgagtatataccatgtgtgttcttttgtgactgggctacctcactcaggatatcttcaagttccatccattggcctgtgaatgtcatgaagtcattgtttctaatagttgagtagtactcctttgtgcaaatgtaccacattttctgtatctattcctctgttgagggatatctgagttctttccagcttctggctattataaataaggttgctatgaacatagtagagcatgacaaatggggaacagaactaaacagaattctcaactgaggaaccttgaatggctgagaagcacttaaagaaatgttcaacattcttagtcatcagggaaatgaaaatcaaaatgaccccaagactctacctcacacctgtcagaatggctaagatggaaaactcagatgacagcattcccctatactggggcatcaagccttctcaggaccaaacacctctcctcccattgatgtccaacaaagccatcctctgctacatatgcatctggatacattggtccctccatgtgtactcattggttggtggtttagtccctgggagctttggggatatgggttggttcatattgttgttccttctatggggttgcattcttaggcaaatggatggaactagaaaatataatcctgagtaaggtaacccaatcacaaaagagcacacatggtatacactcactgataagcttggagcacccaaagtataattcacagaccaaatgaagctcaagaaggaagaccaaattatggatacttctggttttcttagaaggtggagcaaaatacctatgggaagagatacagagacagagtattgagcttcatgtggtcttaatgctgtgtgaaatctgctcagattcctgcaagtgtctgtttgagagcttgctgtgtcttctttcttcaatctccatctgtataaatatcactgcaccagttattttctcatatataatgctagtgaccttcagaatattattggcagttacatgaaataatgagtgtaatacgtttgtgacagcagcagtcattcggtaaaagataaatcattattaccttaaaattgtcatcatcttgaatgctgtaatctttgggaagtaaagacagtaaaaagatgtgtgtgtgtggggggaagcctccccatgttgcaaagggcctgtcactgctgctctccctgacatgctcctgagacttgggctccattgtatttgggaccctgatatgcagaattgctaaaggaggatagagactcgagtctttagtgctcggtgatagatattctagtctgtgttatcatgtgttcatttttaatattttatcttttctcaagaactgtacaggttagcagacttaggttaggaaagaaatacccgctgcatgtgcctccttgctcttgccatctctagtttctgtaaccacagggtgaggcaccctcttaattttaacatgcagaggcagaggcaaggggattgcaagttctatgctgacatggactacacagcaaggtaattagtaaaactaacaaacaaaaccaacaacaaacaaccacccacatatacgatggtcacttcagaaagatgcttttgttttgttttgttttgttttgttttgttttgtttgttttgttttgttttgttttttgaggcagggtttctctgtataaccttggctgtcctgaaactcactttgtagaccaggctggcctggaactcagaaatctgcctgtctctgcctcctgagtgctgggattaaaggcgtgcaccaccaagcccagccccataaagatatttcaatgtaaaaatattaagcatttgggcataccactcctttgttgccttagctcttctattagccctcttctgttgccccaattttcctcttctgctgccatgtcacttcaatctatgttctctctctccatttttctctgcttctctctctctctctctctctctctctctctctctctctgcttgtctatctgtctttctgtctctgttctctttcttacccagaaaacttaaggaagacatgggatgtttgtctttcttagtctgtcttatttagctaaatatgataatttccagttccatccaatgtaatatgaatctctgctactttcctactccccatttgcttactgctagataactaggttgaatcccacatttggttgttataactaaagctgtagtcagcatggatgtgcagctatccatagtactgatttagattcctttagattcccctgggagaaggattgaatcacttggtagttctactttttgacttttgaagaaactttcacatggattagtatatggtctggaataatctacattcatcaacatttcctctaaagataagtaagacttattttccctatatcctcatccatattttttgatttttcacccatatagccattcccactaggaaatggtggaatctcagtgtagtttggatttgcagtttactgaaggccatggagttcaaggtttttttttttttttaatatttgctgatcatctgtattgagtcttttgagaacatttcacttcattaattatttacttattgaataactatttactttttaataaaacttttgaactctatattctaggtagtacatgtctgatgtctcctttctgtgttttcactgtggcttccagccgctcattgtggacattgctgtgcatgacctttgtagctttatgcaattccatttgccaattatctaaaaaaagagaaaaaaattaattattctctctctccctctccctccccccactgtgtgtgtgtgtgtgtgtgtgtgtgtgtgtgtgtgtgtattcttagaagtcagaagacagctttgaagaaccagatcttttcttctaaaaatgtagattccagggatcaagctttggtcaccaggctaacatgaccagtgcattgatccactgggctatcttgtcaacttcctctgtctgtcagttcatgttataattcctgggcttttggattccttttaaatgggtcttacctgtgtcctcaaagttttttttccctctagcaatttcagagcttcgcatcttttaaggtcttagatccaccctgaactgatttcactacagagaaaagagatattagaaagcaatgaaatcatctacatactttgtcttttcatgtttctctcaacaatacatctagagtaataactcatagtattgtctattgtgtgttagtgaatttgcctttgttttagttattttaaattaattggatataaattaattaaataagtcatatgtacctatatgtataaatcaattagatatagaacataagtcatatgtacctatatatgtgtgtataaagagatgtgaatacaaaagtcttttcttctcacttctttcctcaggatcttatgagagtgcttctatcacaagagagtcaggagacagaggtacgtgtgttgtcatgtggttttacattctttcctacctgttcttaacatcaagagacatagacaacaaaattatgcaacctttataacatttataatttctttaaaatattgtcatttattatcatgagtattctcaccccaattcagcattgtttataagcacacagtcttatgatacagcaatttgattgtgctgcgattaaagactgtttccattcattgtagctggttcacaattccattttgttaaccttctaaggtaatagcaccctacattttgaggaactaaattttgaaatcaaacttaaagcactttagaatgttagtatattttggttgcaaccatagttttaaaaattagttggactgggcatgatgatgcacagctttattcctagcactcaggaagcagagggaggtggaactccgagttcaagactatcctggtgtacacaggaagtcaataggcaagctaaacctacacagttagatcctccagctctctctcttttccatcattttcctccctccctttttccctcccttcaccctctcccttcaccctctccctcccctcctctccctctcccctctctatttttctctttgcctctctttctctcacatatatagacacagatgcggatacacacatacacacacacaaacacacacacacacacacacacacaagtttctagaaagataactctgggtaagagtattatacatgtgcttggttacaaacatctgtaattctgcttctagggtatccgatgccttccttgtactgtgtgagacatcaggcatgtatatgatcaacatacatgcaggcaaaacacttccataataaaataaatttaagaaagtagactttaaaatacacatttagtgtgtgtatatatgtatgtgcacatgcagttgcatgccaacacagaagcatgaagggcagaggacagcttgtttgaggggtcagtttactcctttcactatgtgggtcctgaaggccaaattcaggccaatagacttggcagcaagtttgagtgcacgctagcctgtctcatgagccccatgtaatcatatattattcagacaaattttaatactttcataatgcatgcattaaaagattcttggtatatacacgtttgttattatcatatcttttacagtaaatagtatgcttttctcttgaagctggtcacagttgtgagaaagaaaacagttcagagggcccaactcagaaaagtcttcgtgaagccagggaagaagttggatataaatcaaagttgaagaatgagaaaaaggtacgatgttgacttatgttcctcttagctggtgtgtaacattgggattgttacaggacagcgattgtacagcatcagtctattccctgaaaggggagtttagagtttatttattccaagctcttttacaggagaaaatagagcttgggcaaacagcactggcgtcttgttaactctggtcacatacttactaggggtaaggacagctccatgagtctcagtgcactcacctcagctctggatcctacttacagttgcctctgtcataaagaaaaggccttctctttctctgtggggtaacataacttccctagtcttccttctaaatgcatagaagagaattgtgcgccatttaagaataagccactaataaagtagaccacatgctacatgcatatggagcagagggtggccttgtcaggcctcaattggaggagaggtccatcatagaagatagagtaccatcatagaaacagggggaggggagatgagataggggctttccaggagggggcgaaccagtaaaggggataacatttgaaatgtaaataaagaaaatacccaattaaaaaaagaatgtatgtgtatattcaatccatttgtttgtaatcaggatagtaattaaaatcttatataaatgcatagtcaaaggaataaaaatgaaaaagaaaaacacaaaacatattaaaggagttgaattaggtacttctgttgctgggatagaatacccacggagagcaatgcaaaggaaggctgggtcgtgctcatcctcttcacggaggagcattcgtttccccgggttacacagattctttcaggtcgtatgctgtgcctagtgacagctggtcccctgtatacacatattctctttcaggtggtatgctatgcttaatgacagttggaagaatcatttgttaacttctgttgtaatgcaaggctggcatgttatttgacagaaaactttgaaaatacagaacatacaaattatatatcaatgctttgtccatttctcctggtgatgcagtgccagacttaaagaagcacctccgtggtaaagagttgagacctcaaataagctgaactatgcaaagtgtacctgtcctttctttcctctaagatcacttacttttattaatatttaagttagtatatatttattattatacagcatcagggtatgtttgttttattcactttaaatggcacttatggactatgttatagaaaaatacatatttataacatttcatcaaactgcatattattaatatgcatattctcataattggtagtgcttgtgtttgttttatagtgctaattctattttctgtaaattagtaggcaaattcaataaaacaccatttaaatctattatacgtaaatatgatttcttacaaaattaactattttgaataaagccatgaagtagtaaatgggcctagaaatatgtctttaaattccaccactctttcgtgcctcattagctcacacttagctgcccctcttctcacttggtttcattgttgctctatgcggactgcctgttttgttttcctgaagaacctcctagactaattttcaaaagattctatggaaagaaatcatctcaatatttacacacctgaaatagtctcattttgtcttgcattaatacttagttaataatagtttatcaatttaaatcacttcctcatttgcatcttgagggaacagccttgctatcttagatgctgcttctgtttgcttttggagtgattctcatttttgtgaaaataaccaatgctgtatgtgttgcaatacactaatgtgccaatattttgaaaagaatatgtcagaatatgtctttaaattccaccactctttcgtgcctcattagctcacacttagctgcccctctttgctcagaaaatggccttatttatatgacttgaggaactttcaggctgattggcgaagtcattcttccatattcgtagatgaaaacttattcttggctttttgagactaattaatcaagtctgagatctcagggtacagaaagcatcctcagattagtgacttagaattagaaaacagagtgtccagttttatgtgacactaaagctggatagcggactgtgctcctctgtgctgttctgcttttccttgtaaggttgaagttggaaggggaaaaggatttaagaggaatagagaagtcaggctttcacttgaacaactttaaggtgtcttagagttctttggacctgccagatactgaaatcaggttacctccatcatgaaacctccatagtcatctactaacttcctgagaaactgtgccgtgtcacaacactgcctgatggcctgcctctccatgttcctcttaatgtgcagggcaggtcttctttcttacttgcatcagtttccatctcaggccatgctctttgctacaactctaggtcttattcctcctgacatcacagtcaagctgccataggtaagagtggtatttgatttcactcttcagtgagatcttcatcttgttgttatagattgcaggttagcaatcatttcacactgcactttccaaatatggacaacaagcatgagacatcctgcttgttgtccatcaagtgcatagtaggtctgactgttattcacattcccaagtcttagagaaatagcactcacatgcgagctttgtctagagaggttcctggcaccctctatttccatgttctctaatgtcttaaatctttggtatttatgaaaagtttaaaagaatcaactccttttagtaaatccttaaagttttgcaagtagcctgatacctcttctggaaagcaaaatatagtgttctttcaaaaaagtaacatggaaacatactaatgtaacttgctaaaatatgtgtttggggaaaacttttaatttaatgtctctagatttttttctattcccataaaggggtagttttctttttaaaaactgttaaatttcatttttattgttcatttgtatcccttcttcccacttttaaatctggtaagatgtacagtttaccttctcaaaacagtgtttcatagacctcactgtcttccattctgattaccttctggttctctattgggggaatgacttcatctattttatcatgatcaaccccctgaccctgaatttgtttttattttgaaagctctgttatttatttcctattaaccattgactgtgctgtcttagaagcctagtaatatgtcaaatgatgcaatatttatttggatctccttgtcttagagttactatcacagtgatgaaacactaagaacaaaagaaatttggggagcaaagttggcttatgcttgcacatcactgttcatcattgagggaattcaaggagggaattcaaacagagaagtaacctcaaggcttgagctgatgcagaatctatgaaggggtgcttcttattggctttctccccatggcttgctcagcctgtatgcgatagaacccaagaaaaccagctcaagggtggtcccacctactgtggctgggcctttctacatggatcattaattaagaaaatatactgcaggcttgcctacaggccaatactatagaggcattttctcatttgagagtccctttccccaaataagtctagcttgtgccaagttaacataaaactagctatcacactccttaaagactataattttgcctttaaatgctgaccttctgtttcatttccttcctaatctttcttcatctttagttcttattttgttttattacttttttcttcaatttgtgatcttttttttttttgagaatgtgtataaatactttagattaggttattaagctgtccacagtccatcattaaagatacttatttctgcatcataatcaaaactcctaaaaggtatgagtattgtccaagttgatagatgtggacaatggctatgagctctatgtcagtgggtaagtgtctgtcaaggataagaaggcagagcctacagcaaagatgagcagggtgctacaatatccctggctacaaaacagggcacttgtggaaagcagaggttgaaatgtgtcagcatatttactgatgctgttttttctcatacttctctgtacattcccatatggtaagatgctgtgtcttactagaggttagaggaagactccagcattgctaggttttctctctaggtccatgcacatcaccccagagagagacagagagacaaaggcagagagagtgatagagagagagacagacgttgggggggggtagaaaatgtttgcaggtagttgttttatgaatttatctgacatttagcattttcactcagatcaaaagagaaaggaaatcggaatttcattcaggagatagaattagtttgtaccttttaaacaaaatgcctttaaaaggaagtcattactctggtgacagtaaagctaagttgtcagaattgagagagagaaacaatcaagaaccagatgacataaaatactgctactgtctttgtcttggaggtgcagtcagaaaacaagtgttactagagtctggaagatggggtcatgtggtagagattgaagtgtccctaccagacttggtaaaactgcctaagtggacatgtaagcaaagaagacaaatatttaaatgtgaaatttgtgattaaatgtgaaagaatttctgaccagtagtgataggggagaggttttaattgcttttgtttaatgcataattaaaatcaccaaagcttcacggtccaccttcagtgtggtgaactgtgatccctttccatctttgagtacccagtagctgcttgtctctgatgagtcagtgccttggctcattggggttctttactgctgggttagcttcaacctgagtggttgtcattggtgttcctgctattttgagctgctttaatttccctttggcattcatgttttaatatgggagttcaaagacatgtctcaggttttccctgggtttcagaattcatctctattattatgatttaacagcaactcagtttatcccagtaactgagagcaaagtagaaggaaacagatgactcacagatagcaaaaataatattcaatttgatggcatctttcctttctgtcatggtgggaacattcatctctttttacctatgcatctttgtagatgatgtcactgtagggctgggaggaaatctcatggagtctagtgttgaaaagagcaatgagtaagtttaacaaatacttctgtttctgaggaccattggttttcatgattgtgagacaaacatttgaggctattcatgggttttttttttttttttttgttgttggtttttttgttttgttttgtttttcaagacaggcttctctgtatagccctggctgcctggaactcactttttagaacaggctggcctcgaacttattgatcttaaataactgtaataatcgaacttttggtaagatactcttcgactcattgaaagtttagtgctaatttcatgggtgttagttcataaccatatttttcctcactatgtatacttaagtcagaaatatgtttctggaattccatgagaagaagtaagtgtactggctagttttgtgtcaacttgacacaggtggagttatcacagaaaaaggagcttcagttgagaaaatgcctccatgagatccaactgtaaggcattttctcaattagtgatcaaagagaaaaggccccttgtgggtgggaccatctctgggctggtaatcttggttctataagagagcaggctgagcaagccaggggaagcaagccagtaaggaacatccttccatggcctctgcatcagctcctgcttcctgacctgcttgagttccagtcctgacttccttggtgatgaacagcagtatggaagtgtaagccaaataaaccctttcctccccgacttgcttcttggtcatgatgtttgtgcaggaatagaaactctgactaagacggtaaggaactttgaaagtgtgtggattcatctagcaccatagacacataatgaacttgcaacagtggttgcaattacagacaatacctgatgaagcttagagtacttctatgccatctaatcaggtccacaatttttttcctaaagccaaactatcaagttaagtagggacatgaaaggcaacaatatcctatatttttaaacaatatcctttattttatggaaggaagccttgatttcgacagttcctgcaaacatgtacatgagttttactttctttttagggatgccaaggtctacagcttccgatgtaactattatagtaagacttcataaatcaaggaatcattggtatattttattaatgaactgaaatgtataattcaagtatatataataaggatgaatctctaggaaaaatagccaaggaatgtgtgcatagtcctacaaagcttactagtaaacagaattcggtcacagtattatcaatcaaaaaggagattagctctttttgtgactgattcattgaggttgcaaatatttgcatatattaccccccccacacacacacacacatgttgaatgtccaaagaggatatctagtatcttgctttaccactttaaattttatttacttgagccaggatttctcactaaacttggagctctgattgtagccaataagctatctaaatccagtccttctgtttcggtcactatggtgttggggttgcaggagcctggatggccatgcttggccttttacatggatgctagggatccaaactcaagttcttatacttgctgcacaagcacttcactaatactgggatctttctagccccaggactagtaagtacacttttaaactgacgtttccctgagacaaaggaacttagtactttgttaagtgaaggaaaaattgtgtgattatctttacccacgggaataggggaaagcatccatgaagttagtggtaataacctagtaggtagtgtgctggtttgctccagttaaagataacattgaagcaccctccatgtggcccagataatgtctctcctcacctgataataagtgcagaggattttactttaacttcaatttcttttgttttctgagactttcataatgcagtgcaaaatgaaccaaaaggtctgtggggctagatgagtggtttagttttaagaagggttttaatgtgcatagatatatgtaaaattgacatggttgtcatgacttgtgatttgtactcctgagcagatatgaactgtcaacaggttatagagagctagccattggttcatgtataagctatgttttcttaaattttcaagaggtcccaagactgtgtgtatccttaaggtataggcagtcagcactacaggtcaggaaccattgaactgttttcacaaattgcctctttgctatatttatcatgaaatcaagagtttatgatatatcattagatggtttattatccattctaagataatgcttagtaatgccctgtgatatttccagacagtaaaatttcctgtagactggttttaaattcacaagtgagaatgtccacctgaggagaccataaatgctcaagtgtcttatgggagaggccatacatgttcacacatctcaagcagatgtacactgctctgcttcttctttctgatggaggagaaacaaacacccttgctgattcattggctctgcactgtttacccctggacatgttcatctgctgttgcagcaatatgtcagacagaacatctgtagtgcaggcttctgtgttgttgaattttaataatttactattagacttcagggttgctctttttttctccccatagagaggagaaaaaggaattttgtggaaatatcatggatactgctgtatttccatcctatatttaatttctgccagctcttggcaaccttcccagggtgttatatttttcttgatcagggaaagaacagttttagaggttaccacttgacatcccccaccacacacacacaaatccttatcccacgggtcatgaacaaattgggttattttgcagctgccaaatatattctttcaatgacatgaatatctttccatctctgaactctttccttaagttgaatctttttatgtgatttaaattttacgtcaattaaaattttaaaaaaatttagaactttcttatccagatggatttaagcaaagggtacactggggaggatggatggggagacgataaatggatgcttaaacagctttacaatgaaactggagatatgtatgtatgtatgtatgtatgtatgtatgtatgtatttatttattattctttaatccctttttacagtgaagttgttatcccccttccgttctgccctctgactgttcctcatcccattcctcctcctccccagccctgcctgtctccaagaggatgtccccagccccttaccccaaccctaccaaatctccccacttcctggggcctcaagtctctcaaggtttaggttcatcttctctcactgaggccagactaggcagtcctctgctgtatacatgtagggggcctcatatcagttagtttatgcttcctggttggtggctcagtgtctgagaaatctcggaggccaggttgagactcctggtcctcctaaagggtcgccctcctcagcgtccagcttttccaggtgtccccaatttcagtccattggttggatataagtatctgcatctgactctttcagttgcttgttgggcctcttggagggcatccatgtttatattttaaaaggtcaaatgtcaaagattaaaaatagtcacaccaccttaatacttaaatttttaaaaaaaatatttaggggagtaactaaaatgtactagagttttagattatttgttcaggaagaaagcatattatttataaacaattattgagtgcttattatgagaaggtaattcataatagataatctcataagaagtgctcaataattgtttataaaaagatggcctattatggattaacttccagtgtgatgataaagacagaatctgggtaatgttgaacaaatgtcttcagtaagcactaactactggcaaagacccatgtaattcagtgactgtctagtcagtcattgcacgcttgctagaatgggacttttgtgagttcataggtgtgtggaagtacagcacagatgtgttctgcaagtgcagtgaagacagccctggggtgctcctcagggatggacactctcagactttgaggatgacatgtgcagacccaccttgtggataaggatgggaagattctgatctcttctccgaagtgtccatagctgtcagaacagtatgactaccctgggaatagccaaacagtttcctgagacagtgacaaatcctttacctgtggcaaaacaggacagagctgtctgtagatactgtttttccttacactttgccatatgatacctgggaactcactttcatctatgcacatcaactgatggtgcttctgcagttgtaatcctgccatcattgtcgtaatacaaagcttggacttccaattgtgctgttaggtgagtcagtagtgatccaggtgctctgcttgcaaagaaaggtatcaagtcctcttctagatgtctcctattctgtcactgaactgttttcataagtctgtagcatttaaaaatagtattgaaattacacaagccttttcctggaccttacttcaaaaaattagtgtattatattcattagagtatacaacaaaatatgtaactaaagcagtaatgtaacaatactcaatagcttcagtcatcaaatttaacatgtatttagcttgttaattgtattttattaaccagtagcatgtacaaaagtagcctttaaaagacttagcgtataccatggatatagacaaggtaacactctaatacgctgcagatgcattctcattttatatgtttgttctagctcctttggatattaaaagtgaggtgcaatatcttcttaagagaacaaagtgcta

SEQ ID NO: 1616 - DNA, 808 bp, Mus musculus
ataccagatgacaatttcagcattcctgaaggagaagaagatctggaaaaagcaattcacatcattggagagcaagccagagacatccatattttggaacaacaaaccattcttcctgcaaggaatgtaatgcaggaagccatagaagattttctctgcaatttcctgatcaaaatggggatgaccagaactctggactgcttccaggccgagtggtatgagttaatacagaagaaaggaagtgactttaaagggctcggtaatgttcccgatgtctacagccaggtgatgcttttagagactgagaacaaaaacttgaagaaggaattgaagcacttcaaacaggcagctgaaaaggccaaagaagatctactgagaactcagaaggaacgggacttccatcgcatgcatcataagcgcatagtgcaagaaaagaacaagctcattgctgacctcaaagggctgaaattgcattatgcatcatacgaaccaactataagggtgttacatgagaagcatcatgctttattgaaggagaaaatgctgacctctttggaaagagatcgagctgttgggaagatttctgggcttcaagcaacactgaagaacatagacatgggacatattcaggttcctgtaattaaaggatcttatgagagtgcttctatcacaagagagtcaggagacagagctggtcacagttgtgagaaagaaaacagttcagagggcccaactcagaaaagtcttcgtgaagccagggaagaagttggatataaatcaaagttgaagaatgagaaaaaggtacgat

SEQ ID NO: 1617 - protein, 270 aa, Mus musculus
  VARIANT (1)...(270): Xaa = Any Amino Acid
IPDDNFSIPEGEEDLEKAIHIIGEQARDIHILEQQTILPARNVMQEAIEDFLCNFLIKMGMTRTLDCFQAEWYELIQKKGSDFKGLGNVPDVYSQVMLLETENKNLKKELKHFKQAAEKAKEDLLRTQKERDFHRMHHKRIVQEKNKLIADLKGLKLHYASYEPTIRVLHEKHHALLKEKMLTSLERDRAVGKISGLQATLKNIDMGHIQVPVIKGSYESASITRESGDRAGHSCEKENSSEGPTQKSLREAREEVGYKSKLKNEKKVRX

SEQ ID NO: 1618 - DNA, 108182 bp, Homo sapiens
  misc_feature (1)...(108182): n = A,T,C or G
gtctcaggaaacctttctcctgctctagtttgtcatcagcaactactgtctctaaagttcctgtgatattcttataaacacaaattatttttcttctacaaattttatgaaaactttacaatcatctgcttgtgcctaattaatttataaagttattgataaggatttatgaaatacgtaagtcctgaaaatcagggtgtgtctgtgtcaggtaggagggtacctctagaccttaattcaattaacatcaaggaagtaatttagattcaaagtagggtttaaagcaagtacacatattgaactgcagaagtggcttatcataaaaaaatatattttttaggggcctggcatggtagcccatgcctataatcccagcaatttagagggccaaggtgtgaggattacttgaggccaggagttcaagaccagcctgggtagtgcagtgagatcctgtctcaaaaaaaaaaaaaaaagaaaaagaaaaagaaaaagaaaagaaaaatctgggcattgtggcatgcatctgtagtctcagctattccagctactcaggaggttgaggtgggaggcttccttgggctcataaatttgaggctacagtgagttatgatcatgccactgcattccatcctgggtgacagagggagaccctgtctctaaaaaaaaatacatttttaattaaaatctgactaacccttatgtatttcacatatgggtcttagctttcattactctcatgttttctgaatctctgatttgtgtggttctgtgcacaagaatctgtctcaacagtcccaggatctgaccagcctggatacgatgtactaactggcctattcactaccaaacttgctttcctacctccaggaaggaaatggagctaaaatgagttatcttttacaaagggaacaattcaaactctgcttcccattatctaaaaagaattgagcattgcattatgtgcttagaaaaaatttttttcttctccttctttctttccttccttccttcctccctatttctgtctctttcttctttcatgtaatatgcataattgtagacatgctaagacatgttaaagtcaatcagggattacacaatactttagataaatctactctgtttcaggtataggatgtgacagttgaggatcaggagaacttgcaatggctggaagaaggctctctccagcaagactgtcttggaaattgctgtataccccactgcatatcgaacagtggaattttcttaagcaagtctccactgctcaaagtgggcattagatgtgtgttaaatgttcactgctagaattgtcataatgctttcccaagtcagacttccatttcttttttaaatacatttaaaactttttattttgatagaattttagatttacagaagagttacaaagatagtatagcttaactcagcttttccttttttattttttatttttaacttttaagttaagttcaggggtgttgtggtacatatacaccatggaatactttacacccattaaaaagaatgagatcacgttctttgcagggacatggatagagctggagggcattatccttaccaaactaacacaggaacagaaaaccaaatgtggcatgttctcacgtatcagtgggagcaaaatgatgaaaacacatagacacatagaggggaacaacagacttccatttctatctacctctttctctgcacaattcttctgtcttgccagtcattgtctttgttgctttctttaccactgttttaaagtccttctcttctcagtccatagatagtgcctgatgaggaagtgaacaagatagaggagggtgccctggacttcaaaggtagcccattcagttttctcctatgtatgaaaacaaaccatattttttcatctgtgtcatgagaatagcactttcaggtctaaattcacaaaggcacatcatattagcccttttgtgtgtggtaagaacactgaatatgaggtctaccctctcaacacattttaaagtacacaatacaatgttattgtatatcagatagttttaggaaaaaaccctcagcagcaaaacaaatcttgaaatagtatggaagtaatggtgattccatacagagtcaatttaccaggaggtcttgttgaattgcaagtgacagaaagcccaacagaaactgacttaagcaaaaggaatttattgttttaaaagaaaggtcaatggtgaggcttgtttaaggaaatgttagaataaaggttcaagcaactctttaaaaatttttttatttcagaatagttttagatgtaccaagaagttgcaaagataaagaaagttcccatatactcatattcagttttccctactttgaacatcttacatcaatatggtgcatttgttacatctaatgaaccattattgacacattattattaactaaataaagtccatactttattcagatatccttcgtttttacataatattctttttgccctaggatcccacattacattcagtcagcatacctctttagggatctcttggttgtgaaagtttccctcttttcttgtttgatgattgatatggtttggctgtgtcccacccaaatatcatcttgaattgtactcccataattctcacatgttgagggaaaaattctgtgggagaaaattaaatcatgggggtggtttcccccatactgttcttgtggtagtgaataagtcacacaagatctgatggttttcaaaacaggagttccctgcacaagctctctttgcctgctgacattgatataagatgtgacttgctcctccttgccttccaccatgattctgaggcctcctcagccacgtggaactgtgagtccaattaaacctctttattttgtaaattgcccagtctcaggtatgtttttattagcagcatgaaaacagactaatacagtaaattggttccaggagtggggtgttgctgaaaagacagccaaaaatgtgaaagcaactttggaactttgtaataggcagaggttggaacagcttggagggctcagaagacaggaaaatgtcggagagtttggaacttcctagagacttgttgaatggctttgcccaaaatgctgatagcaatatggacaatgaaatccaggctgaggtaatctcagatggagatgaggaccttgttgggaactggagcaaaggtggctcttgttatgttttaataaagagattagtggcattttgcccctgccctagagatttgtcgaactttgaacttgagagagataatttagggtatctggcagaagaaatttctaagcagcaaagcattcaagaggtgacttgggtgctgttaaaggcattcagttttataagggaagcagagcataaatgttcggaaaatttgcagcctgacaatgtgatagaaaagaaaaatcccattttctgacgagaaattcaagccagttgcagaaatttgcgtaagtaacaagtaaccgaatgttaatccccaagacaataggaaaaatgcctccagggcatgtcagaggtcttcacggcagcccttctcatcacaggcctggaagtataggaggaaaaagtggttttgagggctggtcccagggtccccatgctgtgtgcagtctagggacttggtgccctgtgtcccagctgctctagccgtggctgaaaggggccaaagtagagcttgggccatggcttcacagggtgcaagcctgaagccttggcagcttctgtatggtgttgagcctgcctgtgcacagaagtcaagaattggggtttgggaacctccacctaggtctcagaggatgtatggaaacgcctggatgtccgcgcagaagtttgctgcaggggcggggctctcatggagaacctctgctagggcagtgcagaagggaaatgtggggtcagggcccccgcacacagtccctactggggcactgcctagtggagccgttaagaagagggccactgtccatcataccccagaaaggtagatccaccgatagcttgcactgtgcacctggaaaagctgcagacactcaatgccagcccatgaaagcagccaggagggagattgtaccctgcaaagccacaggggtggagctgcccaagaccatgggaaaccatctcttgcatcagcttgacctggatgtgagacacggagtaaaaggagatcattttggagctttaagatttgactgccttgctggagtttggacttgcatggagcctgtagctcctttgtttggccaatgtctctcatctggaatggctgtatttacccaatccctgtaaccccactgtatctaggaattaactaacttgcttttgattttacaggatcataggtagaagggacttgccttgtgtcagatgatactttgtactgtgcacttttaggttattgctgaaatgagttaagactttaggggactgttaggaatgcaggattggttttaatatgtgaggacatgagatttgggaggggccaggggtggaatgatattgtttggctgtctccgtccaaatctcatcttgaattatactcccataattcccacatgttgtgggaggaacctggtgggagataattgaatcatggggctggtttctcccatactgttcttgtggtagtgaatcagtcccattagatctgatggttttaaaaacgggagttccctgtactagctctctttgcttgccaccatcaatgtaagaaattacttgctccttcttgccttctgccatgattatgaggcctccccagccacatgaaactgtgagtccagttaaacctgtttcttttgtaaattgctcagtcttgcatatgtctttatcagcagtgtgaaaatggactaatacaatgatgttgatagttttgagaagtactggtaaggtatgttgtagaatttccctcagttgatatttatctgatgttatctcttgattgatttgtggttattggttttggggagtaagatcacagagatgaagtgccattctcattacatcataccaagagtacatattgtcaacatgacttatcactgttgaaattaatcttgatcacctgggtgtggtggtgtttatcagctttcttcactgtcaagttgggattttactatacaagaaactcactatgtgtagtctatacttaaggaacatgcagctatgctccatctcctggaatgtagagtatctacataaattacttgaaattattcatcacgggagattttcccattcttctccattcatttatttatcatttaatcatttatttgtatcagtatggactcacagatatttcttttatactttgagttatatttcagtactactttattaatttgattgctcaaattgtcctagcttcacctaggacaattggctgctgtgtccttttgacctatgtccatcactttgagattttttttttagaggtgggatcttttttactttctggaactgtaagatcctctaggctcatcttgtttattcccagtcaagccctaaaaccagccatctctccaaggagccctctatccttttaattagaaaatggtgttaacatctaaaatctgaagtgctcattgtaatgggggtgttcttgcttctagcttatagagcaaagaaataaatgtgtgtatatacaggtttaagtcattgtatctgggcttaagttttctctttcttcactcaggtcttccatgctgactcaattcttagatagataatttcttcatacttgcaatcatgctggagcaactccagaactaagtcccaaggggcagagtacgaatctcccaaaatttccaacaaattcttaccaaatctaatttggctccttttaagacacataccaacttcagaactgatcacagtagccaagaataatgagatattcttttgggttaaacctggaacatatgttccttgccagagacagaggattgaccctgtttgaactacatgggctcagaacactagagaaatgagttttcagtggttgttggtgaaaaagtgaaatatatatgctgtatgtttgaaatgatacttttccaccattgtcaattagtactacttctatgaattcagaaatctaaaattggccaccacttacagtgaagtcttgaaagaaaataagatagttacttttataaagagatgcatcagtaaatggcttgggctctatctatagcaaatgaatgctcgtaacttctgaaaattgaatagcactttactgtattattgcatgtaattattttctgctttaaaactaaaaataaaaagagtacatccattgtcagcttcctttctggttttgctttttaaaataatttcacttttacataaacggagcatttaggctgggaggagataaaatttgttgtcttttgtggttgttgctttatttttactgtctccattggttttctttatttacctttttcagtaacacattcaaagggaaagtagatagtttgctgttcattcatcaaaatattaaggcactttttttccactccaaggaagtttgtgcagtatattaaaaaggaaatattataggatgcaaaggcattataaaccaaacaattactgtggtctgaagtttttgttctttctcagtaaagctttcatacttctttttaattaaactagttattaacagaataaaaattcaaatgtaacacatttattttcaaatttgttccttgaaaatacatactagtttaaagatattagcagtcctcctaaaaggttgcatcaagtttttacttgaaggcaattattggttctgtttatatttgttaaaattattttttgcttttatttcattgcttttcaaaccatcgtagagaccaaaaggtttacaaaagaaaatgttaacatagctttaattggaatttttaaaaccacttctgcttaggtccctgtgaaatgtgtttcaaattgtagttgaaccacaaatatcttgggtgacttccaattttgaaatccatgaaatggatataatcaaaatagtaactctgaattaaaattttggctacttgaaaacttcacagaattagacttacaggtttttatttgtttgaggagtgtagttaatgatacttatttcagtcataagtcttctgtttttgaactctttggagaagaattttttcccatttctcctctacattaagcagtggatattggtcacaatttattcattttatatgactctattaaactgtttcccttttttgagtgctgcatatttcgttctttttctttctttctttcttttttttttttgagatggagtcttgctctgttgtccaggctggagtgcagtggcgtgatctcagctcactgcaacctctgcctcccgggttgcagtgattctcctgcctcagcctcctgagtagctgggactacaggcatgtgccaccacacccggctaattttttgtatttttcgtagagatggggtttcactatgttatcaaggatggtctcgatctcctgaccttgtgatccgtctgccttggcctcctaaagtgctgggattacaggcgtgagccaccgtgcctggctgagtgctgcatatttctaaaaatatttaacttttatcttaagttgtttctatatgtttaagtttcttccaaatataatatctaatttaagcttgcatattcattcaatattttaagcacattttattaacgattatttactgaaaacatttgatataccagacatggttataagtgctttttacatatttcgtttagtcttcatactttagtaaggtaggtactaaaatctccggtttacagaacaggaaactaaggctcagagaacttaattaaggtcatacagaagaggcaggagacaaacatctgtagaagatcacacactacatctaaaaagtcagaaatagatgagccattgtaacgaacaaaaacaaataaaagtaaacagtaatcgctctgagagaccatccttcatgtcttttgtgttcctacatgtcttgctggatatgccaaaaatgtaaggccttgaccactccttacccaggtcatttgttaaggctggatttataggaaacaaccttgagagataaggtaatgccttcttctgaaataaagagaaagctttctgtaaaagcagtggattctccaatgtcagaattcttctgtattttcagcctcctgtaattgttccttgcatttaatgagtactcaggaaatgtctgatgtgagaagtcaaggacaaagagtagggtagtaaaagaataggtaccaggaatgaattacccgactattatatctgtgacccttgattattctaaaaaataaaacaatatcaaacacatttaatagaaataacagctaacatttcttagtgtcttctatgttcccagtaagttcttaatgctttttgttgctttaccccttgcaacagcactttgaggtaggtaatattgttgtctttgttctacaaatgatgaaactggggcctagaggcattaagtagtagtttgcccaatgtgtcatagctagtaagtgatggaagcaggctctgaaagctgtctctctggctctgacacacgtactctcaaacacctccttaggaagttactgctaccttttggtaataaatgggagcttttataggatcactggcttccagttttcaccaagaaatgtagaatgaaaaataataccatttgccctagcaatcccattactgggtatatacccaaagaaacagaaattgttctaccataaaaacacatgtacatgcgtgttcattgatattcatgataaagacatggattcaacctaaatgcccatcaacggactggataaagaaaatgtggtacacatataccatggaatactatgcagccacagaagaatgagatcatgtcctctcagggacatgaatgcagctggaggccattatccttagcaaactaatgcaggaacagaaaaccaaatactgcatgttcttagttgtaagtgggagctaaataatgagaacaaatggacacaaagaaggaacaacagacactggggcctacttgaggaggagagtgggaggagggagaagatcagaaaaaataactattgggtactacacttagtacctgggtgacgaaataagttatataccaaacccctgcgacatgagcttacctgcacttgtacccctgaacctaaaataaaagttaagggaaaaaaaaatatttgcaaagaaaagggccttgaatttgcttctgatacatacgcgatataacctgaggaagatcctctcagcaataagactatacatgatggggcaagtgtcaactgcatacatttgtcaggaccaaatttgtagctcataatttttatgcaactgtttttaccttggcgagaatcaatgctacaaatactattccaagtcttagtatatggaaccaaactcaaaacagatgtccagctaaatgcattaaagatcacaagaaaggaattgacaaagctgaacaccatagttcttcattgctaagcatctgaggagcgtctggtagctcccctgggtcagtctttctattatgatttctagaactttattttttcattttttaaaaaattccaggtgttgagaactcaccttttctagtagttttccctgggaacacttggggatctacaaacatctgaaattggaggatgctaatgggcaagaatcaagagaaaggtaattcagagacgacaacgaagtgggaaagaaattacagggtcaaagcgaaagaaaaccaagctgcttgggtaggaaggtgcaatgcaagccaattgtttactgtatcttgtccgctcccagagctgcgcccgagctctcgcgttaactaggcaacatcgttgccacggtaactgggaggcgcgggagggcgacagctccctggactcccggtaacccttacgtgcccggggctggtccgtggggcggggtgagagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtagagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactaggaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaatagatgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtgatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaggaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagctgcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattatttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaatttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtatgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagttttcttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttccagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttcttttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttcttatatttattaggttttgtttactcttactttgctagttctttaaaatgactcagtaggtaatttatttaaagtttttctttattattggtgtaggcacttgaagagagccggcaaagggatcatgacaactcaacattccaatggagggtatatgatcaaacagcaaactgtttatcatgaatgcaggatgtgggcaaacttatgactgcgcctgccactagaaggtttgctgaaggcaatcactccctggtgccgtgctcgttgaggttatctactgggacgtctatagcctattgtttgaagaatgcaatcttgcaagcctgctgtaaatcaaactgccgactgatagtcacccaacgatcacctcctcttcttgctatctcttttaccgaataaatatggaggactgaagaagcttagggcccttgttaacttgaagcaaggagtcccctgacccttcttccaaatatactcttttgtctttgtctttattcccatgtttgtcatcctttgttcagtcccccaaggtccgtgcaggtggcaaagtggtgcccaaacagggacttgaggacatcggcaggcacttacagctaaaaaattcacctgttagtacggctttcactgtatttcataggttttggtatgttgtgtttccatcaccgttcgttccaagaattttttcaatttcctctttgcttttctcattcaggagcatattgtttaatttccatgtgtttgtatagtttccaaaattcctcctgttaaactgatttttaattttattgtagtcagggaacatacatgactcaatttcagggtttttttattttttaagatttgttttgtggcccaatatgccaggccatgtatatcccaaggatagagatagtctgttcttgagaatgatgcatgtgatnnnnnnnnnnnnnnnnnnnntagaagaaatgctctgtgaaatagctatttggttcttttagtctgtagtgcagattaagtctgatgtgtctttgatgattttctgtcctgatgatatgtccagtgctgaaagtggggtcttcaagtttccatctattattgtattgaggtccatctctctctttagctctaataatatttgctttatatatctggatgctccacagttgggtgcgtatatatttacaactattataacttcttgctgaattgacctctttatcattatataacgactttcttgtctctttttacagtttttgtctgaaatctcttttgtccaatataagtatagctactcctgcccctttttggttttcatttgtgtggaatatcttttccattcctttattttcagttctttattttcagttttagaggtgcagtgtgtttcttgtagacaacagatcattagctcttaatttttcatccattcagtcactctatgtctttttattggaggtggttttagtccatttatattcagtgttattattgataagtaaggaggaagcccttgccattttgttatttgttttctggttgttttgtggtcttctcttcttaattcctgtcttccatttagtgaaggttattggtggtatgattcagtttcttgctttttattttttgtgtatctgttgcatgttttttgatttgaggttaccatgaggcttgcaaatactatttgataactcattattttaagttgatgacaacttaacattgattacataaacaaaaaaagcaaagagaaaactactgaaaactctccactttaacttaatccttctactttttaaagttttattatttctatttatatcttattgcactgtctatattttgacattgttgtacttattgtttttgatcagttcatcttttagtctttctatcaaggtatgagtagtttacataccaccattataatgttataatgttctgtgtttgtgtacttactattaccagtgagttctgtaccttcagatgcttttttcttgttcattaacatccttttcttacaaactgaagaactccctttagtatttcttgtaggacaggtctggtgttgatgaaatccctttccttttgtttgcctgggagaatctttatttttccttcatggatatttgaggtttgatgggtaatttcattggatatactattttaggatacaagttttttttttccgtcataactttaaacatgccataccattgtctcttatcctgtaaggtttccactgaaaagtctgctgccagatatattggagctatatatgttgtttcttttctcttgctgcttttaagatcctttctttattagtgacttttgggaatttgattattaaatgctttgagggagtctaatttgggttaaaactgcttggtgttctctaatctttttgcacttgaatactgatattttttctaggtttggtatgttctctgatattatccctttgaataaactttctacccctatgtctttctctacctcctgtttgcctcctgtttaccttcctccctcttactccatccatgcctctacctcctctttaaggccaataactcttagatttgcccttttgaggctatttttttagatctcataggcatgcttcattctgttttactctttttttctttctctgactgtattttcaaatagcccgtcttcaggctcactaatactttcttctgcttgatcaattctgttggcaggaggctcttatgcattcttcagtttgtcagttgaattttcaactccagaatttccgcttgattctttttaacttttttcagtctgttcattaaatttttctggtaggattcttaattccttctctgtgttatcttgaatttctttgagtttccacaaaacaactgttttgaattatctgtctgaaaggttgcacatttctctttggtgaggtcatgttgtcctggatggaaatgctgtggatgcttggatgcttgtggatgttcatcattgtctaggtattgaacagttaggtattttattgtagtcttcacgttctgggctacccatccttcttgggaaggcattccaggtatttgaggggacttgggtgttatgatctaagttcttggtcactgcagctgtatcttcattagggggcactccaatctcaataatgttgtggcttttgtagtcttatagaggtactggctaagttgtcttggataagatcaggaagaattctctagattaccaggtacagacttttcctttacttccccccaaaccatgagtgtttccctctctgtgtagagctgcctggagctggagcagggttgatagaagccacccctgtggtcactaccactgagactgtgctgggtctgacctgaagccagcacagcacagagtctttcccaaggcccattcactgtaaatcactgcctgggtaacacctatgttcactcaaggccctaaggctctacaatcagcaggtggccaggcttgtgttctttccttcagagtggcaaatttcccctagcctaggtgcattcagagatgctgtctaggagccagggcctggatttggaaatcttaagaatctacctggtgctctattctactacagctgagctagctcgcacccctgaagacaaagtccttcctactctcccctttccacaatcagggaagtctaccaccagcctaggcccattgcaaatacagcctggctaccaccaatgttcactcaagggccaaggactcctcagtcagcttgaggttgatgctgccaaacctggaactctcccttcggggcagtagtctgccctctggcccagggcaggtccagaaattccatttgagtgcaaaggcctggattcagggacctcaatgggcctgactggtgttctacccaactagggccaagctgctacttaatctgcaaaagcaagtctcctttactctttcatttctttttctcaagcagaaagaatctcttcccatagccaccacacctctgtatgtgctaggtcacacctgaagccggcatgtctctgagtctcattcaggacccacagcaagtagtgcctggctactgatgctgattatttaggacccaagggctctttagtcagcaggtcataaatcctgccaggactgggttcttcctttgaaggcagtgggttctcttttggctcagggagtttctagaaatgttgtctgggagctagggcctagaatgggggcctcaggactctgcccagtgccctaccctactgttgctgagctggtatccaaattgcaagacaaagtcctctttactcttctctcctcaagtggaaggaaggagtctctcggggttagggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccttccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtattctaaaggggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacgaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtatcatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaagatttaaagtcctcccaaactaagcatactagtcataagataaaattggtataacgcatttctttatgagtttagaatatcgtggttcaagtaattttatccttatccctagctgccagtttgcaatgagattacattgtattgaataccttaattcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaatattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaactttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctctatactgttttccatacaggttgaactaatttacattcccaccaaccatgtatgagtgttctcttttctgcacgttctcaccaacatctgttatttttgactttttaataatagctgttctgactggtgtaagatgatatctcattgtggttttgacttcagtccagcagttccactactgggtatctactcagttgtataaaaattccacccacactcttacgtttattgcagtgctattgatgataacaaagtcatggaatcaacgtaagtgtccatcagcagatgatgggataaaaaatgtgacatttatatacaatggaatactattcagccataaaaatgaatgaaatcaggccttttgcagcaacatgggtggaactcgaggccctcacccttagtgaaatgactcagaaacagaaagtcaaaaaccacatattctcacttataagtaggagctaagcaataagtacatatggacatatagaatggaataatagatactggagactttaaaaggtgggagagttggaggaaagcaagtatgggtaaaatgtccactacttgggtgattggtacaccagaaacccagacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatggagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaactattttagcttccacatgagtaaggacacgcaatatttgtctttctgtacctggcttatttctcttaacataatcatctctagtttcatctatgttcctgcaaattataggatttcattctttttttaaaaatggcttaataacattccattgtgtatatgtgccacatttgatttatttattcttctgttgatgggtacttaggttgattccacattcttggctattgtgaatagtgctgcaattaagttttgaaaaaagttttccgaactacatctgtcatgctaccagcctgccccaaatggtagtgtttaatcatctaggtttttcaatttgacttctgaggataattttcaaatagcaattagtaataaacatgagattccctatattgaacttgagctaatgtttgtatttttaggattaggatatttcttaaggcaaaataaaacaggcaaaatagaataggatatttcttaaggcaaaataaaatagatatcaaatacttttctaataataatttttaatacacaaaaaagtcaggttgtagatatgtattattcttgattatactaatagcatttagtgatgtatctaggaaaatcaaataaataatacagctataaaattaatatttatctgggggaaagttgccatggaaagagtattgatcttaaagttcaaatacctggcttctaatattctgttacttattaactcagtttattgaattactcccagttttcttattaacctgggaattattttgcatagtgttattaatttctatggaataatgtgataattaaatgagtcaagctatgttaaagagctttgtaaatcacagagtgctttgaaatgtcagctattatcaataactctaaatgctgtcatctctaagtttttattaatcacatcattaatattttttaaattcagcaacgatgaagtatgaagaaggaaatgaaaggagaaaatatttcccactaaaatatcatttgaattgccataattaaagcagggaattgtcattttctctgttgtcaacagtgtcaattttagactataggttttctctgtacctgctataaatatagattatctgtcttccaaaatataaagttgggaaaataactgttgagaacatttctgtatagatgtttttatggagaaaatgatcttattaaaaatttatagttacattggaagtaaaagtatttcccatactggatattgaagaacaatatttttctcagaaaaggagagcatacgttttctattgaaatgtagaccaattgttattttaaatgcaaaagtctaaagttgcacttaaagcaggtgaccacagttgcagagatttggtggttgacaccaacatggcacatgtatacatatgtaactaacttgcactttgtgcacatgtaccctaaaacttaaagtataataaaaataaataaataaataaataaaaaaaagtaaaaaaaaaagattataaaacaccacttagaattgtatctttcacagtttagacactatattcattcataaaccttgttttatttggtagttgtcatgccaaaagatttactttggtctgaagtttataaataactattatgagttttattaattaaaacctttttgcttgatcttcttgcctgttttcactagcattttatgtcttctttccatagtgtagacaatgcaaaaaaaaaaaaaaaaaaaaaaaaaaactcgtttgggtgattgattcctgaaagcaccagtgtacttgaactttaacatcttgcagtctgactttcatttcactttttctcagttggccttggacacaagagaactgtttgacacccaaatttagcagtcttttttttccatttgtatatcctggtttttattcctatcttcccttagcatctgtgacatcatactgttctgcccctccttctaccttagtgacaggcttcttttccttttcttaactccaaacagttgatactctttaagtacattaggataactattgactacatgtgaatattgacaaatacaacatatattaggtagtggtaagtgctatgaagaaaaataacatgggtaaaggagacagacggggtgctgttttatgtaggattggtaaggggtggggcagggagcaggggagcacatcagaaacctgaagagactgagggaaaaagccaagtataaacttgggaaaatggaattccaggcagaggaaaaaggaagtataaagaggatgtggtgaagacaggttggcttgttagaggattagcaaggaggctatagtggctctaaccagtgggttagtggtagaggcctttgctagaaacttgctttttcccccaggtggcatgtgaagctaatagtttgagcagaagcatgtgaacaggcttctgcatggaaaaatgctcaatgttactaattgtcaaggaaatccaaatcaaaagtaaacgagaaatcacctcatacttttcaggatggctattattagaaaaacacaaacaatatgtccggcgcggtggcttacgcctgtaatcccagcactgtgggaggccgaggcgggcagatcacaaggtcaggagatcaagaccatcctggctaacatggtgaaaccccgtctcttctaaaaaatacaaaaaattagccgggcatggtggtgggtgtctgtagtcccagctactcgggaggctgaggcaggagaatggtgtgaacccaggaggcggagcttgcagtgagccgagatcatgccactgcactccagcctaggcgacagagcaagctccgtctcaaaaaaaaaatagaaaaatacaaacaataacaagtgttgatgtaaatgtggaagaattggaacccttgcacattactggtgggaatgcaagtggtgcagccaccactgaaaaccgaataaaggttcctcaaaaaattaaaattcaaactaccatatgatcaagaaatcccactcctgggtatttatttgaagtgaattgaattgaaaccaggatctgaggcagatattagcactcctgtgttcattacagcattatnnnnnnnnnnnnnnnnnnnntgtcattacagcattatcacaacagccaaattatagaaacaacctaaatgttcattgacagatgaatgggtaaaaaaaatatggtacattcatgcaatgcaatactactcatcctttaaaaagagggaaattctgtaatatgtgaggacatgcatgaaccttgaggacactatggtaagtgaaataagacagtcacagagggatgattactgcatgattccccatatatgaggtatttaatatggtaaaattcatagaatcagagtagaatggtggtttccaggggatgacaggagaggaagatagggcattacaaatcaaagggcataaagttttaggtaaacaaaaatcagtgctacagatttgttatatatcattgtactacaaccaacaatagtgtattgtacacttaaaaattcgttaagagggtagatctcatgttaccttcttaccatatactcaaagaaagtaaacagtatagactaatgaacctcatagacctataggataatcaacactctacttttgtcattcttatttcacttctactcttacccattccctactgtacctcaagttataatatataatttttacagttattttttgttatgctttatatacattgaagtatatgtcttagctatataattttgacaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtacaaatatttggtgggaatatgttttcatttcttataaaaacttagtggaatttctggatcaaggggatagatggatgtttaactctgtatgaactgctcgtacatattcccacattcaagttggtccattttgctttctcagtaggaatacatgcgaattccagttgctccaaacagctactaacattgagtgttgttagtcttttcagttgtagccattttaactgttgtgttgtggcatcttgtatttttgatatgcattttctgtatacaaatgatattaaacataattttttttgctttttgaccattctaaaaagcattctacaaagcatttatcctgctttctgtatgtttatgttttttgcttgctgatcttataattgaattgtaagagttgtttgtatattctggatataagtgctttgttagaatattgtgaatattttctcccagtctgtggcttgtgtctttaatttatgaatggtgtctttgttgagcagacactataaattttaatgaagcatatcttatcttttttatggtatttattttgacattttgttgaatatatcattttctactataggtcacagagatattctgtgttttcttctaaaacgcttaaaatatagatttttatttcaacataggatctgttcttaagttttgtgcattgtgtgaggtagaagctagaagttaattttctttactataggaatacataattgttctggcaccatttcttgagaaaattatctttaagtctcatttaatttctttggcacttttattgaaaatcagttgaccctttagaataagtttgccaatttccacagacacgggtgatgtaggtgtgacataggatggggattaagttgaaaatataacttgattttggaaaaatatgtgtgtgtgtgtgtgtgtgtgcatatctattttttgaggggggaaggattgatactgtcacaagttttagtcctatttacatagcatatctctccatttaagttatatttaatttaatactttatatttatgaaggagcttgaaatttatgcccttcatattgaattatctaatgtttatattttgttgttgcattttcagttccatataatagagactatgttttgtgttcactatacccacggggcctatctctgtgcctggtacatagaaggagcttaagtgattgtgtgctattaaacttttggctctttagttaagcttttaataatttttagagcagttaattggtgatttttgcccctttcatggcatttatttggggtaggcattattttcttgggaatgtaaccagtcttgccgtattttgagtattgtcttcctttgccaggcttttacagtaaggaaatataatgcagaccagaaaggctttgttgagagccctgaagaaaataatactgattgggattactaacaggaagatgaaaaactaccatttaaaaaataatgaaatactttattttacaatctgccagagagtataggcataaagaaaaccataattacatggcaattaatattgaggaaaaattaaggtggtttactaaggggcctttatttcactttcaaaatttacttctataaaaggtcaaagagtgcccagcttttgtgaagacccatttagttttatgactttcagaaacaaacactgtgaaaataaagataataatgaggcttataaaatttcatgctttagtgtttaggtaattgcttgttaaattaagaaggtatttttttctggacgtgaatatacccctttcttttttggttaggatataatgaaagtttttctctaatctggttgaattccattttggccatccaacagttattccaatataaaatttagtgggttaaataaattcatttataaccaattgaagataatggaatatttgctaattatgtaactactattatcagaaattactttgattcaattttttcatgtgagaaaaatatatgacaaagatagcctacttcgatgcaggtaaacaagaaaatgtttatatgctttactttgccaaattataacaagataatccaataaactcattattaaatgatcattcaaaaatacttaaaactgttcagttaataaaattattttaccatggatattcacttcaaaatatttttgagcatactattaaataatattcatatcatattgaaaatggagttttggggcaataattttatagttcgataagaatatctgtaccttaatattgcataattgaattgtagactttgatatgctggtttcctgaaatggagaagttaaataatcattgtaccattttattaagacaaagcatgtgcaaattgttttctttatgatgtacacatttaaatagaatgttccactgagtaactcttaacagcgttgtacttgaaacaatgtctgtttgctgtgttttttttttttaacacaaagatgctctactaatgtgatgaggaaatattatatagtttaaaatattagctgcttatatgaatattttaaactttattctttagtacaacttttattttccatttattaagcagatgggcagcaggaaggtcataataggagaagcaccaccatgaaatgaatttaaattgttctactgaatagacttcattgtgcaaacagaaagaaagtccctgaaaaccaatttaatggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctgatggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaaggatagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacacaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaagaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaactagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaagaaaagaagaaagaaacttggaagaatggatcagagaccttgcaccatatgcctcatgtaatttgatcttcatcaagaagtcgttaatcaacatatgcttcactgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggatagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatatatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggaagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagtgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattcccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaagagatcagctgttagtctgatgggcttccctttgtgactaacccgacctttctctctggctgcccttaacattttttccttcatttcaactttggtgaatctgacaattatgtgtcttggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaagaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaataaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatgtctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcgttttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattgcaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacaatggttgaactaatttacactcccaccaacagtgtaaaatcattcctatttctccacatcctctccagcatctgttgtttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcggtatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagatatgttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacacacacagaggctgtgaataaattcactacttgtggaattgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaatggaaatagggaagaaagtaactttacagtggggaaacctggcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagtggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgatttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagtactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttattttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaagtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagcagatactttgattatgttcaaggacttaatggaaaatactaataagtgaacagatggggaatttaagcaaagaaatgagaacaagcatacattccaaagcaaattgaagttctacagctgaaaagtagaataactaaaatgaattttttttttttttgagacagagtcttgctgtgtcacccaggctggagtgcagtggcatgatctcagctcactgcagcctccacctcccaggttcaagtgattctggtgcctcagcctctccagtagctgggactacaggcatgtgccaccatgactggctaatttttgtatttttagtagagctggggcttcaccatgttggccaggctggtcttgaactcctgtcttgaagtgatccgcctgcctcagcctcccaacatgctgggattacaggcatgagccactgcgcccaatcaaaaattttatttaatgtacttcataacaaattagagatgacagaagtgtcagtaaatttcaagagagatccataaaggcatctagtctaaagaagaaagataggccgggcacggctgcacgcctgtaatcccagcactttgggaggctgaggcgggcggatcacgaggtcaggagatcgagaccatcccggctaaaacggtgaaaccccgtctctactaaaaatacaaaaaattagctgggcgtagttgcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaagaagaaagataaaagattaaaggaaaacttgcctatttaacatatataaaattaaagtcccaaagaagagaatgaaaatggagcataaaaatacttaaacaaatgatggccccaaatttccccaaattcatgtaaagtataaacttaaacacctaagaaaataactaatcatacacataaagagaaccactcctgaacacaatgtgttgaaattgttgaaaattgaagtgagaaaatcttttttttttaatttataaagaaaaagaaaaagaggtataatggactcacagttccacatagctggggaggcctcacaataatggtggaaggcaaaggaggagcaaaggcacctcttagatggcagcaggcaagagagagtttgcagaggaactgccctttataaaaccatcagatcttgtgagatttattcactatcatgagaacagcatgggaaaacccacctccatgattcaaatacctcccacctggtccctcccttgacacatgggatttatgggagctacaattcaagatgagatttgggtggggacacagcccaaaccatatcaccaagtgtccattgatagatgaatggataagcaaaatgtggtttttacatgcaatagaatcttttttttttaattatactttaagttctaggatacaggtgcacaacatacaggtttgttacatacgtatacatgtgccatattggtgtgctgcacccattaactcatcatttacattagatatatctcctaatggtatccctccccattccccctaccccatgacaggccccggtgtgtgatgttccccttcctgtgtccaagtgttctcattgttcaattcccacctgtgagtgagaacatgcagtgtttggttgtctgtccttgagatagttggctgagaatgatggtttccagtttcatccatgtccctacaaaggacatgaactcatccttttttatggttgcatagtattccatggtgtatatgtcccacattttcttaatccagtctatcattgatggacatttgggttggttccaagtctttgctattgtgaatagtgccgcaataaacatacgtgtgcatgtgtctttacagcagcatgatttataatcctttgggtatatacccagtaatgggatggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatagtgttggaagttctggccagggcaattagtcaggaaaaagaaataaagggtattcagttaggaaaagaagaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagtattcttatacaccaataacacaaacagagagccaaatcatgagtcaaatcccattcacagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaaaaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacaattgaatacagagaattaaaaatgttaaattctggttaaaatgagaaatatgttttccttttctaatttcctcagaagaaaagtgactgattaaaataaaattatggtgtcataaggtaatgtttataaggtatgtaaaataaaggaaaataaattgaggtgtggtggaaatgttttatatcttaattttggtggtagttacatgcctgtttatatttgtcaaaacacacctatctgtacaattacagtgcataatttacctacaataaaatgcataattttaagtatacctgtgtttacttttaggcaaagaggatttttttttttggctcagatagctagaaggcacagacagtattctcagacatgactagatccagaaggatgatgtccttaggacctggtcactgcctctgtcttgtgagctgaattcattttttaaaaaggataaactttattttttagagcagttttaggtttatagcaaaattgagtggaaggtacagtgattttccatataccacctgcccccacccatataccacctgcccccagacatagcttcccctattatcagcatcccctaccagattgatacagttgtaaaaactgatgagtgtccatgacattaatgtcaccgaagtccatagtttacattagggttcacttttgatgttgtacgttctgtggaattcaacacatttatgacgtgtatccaacattatagtgtcatacagagtagtatcactgccctaaaaaccttttgtgctttgcgtattcatcccttcctccttcctacttttctaatattttatgttaaagtagtatcagttatgcacagtgattcctaagggactatgcacaaggatgtttattgcagtcataaaagtaacacaacaatacaagcaatctcactttttaaccaccagtgaatgtttatagtggatcctacaataataaaaagtctaaaactcatgcataagaaatacttatgttttaatgttaagaagtaaaaacatttatatggtacaaatgtatgcctgttgaatatatgcaaagaaaaaatatcagaaggtgtataccaggattttaacataattttctctgtgttatgtgactacttcctacccttttctttattgcatattttacaaagagtgtacatttctgtcaacttcaaaaattgttttcatattaagataagaagaatgtaatcagatataaatattaaatgatggtttgaaattatcataatttcatgaactgtaactccaaaaatgactaaatagtctgaaaaagaatatatgtaagaaagcttaaaggttgagggactttgtgaattgggttgatgtttgcaccaattaatctctaacgattcattctactctaatggtttaaattttatatatttatccttgacatatcaattaaaataaactgatgcctgacagataactcccttatgaaattatctcctggtgtttagtctaattcatacaagaacatattgcatgtttttcttgagtgatgtttacaatgtactttggagattaaacttgtatttgatctgtgatattttgaaatggcttttagtcaaaagaaattctgacccaacatggggaaatagtttcttttagttatgtatcccaactatctaatcaaaagtagttatttaaatcctgtactgaataattttatgctctttgtaaacatacactctagttttagatacagaacttgaagcacttttccctaagcttctgatctcagcatttgtctgtggtcccttagactctgtcacgtctccagttgctaaaacttggtatcctgcttagggactgtaatttgaaaagaggctgtgcgtggtggctcacgcctgtaatcccggctctttgggaagccgacgcacgcggatcacgaggtcaggaaatcaagaccatcctggccaacatggtaaaaccccgtctactaaaaatacaaaaattagctaggcatgatggtgcgtgcctgtaatcccagctacttgggaggctgagacaagagaatcacttgaaccaggaggttgcagtgagccgagatcgcaccactgcattccagcctggcaacacagcaagaccgtgtctcaaaaaaaaaaaaaaaaaaaaaaaagaaaagacgatttattgattaagtggttgttcttcataattcctgtcattcttcatattttcatgttacttcctcccgctttacttgctcatttaagtttagttttaaaaatacttccctctctctctcatttacccattcatccacccatccatctatccatttattttcggcagaagttggcatgtcaatagagattcttcaaattaaacattatttactttgaagttagaaaacaacaaattcattgtcatttactctaaactttgggaagaagacacattaattgttaatctaaatttagggaataagatgcaaattggaatgatttggagcaaagttagcaaagtattttaaacatacttttttgactaccaaagtgacgtttattatagaaaattcagacaatgataaaatatattttaaagaatcaccccgtaattgctgccatacaaagataatattaatgctttattacctaatctgatctgaaaagagttttcaattttacatttattctttatggtaggtcaaaagtagaagaatttctgggagaaactatgaaataattattattgagtagatatttaaactgaaaattacagattatgtttttatttttatcaagggtcatatgtatcgaatatttacatgacactatacagaaagcactttttagtattacatattatgagataaattttttttcaaattaatttcaaaaagcttatgaaatctactggttttgattgtcatccttttattagttgtttttgtttgctaaggttgcaatttcagtgcagtaatgcctatttttaaaccagatcataatgatacatataattgcattttagtatatcttataatgtataggaaattattaattccggatgaccttctagaaattgtaaatgcttggtgaagtgaaaaattgtgaaagctgacttcagagctttaaagaggaaataaatgtcatatatagtaaagcaaagtagctcttaagttagtacttcaaaattaatagtagagcaagtactcattatttcttatagtttaattaattgctgctttttaagttcgtgttttgttgctgctcagaattgcattatgagatgccaaattcatgtaattattagactatatggtctaattaatacttttttcaaatataacatcttcttatttaactctatttctttttctgaattctaattacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtaaaatttagcactggaaggtacaataaatagaatttctataaatgaaagtgtgtttgtttatttgctgtttgttttatctcaagaaagtatgcatgccttaaaatgttgactttacctaagtaaaatttggaaaactgcacagtacctgttggtaccatagcctttgtcattaataagcattagatgacagccatgagaagctatgatagagacaaagactttgctgggatattactcaacattgagaagtgctatatggaatctgagaattacatgcatttaacactgaatgtgatacagactttattgtctgtgcctttcatttgttctgtaaatttttgtgtaagtaaaagtgatgcttatttgctggagagtggaaatcatatttattctcgctacattgagaaatacttgaaaaacatttttttttctgccagtaccctgtacattctgcaatgtttattcctaagttttggttttaaatgttgaatactgtcctaaaattttattaaagtgtgtatttttcattttgtttgtagagcaacaatgtatacacataaaccatgcccttttggattttccacttttgtaattactaccatatttgtttgtttacttgctttttaattttatttctttgatgaagtggcctttagcaatgtcttgcatgctacatgagatctgcttatattcctggaattatctgttggattcttgagtttctctccctactgatttctcttttctttcctctgatattactatatgcattccccttctcatatacaatgggaacaaaaggtagtgtgaccttcacaagattatttacataattgcataaaattgtacctataagttgtttagaatagtggacattataatagtaaaagatcaatgaggcatgaatgttagttattgtttttaattattatcaggttgacacccctggaatttgaaggggaaaatataataaaagagaagcagaagtaaatattttcccttaatctcaacaagctgtaattgttgcctttcctctagacttcagtatcctagatgctgtgggactctagcttagcaccttcggggaggacaggcagtttggacacccaggtctctcaagtactttcatgtaacgtggggttatggaacattttttaacgttattgtgggagttattttgaggattttctcctttgtctagaactggtatcgaatagaaaaaattagtcagaaaataaaataaaataaatgccagccattttcttccctgcctttataatctcaggatttcttaagagagccttgtcattgaaatcatccagacatttctttgttcatcatcttttctctattataaatctggtgttataatttgtaacgtttagttgtttatttgtgttagtgattataaccttagttttttgcaatcaacttactgtttagaaatacaagtggaaatatgtgtacttatatatgtgtatgtattatatgtagaaaaatgtgagagactttttctgtcaattccccactctcaaatgattccattaagactgctcattatgtccatgagaagtaggagaccaatgttacaactattttgaatattaccctgtgtttttcctttttgtccttaacatagtgaagcatagacaataatattttattaatataatattctttttataataaaaatatttattatctagtttcatgtgggaagttttgtcatttcttgtcattctctcctccaccatctttaactctgtttataaacacacaaagccttgtgataacaggaatttggatatgtcataactgtgctctgtaactggctcaccatgtatttaattaaccttgtagtaatgcatctctgcatttttgggaactgaattttgagaccacacataaagcatttggtatggtttgggtatcaataatttaatgaattttttaaaaatacatgcatcattgaggttttggttttcatatttttggttgcaatcattttataccgataaacagtgcaaatattaagaataaattatattatcttgtagttgatcatagtcgtgaaaaagaaaatgcaccagaaggtcctactcagaaaggtcttcgtgaagccagggaacaaaacaaatgtaaaacaaagatgaaaggcaatacaaaggtatgatatttgtttttgtttgcattaagtcatacttaactctcagatctttagatccattcactcatatggtatcattattttaccggaaaaggaatttagaggttatatattccgggctgcttggtttatacatggacagtggaggtatccaaatgttactagtaagtagttaattcagggacacaggcttattagtagcagagacagctcagtggatcactctgccacctatcccaacataatcatgatcatgtctgctcacctgctaacttttctgcttgaaactacctctgtctaaaagaaatcactcccaggtcatatcttgttatatcttttctcaaaatgtaacgtcagactttacttagtctctttaaaggtagaatgaaatagcattatgctccgtttaacaatctctttatatcttgagtaccttcactttgtaatcagactggtagtttaaatctttgccagtgattaaagaaaatggtattaaaaatggttggtcaaagagatcaaaaatgaagaaaattacataaaacctgtgaagagtttagtttattgttttgaaaattacataaaagtctagctcaggtaatggattttcttgtaaggcagttgttaccttagagttctaaaatatctggcacttattttaaaataaaaatatttacaattataatagcttcttagtaattctagaagaagaatagatttgtatgaattcaaataatagcatttacttaggtaatgccaataattttttttctctctaaaacatgcattggattctggtattgtataaaatatttatacaatgaatttttataaatttgtataaatataaaatataaaatttataaatttgtataaatataaaatatttatacaataccagaatccaatgtataaaatatttatacaataaaataaaaactaatcacttttttgttataataagctttttattataatcttgtgctttttcagattagtgttttgttgtttttctatcataattatagattatcatatgtgaggtagactcacatcagatttaaggatttttggaatgatggaggtgattgtcatcagaaacattttcatcttctaacggtataagtattgtctttcaggtagtaagtcatacttagaagtgatttgttgattcattcactcagtgcttactgcttataagagtttagattaataatgcaaggttgactttttatgggacaaaaagatactaaaatataggaaaagtacattgcatatttatgcatagtatattattttatggtgttgcattctgatatttaacgtaatacctacagcatggtagaaaacataggtcatattaaagggctaaagtgtaaaataaggtgaatccttctcaccttcactgagtaatcatttttactagtatttctcttaattttcttgttgttattattataacaaatgactgagttctgtttctatttttttaataattcacttcacatgatatctattgactccgccgtaacaaagaggcatttagagcactttactgacttgatttgaattatattattatgtatgttgtcataattgataacatttacatttgttctatagtcttaattctattttctatgctatgtctgtaaattaatactaacatttaatcccataaacagcctttaaatggattatgtttaagtaaatgtaatttattgcagacattgcaaatttaactagaactgtagaggaggaaggagaatacctgaagtgcataggactgtatttaaagatttctcttttataaacagtcgctctcttctacttcattggcttacactcagctgcccctgttatgtattctcatattttccttcatagattgctttttctgttttcctagattatctccttgagtaattttcaaaaagggccaatggagataaatgatctaagttcatacatctgaaatattcttgttctaccttacactgagttgatattttgctggaattagagttctagttttaaattaatttttcaccagaattttacaggcattgttttaatgtcttagaggatagcaataattactgttggtctgattcttgttattttgttgggaagtaaaaaataccatatacaatacaatgtaccagtaaactagtattttgaacaactagaacagtgaggtgtaatcataataacaactttatttatgtgacctactgactcttaaagctgctcagtggaggtaattcaacccttaccctagggtgataattcattcaggcttcatgaaattattagtcaagtgtgtgtttactctggttgcaaaacacaatctcaaatcagtaattaaatatgtccagctttatgtaacacaaatgctccacatttaacatgaagttaaattttcacctaaccctcagctgaggacttctttgggctagacatttgcagtgtggaaggggttgtaatggtggtggtgtgtggccgttcgtaaatcttttcctcttactttttccctcttactttttcctcttactttttcccttactttttccctagtttgctaactggcaaggttgaaggtgcaaggagggagaaattaaagacgaatggaagagttgttactggacttgagataccttatgatagcttagagttctttgaacttggcaaaatcagaaagcttttatcctgatgagcactgtattagtcagagctctccagagggatagaactaataggatgtatatatatatatttttttttttttctttagaaggatagaactaataagatatatatggggagtttattaagtattaactcacacgatcacaaggtcccacaataggctgtctgcaaactaaggagcacggagagccagtccgagtcccaaaactgaagaacttggagtctgatgttagagggcaggaagcatccagcatggagaaagatgtaggctgggaggctaggccagtctggtcttttcacatttttctgcctgctttatatcctagctacactaggagctgattagatgttgcccacccagattaagggtgggtctgtctttcccagcccactgactcaaatgttaatctcctttggcaacaccttcacagacacacccaggatcaatactttgcatccttcaattcagtcaagttgacagtattaaccatcacaagtccccgccttgtcaacttgaacccatacatatctgctgagatcatacataatcttcaaataaagacaataataaggtcataattatgcctaacataaaacaactatccttcgtacaaccagaaatgcatcagtccccaactcaaatactattacataaagttaacaatacttaaatgttgatgtgaagtcagtaaatcttatatcacatgataagggaaaaaggaaataaaacgaaggtatattcttagtacagtgtatacatgtacaaccatggttttaacaaaagaaggagggaatacccatgacaattacagtcctcgtttctgcagctggtcatgtggttgtagctggtattgattactaccttgttctatctattctgtagtccctttgccttcagcaagtacctcagcaggttgtggattttttcctggtggagtgacccaaaccttcattcctgaagggtctgggccatatgcagtcctgcccagactgtgatgttgtaatttcccaatgaccttaatcacagggcatggcaatactaagagacatcctagtggatctcctgtagtcatgcatactctttgctacctccattgtggagtagtagactg

SEQ ID NO: 1619 - DNA, 701 bp, Homo sapiens
agcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttgcaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatgg

SEQ ID NO: 1620 - protein, 176 aa, Homo sapiens
MTMNMKRYQMTILASQKVKKIWQKQFRWPKNRLQILKFCKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVASKRIKYLRIQLTKDVKDVFKENYKPLLNEVKEDTNKW

SEQ ID NO: 1621 - DNA, 53981 bp, Mus musculus
  misc_feature (1)...(53981): n = A,T,C or G
gagccatctctccagccccaggagtggatggtttttgtaggtggagacatgtgggctctttgagatgaggtctcactgtgtagtcaaggctggcctcagacgcagacttgcctctgccctctgagtcctgggactaaaggtgcgctccactaacactacccacacagacaggctcatatattttgattgcctgtggtgagtaccgttaaaatttcaagtgagagtaagttatcagtttcaactagctagtcctctctcatctgatctattgttactacatgcatactctcatttctttgcttagtggctcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactaactgtcccagctccagtaatacctcctgtttcacttcggcatggcacttctgggagctagagaggttgctttctgtgtaaactcgaggactcacatccccaagttaactagctgggtgtcatgcttgtaactccagctcccagggatccagtgcctccttctggtctctctgcccaggcctaggtgtgcagcctctgccccattccacaggcatacagtctgacagacataagcacacgcatgcatcaggacattcgtaaaaacaaacagtgaaactctctacttgtttgccgcgtttgcatgctttaataaggccacatattccctgctcactcctccagccttgtgggttggaggcccctcctatgtgttgtgtgttgtgtctacccatttaataccttcatgtcggtgctaagtcccagattggaatttgtatcacacttactgtgtgtgcgtgcaccccatgcctgtatggaggtcagagggcacctaagtggttgtcaggcttgtgccttagtgatctttacatgaggaacaactaaaaaaagttaaaatttgttgtgtgtgtgtgtatgtatacatgttatggctttacttgctgagccatcttactgggctactagcaaaattaaggtaaattttgagattatgttttggcttcggtatggtggctcatgcctttagtcccagtatttggaagacagcagcaggctaagttctgagctggaggccagcctggtctatatagctggttccagcccagccaatgctacatagtagtaattctcaacaaactttaagttgccaaaatatttttaattgtgtgtgtgtgtttaccacatatgtgctagcgtgtccgtggaggccaggagagggagtcaaatcccttacagctggagttccaggcagttgtggtctgcctggtagagtgcggggaaccaaaccccaggtcccctggaagaggagaagcaagtgagccgactcttcagctccccaaacatccttcaggaatatttcccagctaccgcaggaaagtctaaacgcaggcaggatggtgtgtctgcagtcagttctggagatgatgcgtttcacctgggatgtaggcattagtgtatcattgttttgcccccctaaaattctgcatacagcagtgtcactaactgtcccctataaacgtatatctgtctatgccaaaggaaaccaagaggttgggagcatctggttctagggaagagggtttgtgtatgttaggcaggattccaggttagctggagtttcttggagctcttcctttgttcgccattcagaatgctaggtttcccagagcctgagcttttcttaacattattatgtgttgtgtgaacttatatttaaggagaattaacatatgtctgttcactccacataagaaaggattccacccaagtggagtttgggaattagtgtgtaaaattggggttatatacagaagcatgggcctttgggtatgggtgctgaggaaaaacaaacaaatacctcctagtaactgttaactgcctgggaaatcctgggggactttgtgaggtttttctgtcctggcaactgccaaccacctctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaactgcctgtaaatgctggggaggcttgtgagcctctccctaccagcaactgttaactgtctacaaatccttggttatgggccaggcatcaggagggtagagccttatgaaccccacctcctaaccagctgttaactgtttataaatcgttggggagggaggggcctcacggtcccctttctactcagtggtgggaagttaatggtggacttgggcaggtctattaaaggtgacctcatctcatgatagttcaagaggctgacagctgtgctttgagaggacagcattccacagtcttaccttttaagtttcaaaagttctcagtatacgagaatatgtcaaattctgaatatattaccatcatgtctatttccacagaagtcagcaagatcacacgatttagtagtactgagaaagaaaacttgaggtgaagaagtaggcatcagttttggaggatggtagaccaccactttattattctgaaaacatagataacaagaaagaataaagactttatccctgctttttcccgtaaaacctgatttcaaggtaagcaagttgcaagcgaagccttcagtttcggtgtttttgttcctgttgccttcattctcagcgatcagcttcctggtttaaagcttgattcgcgtagctcttttctcattgtttttatctcattgtgagcataattgcctgttatcattcataattattttaaatcctgtgatggttggtgtggaaatttggctggtctcttgagttcgtctggattgtgtttccttctgacaaagatttctatcaaaagtttgtttggatttcagccatgtttctgaatgtgggggaggggagtctggttgactccagcgcctcatcagtgggtgtcagagatgtgctagaaagctctgacgctgcccctattgtctttcttggactggcttgcacatctgtatccagaaagggtcttagaggcttcgttctgtagttctagtggtagagtgctgtgcatgatctacttggagatgttgaggtttgcagtggtgggaactgagtccttgctgttgtcctgggtcagggttgggtttgtgcaggctgtgtttttctctttccttgtaatctgcttcttctttagacttaggactctagtcttcctttgcagaaaagtagtttccctcagcactagatactgtgaataattttggaggaatttaattagaaatgcttttatattcagtatgaaaactaatgaggtcagggtctttgaccacaactacatgaaccttttcaagtagcgttcactagttccatgcgctttctgacattcctgagtaactcctgacacaattcagtaaagaaaagtgcttcattgctctcaaggaattttggttttaagtggagggggtgggggaggagtaaaaaaaaaatcaaacaaccatagagagtgttcctttctgcatgggatagagtgtcccccactatagttctgtcctccagtctttgttgggcttatgtatggatggtactagattggttctaggtttttttcctaagagaatcattaacaaacttcaacttttaagcataaaatttgaaagtacaatatgactagagaaaacaccaaaggctctgcctgctgtatttttaggtatgacccaaagctacaaaataaggttcttgactatatattgttatgtgaatgtaaaaaaaaaattaaactgtgtacatttacatatacaagcaaatgaaactatccatcttaatatatttttttacagtaagaatatttgctggcaaaggattttaaagctactattcataaagaaggatatgaagttacactaaatcagaggttctaagtgtaactttacctgtgagagactggtcattttaggctagttctgattttgtttttaatggaatagttttaccaccaatcttggagagcaaaattctccattgttgtttacaaatccattgtttagatggcattatggcagactgaaaagcttaagagacagtcttcagtgtctgtcagactcctgacgaatgtgatacctagaatccgtaagaactcaaaaaacgttaaagcagaatagcaattagtttaatgctaatgacatcatgggaagatggcctgaataaatatgtcacattaaaaatactctgccatcacactgttagggaaatgcaaatcacagttgtgatgtcatagtacttcatcgtagttagaatggctgtttatcagaacaacacaaagtacaacaaaggttgaaaagaatgtgcagagaaagaacctttgtatactgcaggcagagatgcagatgagtatagccacacagccagaagaatggaggttctttaaaaagttaaaaaatatatagcagcctcccgtgacagggtatgtacccagacagaatgaagcaagtgctcagaagagatccctgcgtgtcccagtttattttctctctagtcatagctgccatgtggaatatccctgatgacagaagaaggaacaaagaataagatgaactcacctgtgacactatctgtctgtaaagaacgaggccaagtgacctgcagaggggtgactgcaactggagagcactgttccagcgcactaagtcagactcagaaaaaaagaaattgagtatctagtttcctaggcggaaagtagggagtgggtgtgcctagcagagggtaggagcagcaccaccaacgtacactacgagaatgctcgaaagggtcgcagggacgcccacgaagccgtacagttaataggcattattattaacagatctgctcaagggccaatacatgccactcactctcaatacataatgaatgtattttaaaagtctctaaaaagtacctgcttggttatgcagtgtgggtctgttgttagtgtgagtgcactaaggacagctctatatatctgagccacttgggaaaaatgaacctggcaagtgttaggcagctcacagtaatgcagacaggtgaaaagggctacctagtcactgagcatttttcgggtttggatttggcatgagacaggagtacaatttgctgattgctgaatgacccaaaagccttagagcacttcagatttcttcagcctgggtgttttagagatgatgaccttgaagagcaagttttcaatagttggtgggagatgggctgggaactgaaccctgggtcctctggaagagcagtcagtgctcttaactgttgagccatctctccagcccacctggctacatcttttttggaatgaaatgacctgttttgccgaatttgagacgtattttgttaaaaacgattctggttatttaatattaacatcacaatgtgcttcccagtaactgaatattaacaaatatgttgattgaattttaagtctgtagttaaaatatttttgaggttcaatagttatagtgctagctgagtctaaagtgaagcccagaccttccaggtcccagcttctgtaaatacaagctctggtattgaagtgccttatctactctctttaattgaataagtaatttgcagtagtgaagcccatgtggcgctagtacacagtgcgtttcctttatacggactaatttgtttttattacatatttgtgttttgcagtaggttataaatctcattacatgtaatcaaggaagcagtcactgaagatgactatatttccctgctaggttttgttttggttttgttccttcaaaccaattgcattaattttagcagtgtacctcagagctctgattgcagagggcctccagtatgtaaagaggtcccatttcatctggagagctgatttatggagcagagttaacacctttagattcttgagttaggtagaatttatgtatatgagtatttggcctgcatatatgtatgtgcaccctgttcatgcctggtatctttggaggccagaagagggcattgactcccgtagcactagagttacagatggttgtgagccacacagtgggtgtgttggtaattgaacctgggtccttttaatcgccaagccttgtctccagcaactcatttatagcttgaatataaattcttacctcagtgattttgtttatggacagaactaggctcaggacttttagctctgaccagcacagggcagagggagcttgtgggttcagtagaaatatggccctgcaggaaccagacctgtttgtggagtgagaatttgcatgtggcttgttttgttttggtggcagttaatagttggagcatttctgggagggtgtctgtagagaacttgctggaagacaccctggagagagttgcttcgtgtgttccatcctttgtttccattccttttttcttggggttcctcttgagcagagtaggaattttgtcttgttatttatagattctaactttctagtactttattattaaaagccaagtctaaatgaggaagttagtaagtcctgggttcctgtgcagccagccacactagaaatagaaagtagtgaccatcagtagagaatgcacaattagaagctcagtcgagattgcttgtgggttattccttcctttcttccttttgtattacccccacccccaagaagacagaaatcagactcttatgttggctcctgcagagatgaggctgctctccttggaaggctgacagtaggcaggtgtttgtataggctcccagagactggctttggagtttgtatcagattggtagtttgctaaagaaatcaaggctttgcttgggaattataaatccttatatccgttcttttcatattctaatggaacagccaggcatttctgctgcagcccatgcttaaaggtatttttagcactgttaggtctggtgaaatgggataatgcagcgtgacatgaaggcagcaagagcacgtaggcagaacaggaactctgaatcacaactcttgatttagaaattctgagttctcttcggttggagtaagaaaaggtatgtgtatggtggtgtatcacctcaaagcctgtatttaggaggctgaagcaggaggatcccaagttcaggccagcctggcctacatagggaagagaacttgtctccaaagaagaaaaagactaaaggagaaaagacattgattgcactgtatccatctattaatccatttcataataggctcatagatgctgggagcagagcttgctctgtagaccatgctggcctggaactcaaggggtctttataaaataaggaaaatcgtaaatgaaaaacaagagtattttaagggtatttagttgcttttcctgttactgtgacaaaataccttgacagaagcagagtgatggtgaaagagtcctccctcccttcatcccacagtcatggctacacagtccatggtgtagggagggcatgatggcaagaatgccaggaacatcaggcacccacagtcaggctcaggaaatgagtgttcctccctccctccctagtcggtgggctcctctgcctacagaaaagatggcctaacacctctaatctaggttaaccctcacagacaagcctgcaggctcctctgctaggtgggcgtgtgacccatgacgactgaatccaaggtttgaaatctcatgttaacacttttaattccatattatttatagttaggatttgctagtaaaattaaacaatatacctactccttaaaacaaaacaaaacgccagcaaagaaattgaaaaacaaaacaatacaaaaacttttaaggtctattcttttggggaaaaaaaaaaaatcaagtttctcaaggtagactagcataaaacctaaatgtcggctgtagtattggggttgtaggagaaaatttgagctgtaattctcaagtacattaaatgtattaaagctgcctgtggtggcatacacttgagaaaagcaagagcgtgcgctcagataagccccatgattagctagtaagaaatgctgctgtggggatctgtggcctgggaaagctgtttctctccagagtgttgctttcgttgtctttacatgctttttaatggactgttttccttgtagtagtatggtgtcattgacagttggggattaagcagtcttctttaaaaaataaaagagaaacaacaacaaaaagacttcacccacactgggaccccaacccagaccttcccaccaagtaggcaagtgctttgccacccagcagcaccgtctgtccccagccccaatttcctttaatgattactttgtgctgcaagttataaagcagggagatcactgatggttggtatttgaatatgagactccgtttaaacatctttatatgtgctgcactctttcagtggcttgttttattgggcttactaaccttaggtgggaatgaaggaatccagagccgacagcatgcagatttgtgcagttttcctagcatcagatgcccattatagatggttgtgagccaccatgtggttgctgggaattgaactcaggacctctgggagagcagtcttaaccgcagagccatctcttcagccctgagctgatctattcaactgactttgagagtttccaactctcccaccgccactgtctgtctgtagctttaacagtttagtttaaatggtctacagatatgtcttttgtatttattgtaagcactcagtgctattgtaagggttttcagaaagcatgggggggaggaaaagatttttataggattagatgaatttttgaagatgataatccctggaaaacggcagattgaattttgattcccgttttcacagatctttaaaatacaagcatagcggtcgtcaaacttctcactgctatcttgaaagagagacttgcctgtgagaactgaggagcgatcagaagaggaattcctagctgtctttgtctgggttataaagtcctgttgtgattggacgggaagtaaaaccatcatttattttcttcaagtgtgattggctaagattcttttctttccgtggtcttttccagtaactgactctggagctttccgttttattacctatgttctagtacgcggagtactcgggttggctctgagacagtttgtgaaatttaaggatgtcggtaacagctcgcggtggagtgtctagcgttcctgtaagaaggcggcacgaggtgtaaatctccgaactgctccaacacggaattagaattgccgccgggaggaatgctggtttagagccgcgggccgccgagggggcgcggtggggtgggcggcgcggctcgcccggggccgcgcggggatccgggctccttgacgacggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggaggggtaccggccgcctgagcggccgcgcgctcattcctgtcagtttgcctgtgggccgcgcgtgaggtcgtgggcggcgcggctccgggtcgtcgagcgtgcaggggcgctctcgctcgcgggccgcctcgcctgcggtcggctcctcggcatgggcggccggtaggagcgggctgcgctcgtccccggcgcagtggcggccatggcggtggagacgcggcccgagctggtggggaagcggttcctgtgcgtggcggccggcgaggacgcgcgtccggagcgcgggcagagcggctgcgggcgcggctggcgggcgggggtcatccgagccgtgtcccaccgcgaccgcggccacccggacctggcggtgagagctggcgggcagcatgtggcacgcccctctgcgcggggcgggcgggcggcaggtggggcgggcgggcccggcaaggggagcgctggctgctatggcccgactctgccgggcaaaaccatcctgcgtttggctttccagccggaaacgatagaaatgtttttggtacgagggctagtcgaaattatttctccctttctccatcattttgtattttgtttgttagaaacggacagtgctttagggaactccggctcctgagtcttatatggcttcacgaaggctagagatagtgtaaattaggggtttgaacggcatttagtacttctaagtagcctcccctacatttatcagttacataggacactgtcagtgttacctttcaggagaataaatgtgtatttatgatttcgtgccaggatacattcttttggtcacaagcgcattctcataagggaatgggattgagtgagtagactggagatagagttgagtaagtagagtgggggtagggaatattaagatattccccctttgcatttagatcaaatccaccataaaatgcaaaaatagtcaccattttgatatggttgttggaagtttcgagtgtgttcttgcaaaccattcctacctgctatcaattccatagttccccacgcactgtattattagtttaaccgtgtaaaataggcttagttgtgaatacttataagaggaattaaaaatagagacaattgacaaaactccgcatggcagttctttgtgctaaaggaaaaaaagaacccttaaactttactcatcttaatgcttacttgtgatagcttcacaaagccgttgctttgtgtttgtgtaaagatgccggaactcatttctctttccgctttgatatgaaaattgaagattttacgtggaggatgcctgggtaatggcttagacactaaagcaaacacggaacagaattatgtactgtgttcctatatacgtgagaattaggaaattagattagatagtattggagacagtcaagttctgaaactgtttttgaaaggtctgttggaaagaaagggatacagagggaacaaacatattccagttgcccacctcccttatttttccaaatagcaagataataaggtggttgcttagaagtaacaattgtcaggcagtcactgctttgaatgggtgtaatccaaaatcgtgggtgtggtgtgggaagatgtcaagttccaggcctgctggggtcacaatcaagactctctctctatatgtagttatgtatatgctgtggctcacagcagttgattggaaaagagagaagggagtttcgggaagtgacaggttgtttacatacattaaacattcctcttgattattggttcatataccttaatatatcaacatttcattttatataagttttaatggaaaaaaaaatccatgctgaacttaaacagtgtgagttgtttctttcaacaatttggcaagtgatttgttactgtatttcagtttttatactttttccaagggttccttacatattatttgaacctatgaaatgtagaacgctttagcaccggtattagtgtaattttacgttcagctacaaaatgctcagttggctttccttatggtgtgcctattgtattgctatgggaggggaattgtcttctataaacactgtgacttctgtatagtatttcttggggatgacagaagtaagattttctaagatgaacttttgccttgttgtccaggctagtcttgaacttctgtactcaagtgctttatgacccagcctctcaaatagcagggattgtagggagcatgtaccactgaacctgtcttggatttttgaggtgcaagctatgatattaggtcttaaataatgctgtacacatttcttaatgcactcgaggttttagtcacctatttaattttttagtgaaagtagtgtattgttcaaatgacttaataagccacatgactagatgatcataatgtttattaagtttttgacttgttaatctgaaattaagaaaataatacagtatgcctattttagcagatacatttggaaaggaataggaatgtgctttcttggatgtatttttcattaaaaactgtattattagcctggggtgttaatagtctttaaactgtgagcacagcaagcaaatctgaagatttgagtttgactcccccagaacctacctcagtaaaggcaagtgtgctggagcacacttgacaatccagccctgagaaggcagagacaggcagactgtttggggttccctggccagcaggctggcatgcagcctagctggctctgcaagttctaggccagagagagatcctgtctcggaagaaaaaaagagaaaggtggccaatgagatctctgggccagtggatgtaaaagcactagctgtgccagtctgacagtctgagtctgctctttggatcacttgatagcagaggaccaacttctccatacaaattctcctgcacgtaggcaaatgttttctttctttctttctttctgtctgtctgtctgtctgtctgtctgtcttccttccttccttcctttcaagattttattatatatatgtatgtgtgtgtgtgtgtgagtgagacaagtacactgtagctgtcttcagagacaacagaagaaggcatcagatcccattacagatggttgtgagccaccatgtggttgctgggaattgaactcaggacctctggaagagcaatcaatgctttaaactgttgagccatctgtccagccctggcaaatgttttcaaaaagtaaagactttttaaaaagtaaagatgttaaaaacagaaaggtatcttacatgtgaggaacagcagctgggattgtcctctggcttccattcacagtgtacacatgtatgatctgtacacaagcatcttgcgcctcattgaggtgatacaagtgtgttattgaatttttaagttagtggttgctaatttgacagatcagtgataggtatgtgatattgctatgagttagattagtatctttatctttaaattaaagcacttgtacgagtatgagttatgtaataaaaaaagaacttcttagtagatactaatttgttagattatttctttaaattctccatatatggggagtatatttggtgttaattcgtgtattcattgcttctatggtgtgtttatgtttgtgtgtgagtctgtctgtctgtgtgtgtgtgtgtgtgtgtgtgtgtgtggttttgagatggcatctctttatgcagtcctcctggctgttctggaatgttgtgtagactaggctgttcttggacttaaagagatccactgtctctgcctcctgagttctaaaacttagtgattcttaatgctactagaataaatctcctgtgcaattattgttggatttgagcagagagtctcacttagtctcaggcttgcctggagctcagtgtaaaagaggctgtcttagaactcatgcagcctgtttcctcagaacttggattacagactccagagcctggaggctgcctggtttccttgcttttggtttgttgtatgttttggtgcatttttttggtgagtttttgttccgctgttcctttttggattagtatctaagtatacatgactaaaatattcatgtttggtttatatgagaatcaaatctttctaatcttaaattttgtctatacgttaatgctgtaacaatgatgaaaccgataagatttaaatttatcatctgaagtgtcatttacgattcagtcactaaattttacatgatagaatcagaattatgttagaaatattttagggacttggctgtagctcagtggtagagattgtgcttcatgtatatgaggccctgggcttaatccccagcagagaaagaaatattttagaacatagccttaatcttctagagtagagtgcatctgtcacgtggttcagtgtcatacagttgcagaaggaaagcttaggagtcactccccgtgagcacctcctcgtctcccgtgctttagctgagtgggtttcttaaggctctctgcaggtgtagaatggacttaatcttcccatgtgggtggagaaactaccttctcatggagaaaacactgaatgtacagtcttaaacactcagtagaaaatttccaagtgcttacattgggtatttgtagtcctataaagctgctgtgaatggaagtttagtgtttgtagtcagagctctcattttatgtactagacagaacatttagttctgggatcttagaatgtttattgagcttcacagatagtaatttattagtcttttaaattcccatagttcagtgataatcctgtgaaaatggttttgatatttttgtattttgagacatggtcacactgagactagcctggagtaccctatgtaaacaaggctggccttgaactcacagagttgttcctgcctctacctcctggtatctgtgataagagccatgcgtcaccttgcctggcatggtgtctattttcttaacctttcaaaaataaaggaacttgagaattttgaaatcacagaactagtaagtatcagagcagggatatgaatgcaggtttctgattctgaatctattgtctcttgatattcttccatattgctttcttcaaatggcttttagtgtgcaaattttcaaaatccaaacatattccctttaattttggaatgtgtgagggtgtagttgttacgttgagataaggtctttcctttatagatttactaactttatctgtgtttctggttcatgtatgtatatgcaccagatgcagatcaaagaagagggtgctgggtcccatggaacccagatagagcaaatctggctgtaactgctactttctggttctgttttggcattatgcttttttttttttttttttttttttttttttttttttaaatatagaagaagggtcttaactaagtactaaatactctgactaagtagccctggaacttactctataggccaggctgtccttgaacttgcaaagatatgtctgcctctgcttgtccagtttttggctttaaaaggcacgaaccaccatgcccatcaacattgtatgtagtgcttttgacgccaaggcatatttcttcatgttgagtctgaaattaaaaattttaattctaaaatggcatattttaagcagtaagcagtcatcaatataatggtggtagcctaaatgcaaaatgtgtatgactttagtcatgtataagttttcattatccctcctaaaaagcattgacttctattgggctttgatgtgtgtggattatccctattgctattttaactgtttcaagccttcagaacatgcaggtgctcattacagcacttgtattggaaatgatactaaagtgatgatagctgtgtacagagaagagaatgaatgaaaaatacatttactgtcttaatagcttatttagtttttatctcacctccttaatgatttccttccttcaaaaagttggtggtgttgttagtatgaattaagtggcgttctcaaagtccttttatttgctatgttgatatcttgtatagaaatgtatatctaaaaaaaaaaaagaaatgtatatctgatgtagaggagttcgtttcacatgtcagagaatgttatcattgtagtggaaatagtgaactactagaatacatgttagaatttttgtaatctaggaggaggtctatgtaacttaattccattttgtgagagagagaggatacttagactgaaacatctgttccatttgttaaagcctcttcagattcagagggtagcagagaaggaagcacaatgtatggatatagttatgtactgtcattttatatagatggctccgaaactttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcctccccttcttttcttcctcctcctcctcttcttcctctcctccctcttctcctcctgtttgtgcttaattgtaccatatcataatttagcctgttaaaattcatattgaaaataaatacgtaacaggtctttagcatttccgttgtattctaaaatgttttagcttttaacaaagctaatcattgtaatgctaaattgaattcttctaagataaaacagtttattccacaatgagtactttgaatatgctatatgccacatatatgaataaagacatgatggcagcatgcttttaaatctagcattttggaaacagaagcaggtggatctctgagttcaaggtgagtctggtctacagagtgagttccaggatagccagagctacaaactaaaatcttctaaagattttttttaaagatttattaattttatgtatatgagtataccattgctctcttcagacaagccagaagagggcatcaaattccattatagatggttgtgagccaccatgtggttgctgggaattgaactcaggacctctggaagaactgtcagtgctcttaacctctgagctatctctctagccagaaccactctaaaaaaacaaaattatttgtattttatctttccattgattcttaagcacataatcatatacttgcttttaggataactactaagtcctttgaaatacaaagttgaggacagttcagtagaacttagaagaacctgatatatatgattggaatcattcattaacaacttctgtgtcttgtattcattgttgtctcttagggctgttttatgtgcacagagagcatgccagtaacagactgagagtggctttggaacaagggctggagagatggcttagtgcttaagtgcaatctctgtactgttttactgttttttgttttttgttttttttaaagagaacccaagttaggttcccagtaccaatgtcaggtagcatacaattggttgctattccgttccagggaatcttggtgccctcttctggtttctgtgagcacctcaccccagcatacaaactcacattcagacaaacatatatacataaacatttaaaatattaaataaaataaaaatacctttttttttctgtgcctcatacccacatacttgcccgctgttgtataaataccaaaaacagtatgaaaaggtacatttagaataatgtttttttctttctttattttctaatactgtgatttgaatttgggtttaatatagggtaagcaagcattctaccaatgattcatatccccatctttctgcttttctttaaaaaaaaaagttattaattttaaatgtatctgcctggaacttgtcttttttcaatggttcttaatattgtgatccgtccttcacgttgtggtgatacttatttctgttgctactctggaactgtaattttgctactgttgtgagtgaattgttctgtaaatacctgtgtgttctgatggccttaggtgaccccaaagtcctttgaccaccaaaagggtcatggcccacagattgatacctgctggactattaatttatcctgtgcatcgaatagatgattacatcatttttgtccaggttccttaacctttttgactcagaatttatccagaaccccaccatatcttaccctcctttcctatactagtttaaatcaccattgtattttacctagattatcctttatctttctaactagttgtagtagcctggactagaactagtttttgttaagtgagtacctaactacctgtctagtcttccatactcataaaagtatgcagtatctgtagcagacagtcgcttctgtcctttctgtggtcactctcaaggcttctaagctgcttagtgtagatgctttagtagcctcaaaggcattgccaccatactccattttgaggttatcttctgtcacttttccttatgtagtggtccttatatgctattctctgaatatgcttgttgtggtcttgctttatgatcctaagacgtgcgtgtctgtgtcagatggtctttcctttctgcaagagttcctcacttttaagtctgttgaaataacagcagatttaccattgtggctgactctggaaaccttatctaaaatccaccatttttttcttcctatgtttactttctgcttctttcctctgtcatagtaagtattctacttgttttcagtcactagaattgagctaccttataaagtgagttggctttgatacttgctatagtctccatgcctggggcattatttatcacatagtaggtgtttattgatttaaaatatagaaatgccctagagttttctgatatttatctttagtctttaagagacattaacaacaacaacaaaaactattaactcagtgaaagagaattttgtaatatttatgaatgaaactagaaaacccaattttatatattgagttttaataaatgtgtttaaatatataaatattaagtgttaattaaatggtggactcatccaacgtttaagaaataaactcatcagtggtacctggaaaagagatgttaatgtagtcagctaatgtatacacagttgtggcactgtaaatatgaatttgttttttgtggtttctgatgcagagcacttaatactacagggatttcttaagctaaaatagttctagttgagtcttgttctgtgagaacacccttggtagtttcaggataaggatcgatcactggaagaaccacaccttgattagacattgaacttccatccttgctccctagttctcaaatgataggagaggggctagagatagttcatcctcaatagccatgtgagaaagcagccattacaaacccctagatgacagataggttctggaaagctcccatgttgaaaaacccagagtattggaaggatgggtatgatgatgctgggcgtgagaaccctccttgttctttgtatgataaagtaataagagtaagtagtcttcctgagtaagtagtttgtaaattgttcaataactaaaccagagaagtggggtggttgtggaatttctgatttttatacctagttaattggctgcagagaagtgtgagtaaccctctacttccctgtggtagctaaagtgtaggcagtgctgtaggagtgagccccgcccttgttttgaattggagtgtcaactttataaaaatcttcctatgcatgaggatttcattctacccttttcaaatattataccataattttcacaaaacatttgcataattttagtctttatacacacatatattaatagtatatgctatgaggactgagcttttacccagtggagttacacctaatactgggtactccatgttggatttaaatagtaagagttaaagaagctatattgaaaaagatcggatgtatttggtggcaggagggaaagcacccccaaattaaagattatttactttataataatacagttacactacatgctgtagatattaaagtaaagggtattcagagaaacattggagcactattgctgatagtatgcatagggcccaagttgcataaagggcaggctctctactgccctactgctgtacctactgactaggagtccaaggctctgcttggcacttgcagaattgcatgccagtgttttctttttacgctcctgtttgtgtgtgtgtgagtgagtgtgtgtgtgtgtgcgccccaccacattgttgaggtcagaggacagcgttttggagcaggttcttctaatgtgtgttctgagaagccagttgtcagtcttcgcagcaagttccataccagctgagccaccttgccagacctacttttttttttttaatccttttttatcttctgtaagttacatttggaattacaaggcacctattgatgttcatcctatgcataacgcacttctcatcaaatccaaaagagcatacctgtcagcagcacttgggaagatgaagaggattgagagctggagtataaatacaaatatgtacgcacacaaagttgtgctcacatacatctaatgtatgtatatagttgaaaccatgttgtatgttttcctctctttactaagaggaactgataactgtttcatactcaatgagggtaaaactaggaggaaatgagaagctaacaggcccccagattgcttgtttatttctgcctggcaacctaggatactttactgttttacttgttcgctagcagacagtaaaggtgtaatattaaatgaggtggtaagttccttgggtcattagacagtagttttgtttgcttgtttgtgtctcatttaagtactttaaaattatttcctcttgtagaagatcttaccagctgcagtgaccagtcaataatgtgcttatttattagcacacatatataacattcagaatattgtttaaaaaatagtattttgtaatataaattttggataacactgtattaagtatttaagttttaggctatagttttgagtagttgagcatatctgttcatattcaggaagcacaaattggctatacccctcaaataaataaataaagtaagtaagtaagtaaataagtaaataaataaaacaaaggacaaagaaggtccggaagatatgtgttgggtgataaggaggtgggaatggggaatggatacattcaaaatacattgtgaagttgtcaaagaataagattatttaataaaataaaatttaaaaatgtaaagacatggaatgagcagagtagaatattaaggttaaggtgatggtagctatgaaaaatctgaagaatttgaattgagattgaaaatgatgatgagaacaaaggagatgggtggggccataaataggggtctgtcaagatctctttccagaatatgcttacatgagttcattattatcaactggctactgtgatttttgtggatgatgataaaaggaaaactggataaaaaaaggggagaaggttatatgaaaatggaaagtattggtataagaaaatataaaataaaataattaggagaacttggattgaaggtgaggaggaagggatgagaggatctagtgtgtaacacagtggtggagtgcatgcactgtgggatcagtcctaggaccagaagaggaaaactgtctgcaggcatccgtaaaggtgatttccacctctgttcctagctcactgaatgactcctgtgttagctaattttctatgataaaatcccatgaacacggtagctcatacaataagcatttatttggttgtgtggctatagagggataagagtctacaatgacagaacagaacagaggcatggcacctggaaccggaaagccaagagcttagcctcctgaaccctaagcaagaagcaaagaaagggaccacagctctcctccagtgcccctccttcaacaaggaaggccacatctccctaagcagtaccaggagctggggatccaacattcacttatatgaaagtataggtgacatcacattcaaacccccttagctcctgtctatctagttgtctcagaaagattcagtaactccctgagttgcttatggattctcatctgagatgttctcatgtcttagaaaaatgaactgtttttcttgtagtgattctttaagtgttgatgggcatgtgaactggttggtgatttttactgtgagattttcttcttttggttttatgagacagggtttctctgtgtagccctgactgtcctggaactcactctgtagaccaggctgtcctcgaactcagagatccacctgcctctgcctccaaagtgctgggattaaaggtgtgtgccaccactcctggcttgtttagggcagttctaattcaataaatgaccaaagtgtaccttcaaaaaccatggctgtcatgttgcatcttgctgtggttgttgaatcaggaacaagagtataagacttagagtttctctgtacccattgccagagcctcctcagaaaggtgaacacctggtcatttgactcagatgactttttatgtttttgtttctaaaagaaggtgtcttggtctgatgcttaggctggattttaattcctgggtacaagggatcggcttctcttatgcttataatcaggcttgggctttcagctgctcatctgtgtcagttctccttttttattatactgtctcccgataatagaatgtaagggattctttgagagttacagaatgagactgctgtcagaattcagtctgaaccatatggaacaggggatggaggtcacttgagttcatagacagctttgattcctcaggacatggcagtactttgtccttttgtgcttttgcctcttcctgaaactcctttgcacccccagtcccccttctctgcttggttgatgctgctgcagagttttcctcagtttcctacactttcccacttggttgagttagtgacttgaaacagatatttgtagctattccctatgcatttttaaaatattgaaccagaaacttttcctggcttatcaactagagattattttgcctaaaagagtgttaaaagagttcaaggaaatatgttaagctaaatgtcgtcatgtcttatattttctttattttagtagatggttcaaaaatagtgatcaataacttaatgacccaatcttcagagaaagtatagataggtaattaaaagatctagaaaaagatataggtaagtatatataggtaattaaaagatctagaaaaagatcttgtggtcctgttacatctgagcttcagttgactcctaggattctagaggtgactttagagcctgttggttgttggttatggtcagctgatatattctaactttattaagtattttttgagaaaaagaatataaacaattgttatatgaagtattatataaatgcagacttctgtgttgtatatcttgctccaatagtttgagatatgttataattgttttcataattaatataaaatgggaaaattaccattgtgctttataaataatatagtttaattaattatatcttctgttgcagtcaaaccatcactgctgtttttcatattctgtatacttgaaaaagttagggccttgcttgagagcagtatatgtagaaagaattttttattatgtttataattattgataggttggtattttaatgtattcatatgctaatgaagttattaccttgtcaaaaatttacttttatttgattgattgttttgctttcatgtatgtttgtgcacctgttgagaccagcagagggattggaaaccctggggctggagtgctagatgattgtgagctgccatgtaggtgctgggaacctgggtcctctgcagagcaataaatgctgacccatccccacactgccttttccttagtgagatcgtatgtgagaaaagcatttgctttgtcttcatgtattataaaaaatttaacagatgttcatggtatttagatattcagtgcctgtgagtttctatttgtggattaatctaaaccggtagagtaaatataaaaacctatgtctatatccagttagagccttgtattttttttttaattgtgctataaaaacttgtatctgatgtaagttttaccttctgactagtttttctttaatactagttaggttatatgttgatgtattaacatttccttaatattcttggagagtttagagctacttcagttacagattgagttttggatgtatttaataaaaactcttaagtagcagtagctaaacaggagagaatttttgttgttataagtggagaagtaggtgatccattctttggctatgacagtattattcttgtggtttgtccttcatagtgacaacatagcttgtttaaaaaaaggacagaagcttcatattgtattattttgttgctagttaaggagtactttattggctaccctacctcatctcctgatttacatcatgttatcttctctatcttccaagatactgggaaacgtgggtatcaggcactttctgctacttacagaaactgttggtatgaaaagcaggaatagatgggtataggattgacaacttggagttcacaccctggagcccaccctgcttgtggatatttctcatacccttgttggacgcatgttttccatatctgtaactcttctgaaaccaaaagctagatatgctgtgttttcaattaaatccccaggttcagttacctgcatcagtcttgcagctcacaactgtctgtaacttcatgaccaagtggtcttaacttctgagccactctccagcccaagcttttacctttgcattttcttgtctatttattcttttttgttgttgttgttgttgcaaacagtcacttgttaatttaaatggcttactaactgtcctagagttctttgtcatagggccatcattccgttttaatgataaaaatattgaaggctggggagatggctcagatggttaggtaaaagtctgaggacctgagtttgatccctgtaaccataataaaggtggaaggaaagaacaatttcagagatttgtcctccttcctctacacttgctctggcatgcactcagcacccccaatccccgtaagtctagagatacgcacacacacagtcacgcacacacatgcatacacatcaaaaattttaaaattggtattggattaaatttagtacctcatacattttaagtatgtgtttaagcaatgacctttatcttcctggtcccctgtaaaagtggttcattagggtttttaaatgttcacttttaatttgtattcttatataaaagacattttaaatcttcataatttattctcataatatgtttatcaaatttgacagcagcatatttagctaatatatagggaataatttgaaaagtatgtgacctttaaattttggctttaatgtaacatcttttccagaagagctgtaagccaggcatggtagagtacacctttctttaattcccgcattcaggaggcagtcaggtggatctttgtgttccaggtcagcctggtctatgtagagggttccaggatagctagaggtccacaatagagacctgcccccaaacaaaacacccaggaaaagagcctggcaaagtgatacttgccttcaaatctcagcaagcactaagttagaggaaggtggttctttgagacttggaggccaaactggtctaccattgtgcttcaggccagtcaagattacatagtgaaaccctgtctttaaaaaacaaaaacaaaaacaaaataaccaaaaacaaaaccccaaaacaagtggatgcttataattctagtactcaggcacagaggcaggaaaatgaggagttcaccgtcagcccactgtggccatctagtaacaccatgtcttaaagcatacaacccccccccccaaccacttacacatacttgcaataattttttttaaagatttatttattattatatctaagtacactgtagctatcttcagactcaccagaagagggcatcagatctcattatgggtggttgtgagccaccatgtggatgctgggatttgaactcaggacctttggaagagcagtcagtgctcttacctgctgagccatctcgccagcccgcaataattttttaatactttagtaacttgtgtttaaatattgtttaagtaactagtcagattgcccgagcagtcacattaagattattagtgttcatgtgcttgtaagcttatttgtaccatgtacttccaagagtgattatagctcagaaaagggtgccagctcccctgaaacccgaggtacagggggctgtaagccacctggtgtgaagagcacttgagggagctccctcgtcagcattgctgtcagtctctatcatcacagaaacatcccataacaagtgtacttttaccagtaagtcctgctttctagaaatgtaacggctgtgaatgagctgtgtgcactgaattaagcaacctgtgaactaacatgttttcagattcctaaaagtgactgtttgttgttaaaattgtcttaactttttattaggattaagtttttattatactttctctaatataaaagaaaaaaaacaatttttttcaacctttggaaaggtagagttttataaatatatgttgtaaacatagtaaacataagtttaaatacaaatagaaattcagaagtgttatttaaatgtgtgatttctcagataagaaagctgtagactttgctgtaatttattacaaagctaagttatgttctgttacttatgtaaaatagtggtctttgtttagcttcttaaagtgctaggagaattgtgtagttccattgattgcttccatgcagtggaaatctgacctttagcagatgtttgagatgttgccagcacagcatggtcaaccagctagacagtttccccttgttttttgacaggcctttaatagtttagtaacatgccaaattcttttcattatatctgaaactttgtaacttattaacaacatactataagatattgattaaatagccttcctgtcatagattacagccactaacttaagaagaaaccatttttaaaaatcttaaaaatattgttgagtgaataatattttgagttgtcagtttggactgaaattgttaaggttacatgcatatgtcgcatttatcttgccagaagtagaaattatttcagggatgtcatgttttagtggtagttttaggcactttcattagttgacacttttaaaaatagtgactttttaataaggattgtttgtttgtttgtttgtttgtttccacagagcagatattctgtctagaacttgaatccacattaaaacttgttccctgaaagaaagccggtttttttttttaggccaagtaataggttcagctgtgtagttgtgtagttcagctagaacactgtaagctctgttttcttaactccatccactgagtgcacaggaagggagaggaggagagccttaatgtttgagaactaagtcatgaatggacaggcccagcacttgccagactgcatcttttcctgcaggtgttggttttccataggacgtttcagttgcttttcattgtgttagaaatggtacaaaagattttatttaagcaacatttgaggaatagtcttgtatgttttgcagtatggatttgtagccatttttgtgttcaggcttatatactgtagggaattaatattagcagtgttggtatacctgtgcatataccacctttcaacagtaaaaacttaaaggcctaatcaataccaggaattataagagtatgctaactaaaatagaaaagatgaaatacatataatacagtttcactaaataccatggaccaaaatactgattacatattacttacaagggaatgtgagttactactgagttgttttaaaataagtgtggtaataattatcccattctttcatactagtgtttatgagcattacctataatattttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaacaaagagggtaggggggtggtttttttttttttttttttttttttttttttttttttttttttttttttttttgagatagggtttccctgtgtagtcttggatttcctggaaacttgctctgtagaccaggctggcctcaaactcagagattctcctgactctgcctcctgagtgctgggatgaaaggagtttgccaccagggcccagcctagttttctcaaggttttcattatctaccagaggctattatttttgtgtgtgtgttttcaccccccacccccagttttgttgatatgaagttattccttaagaaaatttattttgaaataggtggtatttctagttgtttgcttaactgtctgaccatctgattgcaagtattcctgatgttgcggtcattctttttgttctacttggggttgcttacatttttactgattttgttgttgtttgttttttttttcattgtaatttaaaacagccataatagtaaaatatgtacataggaaattttgtagattcaatttaatgatatatacctgatggataatacctgtaccaataaactcattttggaaaacatacaggttctgaaatgggtctatttcttactttaatttgctgtgatctgcccgtggtaggaggacactacagcacgagtgaggctggcagcctggggtggcaaagcatgtggataacattttaccacacacaggaaacagcaggccagcttgttggaaagtctccgaagtctaccttttgagtagtgctgtggctgtcccagcaaggtccagttcctaaaggttctgtctccatcgcaaacagcagcactcctaggcacccaggactcaagcctgtgaacctgtagggaactttttatattcaaagcacacatggagttttctgagtactcagttttatatataattacactgctatactgtcatctatatttgtgtttagaatctgggattttagaggccagaattcccaaatctggcaggaaattatatgcttcctgaaggctatagtggagaatcttttctggcttttatgaatatatgacccagtctattattctgttatatttgttttataataagctagctagtgttacatctatggtagtggcattaaaaggtagggcactactgagaaacgtgaactaaatgtcaccttagtgtgcaagtacaataaattaaaaacgttgtttaatcaacatttggttttgagtacaaatgagaaccaatccaaaggtggaaagattagtttggcttatgattttagaggtaggtgacagcccaagtttgtttggttctgctgtttgatatcagaagtgagttagaattgtccatggagcctgtggcccaggtttctcccttcatggcaaccatgcagtgcaaaatagccagatggggctagggccagctaaaacttttgaaggcaaaccccaagtttcctacttcctccagttatgctctgcctcctgcagttccaccagctccctgaagtctactcagatttttaatccatcagtgtcttaaaccactgattagttcagagcccctatgtttttagttgttgcaagaaatgtcctggcgtacatatgttcagaaagagtcacgttttctgcacctgggcatcatctctcagtccatcttgtttatggtctagattccccattcatagtgtactaagtatactagaaatagctcttaaaatgtttttcttaaacttactgtttgcatccacatacttgcatataccacttgtgaatgtggagggcagaaggacaactgaaaaggttctttccctctacaatgtagctatttggggatggaatttagatagccaggctgtgcagcaatcacctttacatgatgagccaggtcactaactcagagattatcttgctatgtagcactggctgctctggacttaatatgaatcccacaatgaccctgaactttcagggacaatagatgggttccacttcacccagctggaaatagtctttgtaacactaaaagaatatgggaaaggaggttataatgggaaagacttttttttttaattgtttgaagttacattaacacttgcatgttcattgtgaataaacagcttaagctctgttgagaatcatatgtcaggggaatagcattacttacccatattttgaccatctgctttatgtaagattattgaattaacagaataaggattgtcatgtgaagatgatttctttaaaggactgaatatagacaaagagtcatggaagaacaagaccttgtcctaggtcctaaactagcaggaaggcaattgaaggaacactgttatgaaaacccagttgggctggcttagagagatggcagtgctggtgaagagcttgtggtataagcaggaggacctgagtaaagagtgcagacacagtccccattgaacctcactatagaagtgcgtgtaatcctcctgtcagcagtcatcttccccaacttgactgactattactcctgtcctagagacctactcataaacatctccaggagcaactcgcttctgacagtcctgaggtgggagaggcattgctaaagcactgtcactcacatagactgtgctcagtttttctattggctgtacgtctcccccagagagtcataactgggggcttttctgtggtagactcttgtttactggtattccccaactttgggcttagcttaacttactttatttcactaacctacccctgccattgctttgattctaccatcagtcaattatgttctttagtctgtgtgtgtgtgtgtgatccttatcatctagtcatgtactatatgtactatattattaatatgctcataccttgacattttgtacctaaatctttttagtcttttcataatattttgtctttaaaaatgtagataatacttgccttaatttccccaaacaaaagatttcaattgataataaaaacttaacattaattataagatacaattagctcagtaaaaactttaagaaggatttatttgtgtatgtgtgcatgcaatatttatttgtgtctatattctagattgagtttttctcaaccttctaatgctgcaacactctaatatagtttttcatgttctgataaccccccaccataaaattattttgttataattttgtaaatttgctactgttatgaattataatgtaaatacccaatatacaggatatttgatatatgccattcaaaaggggtgagacccacaggttgagaacctctctaagagaaccttctagactctagaagatggcattgagggagaggtgcctggagagatggctcagtggttaagagcactaatttcagactgcctttcaaaaataacactttaaaaaaagatttaacttaattttatgtgtgagtagtttgcctgcaattctgaatgttcaccacgtatgtccagtgcctgcaggagccagtccagggcatcagatcagatcccttggaactagagttccatacagttgtgagccaccacatgggtgctgggaaccaaacctgcatatcgcacccctagcccccattttataggacacatttttttttctttgtttccaaagaatgaggtcatattgaaaacattagaagtacgtgcctaattcaggttcatgcttattttggttctatagataaacactaatttaaaactttgtggctaaatattttcttacttttctcatcttgaattcatttactttttaattatgtttcttctaccttttccagttttctactcaattctccttggtggagaagatagaacaaaacaggcttcatgcgagtagtttattctctctgcatctgttaattctatagcctcttcctttgtgataatagccttgtttctcctgaattcatcctcttacatttatttagtaagtgggtctattcggtgtcctttctgaatctgagtcaaataaatgagaataatttataagcattcttatttatgttttcctgcttctagttttcaatatatgtactttaaaaatttgagaacagaaaactttgaaccgactttttttgggggtggggtgaggacttagggattgagtttaggggcttgagcatgcagtaaatgttctactagtgagtgcgccatatttctagcctcaccccaccctgtgcctgcatgttttttatttaccactcatcccttcatttattcagtctactgatatttataaaattaattgcatatatggtgccctagaaagtaaatattgatataacttttactatatatattttatacttttatagggaattttcccccccttcccttctccctcttgcttcagcccctgctcgctctgggccccactcgccagcctgatatacaaaacaagtcccaggcagtgaggaccacatagctagaccttgtctcacccttccctcccagaagtgttttgttgtaaatgtatctcatgtaccaaatggtgtataaatgttaataaagaatatttctccccacccaggggtccatcccatagtcagccatcaaatgcagacactattgcatatgccagcaagattttgctgaaaggacccttctcctgtgaggctatgccagtacctggcaaatacaaaactggatgctcacggtcatctattggatggaacacagggcccccaatggaggagctagagaaagcacccaaggagctgaaggggtctgcaaccctatgggtggaacaacaatatgaactaaccagtatccccagagcttgtgtctctaactgcatatgtagcagaagatggcctagtcggccatcattgggaagagaggcaggccccttggtcttgcaaactttatatgccccagtacaggagaacgccagggccaagaagtgggagtgggtgggtaggggagcaagtggggtgagggtataggggacttttgggatagcttttgaaatgttaatgaagaaaatatctaattaaaaaaagaaagaagttaaaaaatatttcttctgctatatggtcattgtgttcattgtgtttgtgtaaatagatcccactgtgtgtttatgcttaaatttaggtttttaaaaagcatttgtcatttaataatgtactcaaagttcatagttatcctttgcctaaatgcaaactatgaagtggaaacatgctaggcatgtctctgaatcctagcgcgtaggccagagtccagcaaggctctgtgagttccagggcagcatggtgctctacagaaaagttctaggtcatcccaggacacaacacacactgagagattgtctcaacaaacaaaaactcgttattccaagaatttgggatattggactggagaaatggctcagcagttaagagcactgattgctcttctgaagatcctgagttcaaatcccagcaaccacatggtggctcacaaccacctgtaattagatctgactctcctggagtctgaagacagctacagtgtatttacatataataaataaaataaataaataaataaatattaaaaaaaagattttgtgatgcccataaacctcaaggattcatctttcttttgtagctttatggaaaccagctttatgacaagattcccacttggtagacatattccacctagtagatgatgatggaatgatacacttagaatattgccattttgtagatttaagggaagtattggattcagatagtaattatcattggcgcaaatacatcatgtgtacagataatttatggcttttcttgagtgttgatagaaaatcttcctgggtggcccttagcctgcctcagtctcccatgtgctaggactggtggaactacaggtacatgccagtattgacaaacttatggatgtatgtgcattgataatccagcacttgggaggcagaggcaggcagatttctgaattggaggccagcctgatctacagagtgagttccaggacagccagggttatacagagaaaccctgtctcaaaaaaacaaaacaaaacaaacaaacaaacaaacaaaaacttaccatgctacttatttggtagttttctctaataatcctgaatttcagtgtggtggttttaatatgcctggcccaggggtggcactattcagagatgttggaattaggtgtggccttgttggaagaagtttatctctgagttcaaggtccatctacaaagcaggttccaggacagccaaccttaggcagtgacagaattggaaaactggtaatagagtacgggggtggaggggttcatttccatcaagcagcagaactcaggagccttggccatgtgcctttggctctagagtcaagaaaattgatgctggttagctagagctatattagcagtgaagagaccggcatcattgaagtgatatcttctgggcaatgtgttctgagagcacaaagaagcagcgttctagagatagccaagattgtacctcatgctgcagctggacttggtaatgtgtaagaatcacccaggtggtactggttttgaagatgtgaatgggtcacggatagcagctgagacttgtcaatgtgagaggccagggaaggccattggtgaggtgcagcctcagttgcagttgatggcccaggactgaaggggtcatgcaaagaagttgaggcttgacaatatgaagagagcctatgagaggctattggtgaagcctagttgcagcagaagatcccagcatattggagatgccagtaccatgggatgatcaccaagaacagcagcaacaatggagtggatcaacctgaacttagagtgctcaagagggcagagcagaagtgacgccagcccagatcacgtgtgcatccctaacaatggaacaagaagctgtgatttgaagttgccttggagacccaaagatgttaaaagtgccagcgctgtgggatacctattgtggaaagctactaacaaggagtagaaccagctcaggagaaagaagtttgttgcagtcaacaaagatgaaaaaggagtcagaaatctgaagatcactttgacatcaaacatggagatgtagagtttggagtttgcccagctgatttcttgttttgctttgagaattacagtaaattgattggatgaatctcagagacttgagctttggacttttaacattgttgagactgctgtagactatggggactttggaagttggagtagatgtacttttttattatgctatggcaaggtatggccctcatagactcatgcccatgggggccaggaagcagaatgtggtggtttgaatatgcttggcccaggaagtggtacagttgtggggcatggccttgtcagagtgggcatggccttgttagagtgggtgtgtcactgtggttgtgggttataagaccctcatcctagctgcctggaagtcagtcttatagcagccttcagatcaaggtgtagaactcttagctcttcctgcaccatgcctgcctggatgctgccatgctcccatcttgatgataagggactgaacctctgaacctgtcagccagacacaattaaatgttgtccttataagagttgctttggtcattgtgtctgttcacagcagtaaaaccctaagacattgattaagagtgtattaaaaagttacaggaagtacaaggacagaggttcatgattaaagaaagcacactgaatagtctaataaactaatggcctgatttctttaataatagaatcatatcaggaaatgtataaacaatggtagatttgagaggcacgtcaactagttggaatttgtggacctttgaagaacttaaagcattcaaaatgaccgtcctgggaaaagtaaatgctgacttactataaacagattttagagagtcggttggtaatgagattgttgaaacaactgagcataatggtgcacacctttaatcccaaacctgggagaaagaggcaggcagatttctgaattctaggctaagccggtctatagagtaaattccaggacagctagggctacacagagaaaccctgtcctgaaaaactgactgactgacggatggatggatggatggatggatggataaaaataaataaatgtaattgttgaagctgacaatgagtatattatgttcatgtttcaatactaaacggttaaaattttgtacgttgccttttatatattttcattaatttagtatactaaactaagatgtacagctttttctccctttttaattttttgagtgtgggtattattactaaaggcctgcaccaccaacgcctggccttttaaaaatattttaagtgaaggaccagtttatacttgcagattttgtggttatttttaaaatggaaacgttgcagttggctagtaataaagatcaaagttcctccttactgggcttaattttaataggatgataaccttctcctgaattctgttttcctgtaaaaattttcacaacctgaaaatacaaatatctctgaatatgtacacgggttattttccctccccacccttaccttcagtatagggcatgacataaaactgtgtgcctgtgccccctgtatcttttgtggaaagatgcattaaagtgtggtggctcatgtatctaagcctggcactcagaaacctgagccagaaggctttttcagaaatccaagtccagactgagctacattgtaagtacagccagccagtgctaaatagcaagattttatctgaggaaaaaaaattgttatccatttctcaaaggatctggactgttttctaggatgcctttataagcaaaacagctttgaacttaaaaaaaaaaagtagttttctttttatctaaaactctcgggaaaaccatatttattgtcatttaattttggatcacttctgtaaattctttctctctccacgtaacttacactatttccacttacatttcatttctttttatgtgcagactgtcagtggctcactttcttcagtatctgagggtctacagtcttgagtttggcttttcatcatgaaaagcacctgtgttcaaagattttcacctggttatttatttttggtactttctttttctgagaaatattcgtaagttctgtctttatacacatattttgttaaatacattatttgtattttttttttagtttatagcttttttcactatgtcaatattaacttgtcacagagtaaaaattaaatttgaaataatttcctttttcacatagattatgatcttaatattatttctaagaatcattttgctacccagcggtcataagattttggctttaaaaatattttacttagtacccttaagtctaagtctaagcaattgagtctaagttttgtacaagatgtgaagtatggattcaagttagatagttgcattgttgtgtctctgacatgggtttctgattatcagtatttattgaggggacttatccattttcctttgacatgaatgacattaaacatttatgaagaccaggtttcatttcttatgcatttattttgtgtcatcttttcattgatttttgtcttctatctttttggcaatattcttatatggcagctttcttttcagctttaatctttattatcattgtgtgtgtgtgtgtgtgtgtgtgtgtgtgtgtacattggggagcatgtaatcaggtgtcgggcagtatctgcagttggctctctccttctacctctgtgtgggttccagggttcagggtttggacttagattgccagcttactcagcaagcccctttatcgcctgtgccatctggtcaacccagtgttcagttttgagtcctgtagttttagaaatctgattccttctttgaaattgttttggcttttctattttctttgtactatggttttttctttatggtacataaagaaaatctcgatgggcttgtaattggaattatactgaatctccaaatcagtttgagtagaattgattttaataacaaaactgaaactcttaattcatgaatttagatgttttgtttattccgctgaacatttgattcccccccccccctcccccattatcattttgtagttttccccatatatgttctaagtctatttgttagattactccattgtggtttctacttagctctatgtacttgtattacttttctcattgctgcaataaaattcttgacaaaagcaactataaagggagggagggtgtattctgcctcttagactgagggtccagccccgccatggaggggaaggatagccggaatgaggtgttgttcaggttacactgtgtcttcatcagaagtagagacacaggaatgctggcgtctccgtttagagtgactcttgtccctcagtttcctaacaggtgtgtcaagagagttgtctcagcctgtcaagttggctgtcaatattagtcatcataagacaacttagtgtttgaaatggcctattccaactcaagtctttggaaatcaacaccgttgtcacaggtttagcttctgctgcaaattatcacttgttcagatgtcaatctttgttagactggcccactggcccacccagctagaaagtgttcttcatatgttactgactagctttagggtttattagtaacttataacccaaaaaatgtagggttaatttatgttttaaatgagactgtattttttccttctactttaaattaacttatatttttatatttgatattagcccagagataccatagtgaacataaaaaagttttttaaaaactgcattttatggctatgggtgtttttgtgtgcacgtatttctgcacattacataggtctttttgtaccagtggaggacagagcagggtatttgatccctggaaatggagttccagaaggttgtgagctgacatgtggatgctgggaatcaaacctgggttctctggaagagcagcaagggcttttacgtgctgagccatctcttcactctctgtggttaacattttagaaaaagatgagttaaacgtcagaccatcagaatggaacaactctttattttatttttaagttctctatcattatccaaggtattaaaatgtacccttattatttgtgtacttggataatcgaacagtattcagtataacccttctctcctcatctgaggtctgtctgtagacactgctgactgagatttcttttggagcacttaggtcatctgaagtttctgattatggtaccagtagtcattactatgtcaaaaagtaatttcatactaaactcactcattctgaagtagattttaaaaatatactcaaaaagaaaacagatttcaagaatcttatttgttaataaaatgctggagccgttcatccttgttaggttagatgaaagaaaaaaaaaaaaaggaaggtgtggggtgcatgcctttaaccccaacatgagaacaaaagcctggtctgtgtagccagttccaggtgagtcaagtcttacacagcgagacctttttcccttaggcttattgaacgattactatgctgtctgtcattcctctctcatgtttcacccgaggttaataaaggtaattgtaagggtccactgcaaacccactgccagcctcttaccttatattatacaccagtgcttgctgtgtaatatgagagctaggctctataggttgcagatagcagtgggactgcatttggacctcagttgttttgatgttttggttgaatccagaaaaaacaattgaagtgttgagatgccagtttacgtcgctgtacatgtaccctcagtccttcccttttgcagtgctagagacgagctaattacgtgttctatgactaagccacatctttagcgtgatttgaaatatttgatgactgttttagttagggtttctattgttttgatgaaacacgatgaccaaaaagcgagtttgaaagaaagggtttatttggtttgcacttccagatcatagtccatcattggaggaagtcaggacaggagctcaagcagggctggaacctgggggcaggaactgatgcagaagccatggatgggtactgtttatggcttgcttctcatagcttactcagcctcctttcttatcaaacccaggaccaccatcccagggatggcaccacacaccatgggctgggccctccccattgattactaattgagaaaatgccttacagctggatctcatggaggcattttctcaactttaactcctccctttctgatgattctaacttaagttgacacctaaaccagccagtataggaacctaatcatagcagattttaattttgaatttttgttacaatattatttgtatagaccaatgcatagatgaatcttgaaataacactttcattgtttttgttattattttatagaatatttttcttgatagtctagtagcaaatcagggacgctctatagataaactcagtggtggttatgtacagtgaagctgttagtaaaggatttaatgttggacacgtgttatctagcatttcgttgctgactaataagtgctgaggagcatttttgagccactctttttaccagtagtcatttgagtcattttcatgtcatagaagtgagtaaggttcttgttctacaacgttccagcacttgggagggcaaaacaggatggtcacaagttagagaccactctgagctacatattatacaagacctctgccaaaaagatgaatagtaatgttaataatgtattttctaattctgcttcataggttaatatcattgctgtatgtataatactcaaattttatgttttctttttctttttttataggtctacgtggaatttgatgaccttgagtgggataaacgggagtgggttagagtttatgaagatttttcaactttcttggtggaatatcacttaatctgggccaaaaggaaggaccctagccagactcagggatcaaagagcagacaaattcagtggcctgcactggtaagatttgttcctgttttattaattgttctcctttgtttgtctaagatgagtgagcactgaatggaagttagatgtgtttggctaattatagtttaatattcttgaaaaatctagcagaactttcaaagcactgttgtatttaagagtgtttcagtttaattaatattttttcagtatatttagtacataaactgttttatccaacttggtgaaaacttaaatttggttatagactagttgagaaatagtcattcagatgctgtctgtatggtgtggaactgctgtgttgaatgaaactttgaagtgaaagacagacagacacatggcaggagaagacagacatatggcaggacatgattcttcttggttttgttaatcaatcttcactgtaagtcataacatgttcaaatagtgggacaaattaatttatgtcaggaaatggtttgtttgagaaaacatttttttttgtttttttgttttttgtttttcgagacagggtttctctgtgtagtcctggctgtcctggaactcactctgtagaccaggctggtctcgaactcagatatccacctgcctctgcctcctgagtgctgggattaaaggcgtgtgccaccaccgcccggcgattaagaaaacattttaatgcatttctcattatttaaagagtttttaaaaagaaacatactaactaaacaagattactaaattctgtgaggcaagctaggtatggttgtatgtgtgtataatcccagccatttaggaggtgacaatgggggactttagatcagcatcatctacctagtgagttctaggttagcctgatatcctttaagaataaaagaaaattttattaggcaaatagtcacatttaataacttgttactgttttttggcaaaatgcctatcaagtgatgaataagcagtgagtggctcctttaaactaacctcatattagcatgctggaaatcttttaaaaattaataaacagtcggaaagatgtaaaagtttgaacttttccagaggaccagagtttggttttcaacacccattttgggtggctgtgcctgtaactccagttgtagggcatccaaagacctcctctgacctctggatgcctgtacgcacatggtgcactaagagattcacaccagcacacattctagaaagccattaaattgtgatgagtgatccacgttagacacttttacccccaaatttctaatattgagattaaacctgggcctcaagcactctactaaggagcatatctcttgccttccaagtttttaaaagtgtaatttgcctacatatttttttcttactttagttggttaactctttaatgcttttctacatataaaatagaaatttactttatctatttttgagcattccttttacagtttgaaggcacacatgattaaaagtagatagaggctagggatgtaactcagtagaatacttgtgcatatccacatatccctggattcaatatagatagaaaaattttaaatattaggagatgggacaaagggaatgaatgaaatcaactgaataaagcatttcaaaaggaaataaagtatggaaatgattttcatgaactatatttttgatagaaaacttccaaaaagcagagaatcacttcatctgtgggcttaaacaagtttattaaatgattatgttccagctcccagtattaaagcaaaagcttaacccaggtgtgtgtgttggcatgcctttgatctcagtgggtgaagctcagtgagttccaggccagcctggtccacacagtgagcgtctagatggccagggctttgatgcatacgttagggttaataacagatcaacaaccacagaaaattaagctgtgacttgcttttaaaaaaacatcccagccattcgattttaccaataaagactctggtgccagatgctcagagagacagagaaagcacccagctggccttcctatcccaccaaagtcccagaaggaaaagccccttctccttctgcaggctgtcttaaataccttccagcctgtgtccctcctttctgtttacttaggctcactccctggctacttgctccctctcttgaccttaggccaagtttatttagctctcagattaaaggctaaggctgagccacaccacaacaaggtttttccagttcacactctcggggatcacaatgtgatccgatatcatgcagcaatgactaacatgatgtttcagtttctacaccttaacttaaaactcagttcaaacatatgatatatttgtatttgggtatgagtgttatatgaagagttgcaaaagtagtaggaattagtatcataaataaccaaactatattatcctaatatcatagttgaagagtaaaatcctctaggcaaatcattaccctctcttaggttgaattaaagtcaaggtgaaattctgattagtattaatacatttcctacttgctgaaaaatttccaaggaactacttaaaactatttttgtcagtagtgtaaaatgctgtttctgttgaaaattttttaacattagtgcaggaaagatggctcagtgattaagagtatttgctattctatcaaaagatgaaggttcagtttccaatatccatatgatggctgtcttgttctccactacttttcttctggcccagccttccagatcacccacccagaatgaatcttatatttggtgtttctatagaattatgtttgtacttctgtttttataaccagctcattttgttttttattgtatcttttcatgtctatcttttaatagactgtacattgtttaaagttaggaattctatgtagttatctttgtgtgatttgtaagaataaagcccagtgctataccaccatagacagtgaatcaaagtggtaagtggacaacagcctggctagataaaagttacagcaaatttctatatattaatttatgttaaaggaccaagcatattctggtaaaatgttaatttattgatttaaacttgccagaagagtgtaaatactgaagcccagagcacttgtgttgcagaacacaaaaatctggttcttactcttagtgtgtgttttcttttatagatatgcaattctggttagtatgtaaacctttattaatttattttagattctttgcccagtaagaatccttttacataattgtatattcagaaaaacaactctttgggataaaacgttggaaagttgatttagattatggcctcaaacgtatgttggttactgagatgtttagacatgccacatcccaaataggaagtaaactttagggtaaattcatttaaagtgttagtgagtttgtaccattagaattgttagtaataagttggctctgtcctcttgtaaatagtgacatagaactgaagtatgcctttagcgttgctatttcttagaaaggtaaagcactttaagaagataaggttacaaagaataaattagctatctttctaactgactgcatagaatactggtaacaactaagcacattgattcattcccttgtggattacagattatcatttttctttccttccctccctccttccctccctcctcccttctttcctttctttattagagggggaaggaaggatatcatattgtgagaatcaaagaggggcctatgagatgttcagaatgtaaaggcacgtgtcatcaaacctaacaccgtgaatttgatacgggatccagtatggtgaagagagacaggaccccacacggtgccctctgacctccacatgcatgccacagtacatgtgcacctacagccacaggcaatctcggccaactctccatgcaaataataggaataaatctaatttgaaaatgaagtcatttatactctggtttattaatttagttactatgaagttagtcttaaaatacattttaaatgtagaaaatgtattcaattcatccagtgtttgttaaataccatgttggcataatagaagttatagacacaaattacctgcagaaattggtatagtcttatttaaaaaaaaaaaaaaagagtcctccgatgttcagtaatttcaggatatttgttaaatattcttggagaaattatttagttttaaaaagtaattatagagacaggggtgatggctcaatgtattaaggcccttaccgtgcaaccaagagtggcacctactgtaaccttacacttgggagcagggagctgcttcttatattctacaagggagactgcctgcttcaataaacaaagtgggcagcagttgatcaaaacaacgaacttttacgttgcacccatacatacttgtatatacacacttataccatatacaaatactcatgaaaagtatttttttttttttaaagatttatttatttattatatgtaagtacattgtagctgtcttcagacactccagaagagggagtcagatctcgttacggatggttgtgagccaccatgtggttgctgggatttgaactctggaccttcggaagagcagtcgggtgctctaacccactgagccatctcaccagcccgaaaagtattttttaaagaaatgataaatacgcatatagcatagaggaataaattgaaattaaaactctaaatcctgcttactttggagtaagagttatatattttagaagtgttgttaaataataaatatcagttatgattatgaaaattgtgtttgaatttttaaaatgtggtttttgcagatcctccctcttctcttaaaaaaaatcaaaagtaaaaacaagcaaaacaaacctccagggtctgtctacgaggctctgtctggcctggaatccaccatgcataccaagttggtctcacactctcaaatcctctctgcctttccactgctgggattaaaggtgtatatcaccacacctggtaaaaaaaacagtcattgacacgacagtattgtctcctgttatttatgttggaagtaattttcttcaaatagttattttcatatagttatttagttttctggtaataaattgatagttttatttttgttttgctaatatattattttcactctgttatcactacagagaactaaaattttacagtgcaaatgacagcttaagctataacaaaaataatagtaaggtttgcttcttagaaagctcttgactgtttcatggtttgtgtgtaatgtatattggacatgctcatcttctttgctttgtcccacctcttctgagtttttaaagtctgtttgagttacctgttcgcttttagatttgcataatttatgtgactatagatatcacctagttcttcctttttggaatagtgaagttgaaaaagaataattagaagttatctatctgcatgtacacctgtgtgccagaaaaggacattagatcccataacaggtagttgtaagccactatgttgttgctgggcattgatctcaggacctctgggagagcagccagtggtcttaactttttagctgtcgctacagtgctaattagaagtaattaattagaagtaattaattcactatataatatactaagaaccagactcttaggttaaatttcaaatcatgaccactattttgtgagtatctgggctactcacaaaaaataataatgtatttattttctgtatatctcattttgttcatttatagtacatacttcaaaagacttaaaaattaagcaagagctgggcactcgggaggcagaggcaggtggatttctgagttcgaggccagtctggtctacaaagtgagttccaggacagccagagctacacagagaaaccctgtctccaaaaaaaaaaaaaaaaaaaccaaaaaacaaacaaacaaaaaaacaacaaacaaacaaacaaacaaaaaaggcaagaaaatatgtagctaaaaattgagaatagtgttggaacgagttttgccgtatgcagtagtctttgaagggtgtctttacaagggtatacttaacttctgatcctgtttcttcttgatggcttcccagaactatcacagggtctatgatctcctggaactcatagaacttactgaacatttgtaaatactcaagcctacctttgcaattcgagggttttcagctggcatgtactcctagctccttggaaaaggaaggtgtcagggtaaggacagattccatcagagttcaaatggccatggggtcagacccatccacccacctcatgccaaaacagtttattctcctatagtcatgtgtgtgcacgtgtggagttggttgtggaggccaacaggcctaggctgaccctggacctggacttgcaggtagtgtgagctacttgatacagatgctggaaactgaactctgattcttagagcagtttctgagccgtctctccagttctttcaaaagtaatttataaaatgttttagtacttttcagttaaaaagaatgttacttatgtgtgtgaaagtgtacatgaatgtcatcaggtgtgtgggagtcaggagacacctggcagagttctctttttgtattctgtgggcttggcaggacctgttctcatcgtcagacttgggagcaagcaagcaccttacctgttcagccatctcacagaccctgattgtgattttaaagacattgctgtgttggtaatataggtgtatatttccgatagttgttatgatatatatgaattttacttcttttaatatttaaaaaatgatttatttatgtgtgtctatgtagatatatgtatatgagtgcatgtttcaatataggacagaagaggtagtcatatccctgttttctggggctatgggcacttgtaagtcaccagacatagatattgggaattgactccagatcctctagaagcccccatctgattgttcctttcccatccaaatacataatatgtgggcatgcgcgcgcgcgcgcgcacacacacacacctttttaaggtcaggtgttcaaattcatgacagccatgtgagagggagcagcacgctatagttggtgccacccctaggcagatgggcctggggtgtataagaaaacaagatgatcaagtcatgggcagcaagccggtaagcatggcctttacttcagtttctgcctctaggtatcttacctgttgcgttcccctaatctggcttcttagatgatagacatgtagaagtcttaagatgaaattagttctttcctctccaggttggtcttggttatggtggttttatttgtcatagcattataaactgtaactaggacacctgagttgcatctttgtgaactaagtggcaagttgtttttctgccattcacatctgtgctgtgtgtgttggatttgttttttgttttttgttttcagctatttcctgatagaggttttttttttttttgagaacagggtttctctgtgtagccctggctgtccgtggtgctcactttgtagaccaggctggcctcgaactcagagatccgcctgcctctgtctccctagtgctgggattaaaggtgtgcaccaccacgcctggcttcccctgataacagtttttaaaacagtattcgtgggggatctgaaatgagatctctaaacacacaactactgaaatgggcaatgccaatgtgtctgtcagtacttgtcttacctccttttcataagtcttaatgcttcatgtgtagaacatgaactagatttaaacaacaccacctgaccactagccaaaccgaactaaaagaataaaaatacccaaaccaggggctggagtgatggctcagaggttaagagtactggccgctcttccagaggtcctgagttcaatccccagcaaccacatggttgctcacaaccatctgtaatgggatctgatgccctcttccatgcagttttacatgcagatagagcactcatacataaataaattttaataaaatatccaaacccacatgtcattttagatgaatctgcaaaactaaagaaatatcatttaagggctggagagatgactcagcaattaaaaacactgactgctcttccagaggtcctgagtatagttcccagcaaccacatggtggctcacaaccatctgtaatggaatcttgatgccctcttctggtgtttctgaagacagctacaatgtacttataaataaaataaataaacttttttttttaaacaggaaattatataagtgcctttttagaatgtttctagtaagtgacgtcaggaaaacatagttaaatttttattgctgtaaagtttgatttcaaactcagaagtgtcttactgagagaccttctagtagattacacatgatgactttacctaggtattgtttcagctttgcagggtgagctagaatgattatgcacaccgactccccagcctaatacacctgataggtgtcgtgattgactatcatgattggtttgtctggagttagaattccctgggagttagatcctgagcttgtgtgtctgaaggcaggtacagtgtgctcatatatataaaataaatcattctttaaatagaaaagaaaaaaaaaaggaataggatgagctgataaaatttaatccacagtaatgtgctattataaaatttatcataatccgtagctctacaaaaagatgaagacaggctggagagatagctcagcggttaagagcactgacagctcttccaaaggtcccaagttcaaattccaggaaccacatggtggctcacaaccacccataatgagatctgatgccctcttctggggtgtgtacttacatataattaaataaacctaaaacaaaaaagatgaagacaaaaatttctctaatatttgtgtataagccaagtggtagtactggagatgtacacctttaatcccagcacctgggaggcaaatgcagatggatctctatgagtttgaggtcagcctggtctacagagtgagttccaggacagccagggctacacagagaaaccctgacccgaaaaaacaaagggaggtgtccagggggttgagtcctccaagttgtcttttgacctccatacatggtttgtgctctacatatcaacacatacaacagtaaaatttaagaatacaatatatacggatatgtggctgagaagtaaagtaattattagagttcactcaactccaattatagccaatatgatttttccagtggaaatgctactaaaagtttcatggctagtacttgaaaggattattgcttttagttggatacttttaaaagattcttgataagcagttttatatgccgtagcagatatagctaaagaaatatacacatttatacattttaaagtttggcagtaaatatatgctcaaatcacatatgtggtttttggttttgttgttgttacccagattaaaactactaaggaattgccatttatgatctctggttcttccccacctattccaagctctcagtggtcttaatacatagttggtattcctgttgtagcaaatgatatcaataataagttaattttgcatcttagacaaaagaatttgacatttagtattcctgccaacctagaaaaaaaaacccagtttactaatatgaatgtttaattaaaatacactatttttatttctttttgagaatgtttgtagtttgagtttagacagctgttnnnnnnnnnnnnnnnnnnnncttttcttcttttgttcaaactctggctgtgaatcctaaattctcattctctcagatgtagcctgcagtctgagaatgtctgtctgaaaaaccagagacagccttatgcccaaacttctgttaccagtgccttttgatatgcaatatgaattattttgtttaaattcttgataatggcaactgcagtagctaacttcacgttttaaatagtgttcaaaagctgcaaattcatggaatatttaattttgggaggactcagtttggcactacaagaaaacattttatttgtcctttacctgcccgtagttctagcctgtgaatgctgaagcaggccgattgcaagcacagtgttgtagtctacatagtaagttctaggataacttatggcaagtaaatctgtaagaatattattttcaaatatcacaatcatagaagtctagttttttattttgctttttgtttgttttttggggggttgttttgtttgttttgtttttgttttttgtttgtttgtttgttttctggtttggtttggtttttggttttggctttgggtttttttcaagacaggattgagacatgacagcgccaggataaaagacatgtgctaccactgcctgtcaatttaaacacattgagaaagtgagttctgaccaaaaagaatatgtaccgtctaacaatcttgttcactgcctaggtaggtgcactactgtgagctatatcctcagcctcagagatcaaaaattagtgttgcatacaatacctatagagaatgagaacatgatggatgtaactcaagtgttggggagtagagacaagtaacctctatagctcattggctaacctgtttagctgaaaggataggctcaagtttagtgcaggaccctgtctctaaaagtaagatggaaaacaataaaaaaagataactggtgcgccccgtcccccctccccagtcagggtgcataccagtgcatgcatgagagtgcacacagcacatggacttgtgcacaaattctattgagctttttttgcaggggggatggggagcagagaggccaatgtaaccataggccattgatctagcaattttaagtttaaaaaggtactccaaaggtaacacttttggaggaaattaaatatcttactaagttgcagttaggcatgagttactgtgctttttttttttttttttaaatcattaaaatgtcaatgagccgacagaactgttaaataagatattatgaagaaaggggggggaggtggaattggtgttcagttggtagactatttgcctagaatgcacaagacgctgggtccgttgccagtaccacatgagttgatgtggtggtgcatgcctgtaattccagcacctgggaggtggaggtagagggaccagagggtcaggagcatccttagctgcataatgagttcaaggccattttggggtatatgaaattctgtctcaaaatgaaatgaaatataataaaataagaatctgcctaaatatggtggtgcatgtctttaatcccagctgtctctcatttccagcccagccaaggctacatatggagactctgtttcagtaccccttacctctcaccaagacaaatacaaagtgtcatagaaaggagatatgtaaacatggtgtgtggtgactgtttagaaggcatttgtgacaacagattcataggaacttacttttgtttcctctcaggaaatagcttagtatttgataatcctgtgtttgagatgactttacagaatatagaacataactattgtggatagtagtgagaattgattatgcaagtgtttcttgcataaatattaaaattttccctcttggttagaactaaaatataatattgtttgcatgtttgtaaggaacttagtcacaaatgttgtgaaaatcaagtttctatgttttgaggtacctctaatcaactgattttccagtgagactcaaaaatgagagcaagactgtattcaagataatgaagctagttatactttataatggtaccagccttgtaaatgcttctgacaatgttacaatcttttcacaggtcggtgatgttaggtgtgtctgtgagaccctgtgttgtctcagtgcttctttctgtacactgtaatgttccagtcacaggagtcacagttcatgaggcaagaacaacacagctggtatcatggtactcaggaggcagaggcaggtagatctctgagtttgaggccagcctggtctacagagcaagttccatgataaccagggctacacagagaaaccctatcttggaaaagcaacaacaaccaccaaaaagcgaaaacggaaatacatgacattctcatcatctgtagtcactttcttgtgccatagcatagtcgtcttaactttttataaactttcccacaatctgccacctccccagattcctataaccaccatttttcttctcagcttctgtgagatcaatttatcaaggtttcatattagattgggattatgcagcagtccctcttttagcacttcttctcctgtgcctgacttgcttaacttgccatgatcatagtgatttctacttcacttcatgatacagcaaatggctaatcttcagccattcctttttggggggattgtctagtattctgctatggtttccacattacatttctttctccattcaccaactgacatcattagagacacagaggttcatttcttttcttggctattgtgattgtgctgaaatgagcttgggaactcagatgctttcttgacctgctgatttcattttctttgggtaaaacatcagtaatgagatttctggactatgtgataaattccctttctaatttttgagtaaatcttatactgcttttttttagagttatactgatttgcatttgggtcaatcatgtgttaccattctccttccctccccatagcctcacttagtattgcttattcctattttaatatttgcttgtttggtttgatgttttgagatagattcttgctttgtaacccagactgcacttgaatttgagtcctacctctgaatgttaagtgcttgaattcaaatacacactaacctgcttctgctggaagagctccccagttctcctcctcctgtctcttcccagtcaggagactggttggtttcttcctttcctttttctttttttaaaaacacacttctcacttctttttcgttttctctcttttcttcttttccttttccttcctctctctctctctctctctctctctctctctctctctctctctctctctttctttctttctttctttctttctttctttctttctttctttcgacagtatcaagtagtctaggccagtctcaaaaatttttgtggctagatatggcgctaaaggctggcttaccttggtgagttataggctggtctacatagagttcatggacagcaagaacaac

SEQ ID NO: 1622 - DNA, 348 bp, Mus musculus
atggcggtggagacgcggcccgagctggtggggaagcggttcctgtgcgtggcggccggcgaggacgcgcgtccggagcgcgggcagagcggctgcgggcgcggctggcgggcgggggtcatccgagccgtgtcccaccgcgaccgcggccacccggacctggcggtctacgtggaatttgatgaccttgagtgggataaacgggagtgggttagagtttatgaagatttttcaactttcttggtggaatatcacttaatctgggccaaaaggaaggaccctagccagactcagggatcaaagagcagacaaattcagtggcctgcactgatatgcaattctggttag

SEQ ID NO: 1623 - protein, 115 aa, Mus musculus
MAVETRPELVGKRFLCVAAGEDARPERGQSGCGRGWRAGVIRAVSHRDRGHPDLAVYVEFDDLEWDKREWVRVYEDFSTFLVEYHLIWAKRKDPSQTQGSKSRQIQWPALICNSG

SEQ ID NO: 1624 - DNA, 106378 bp, Homo sapiens
  misc_feature (1)...(106378): n = A,T,C or G
ggtctcactgtgttgcccaggctggtcttgaactcttggcctcagctgatcctcttgtctcccaaaatgtggggattacaggtatgagctactctgtccagcctataatttttgattgaatgccagtcatcattttatggtaaatcgtatttatgctgagaatttgtcatgactcttgttctgctaaggtgttagcgtggagggttgaattagtcttgcttggagttgatgagaatttgccttttattgctctgattaccttcagtgcattatcaactttatatatataattatttatatatatataataaataaatatatgtatatatttgtttatttttagacaaaatctcattctgtcgcccaggctggagtgcggtggtgcaatctcggctcactgcaacctcttcctcccaggctcaaggaattctcctgcctcagcctctcgagtagctgggattacaggcacctgccaccatgactggctaattttttgtatttttagtagatacagggtttcaccatgttggccaggctggtctcaaattcctgaccttaaatgatccacccacttcagcctcccaaagtgctgggattacaggtgtgagccactgctaccagcccattatcaactttaaatctattatcacctagtacttaagatggggattgatttgctgcaaagttttgaccaatgtttttacttcatgtttacctgttagccttatctgcgcacctgaacttcagagagggtctctctctgttcttttgctacttctctagtagtcgaatgctcttacttaggtgttacttggagctagtttgtgttgttgtggtgggcatggggccttggatgctgtttagctttgtggtggtaggaattgagctttctcttttgttctagaccagtattagtcttaggcaggctctgttttcctctattcttgataatcctccttctccccagtagtaggagacctctattgttttggtcttaggttactttcttgtctgtccttcagaagtacatacagtatcatctaattttgcaggaatttattaggaagtgttttcacatcctgtattaaaaggaatatatttggaagccatttttgacaagtacccgaactttttaaggtagcgctaactattttcatggaattagatcttccttactaagtaaaacatagttttcagtggtgataatgtagaccaaattgaaggctatttctattccctctaggaagtatgtattcagatggattatttttttaaaagcataaaacaaaattgtaaaatggggagtatccttagctgtccagggttcataaatgcagtcctaatcgaactgagcatttgagagagacataatgactctacatatgttgcaagtaataatgatgtaattatttattataactgtaaaggaaaggataattatgtttagaatcatgaacatctgcaaattttcatgatttatctttacattttatactcgcttaaccatcactatatgatgaagatatagggcatttccagcaccttcatgccacttcacagtcaatactacccacccccatgggtaagcactattccaacttctatcagcattcattagatttgctgtaatttgttcatttaacaatttgtcacattttccgtattacattattactcattcttttttttttttaataatttgagagtaggctgactggactacataatttggaacttttgaccccattaccttcagtcttctctttgattttattttgctctgtttaacaaattgttttgggctgagcacggtggctcatgcctgcagtcccagcactttgggaggctaaggtgagaggattgcgtaacgccagaatttgagacaagcctagcaaaatagtgagaccgtcgtctctacaaaaaaataaaaaatgagctggacgtggtggtacatgccggtggtcccagctacttgggaggctgaggcaggaggattgcttgagcccgggaggtgggtcaaggctgcagtgagccatgattgtaccactgcactccagcatgggtgacaagagtgagaccctgtctcaaaaaaaaacaaaaaaaaaaggtgtttttatttctatttcatccccatcctttgataaattttcttcaggattcaagtatgtatctctctcatcctaaaacacttttcttcacggctgcccgctttataagcactcttacactcccactcattttagcgattgaggagagactcagcaatcagttgaccaaagcatctaacatactttttccatatttctatatccttagtctgttcactgagggtgatttccaaggagtcgaattactgagtcaaatggtatgatttgtttaaggctgttatcagtaaagatggtcagattgcttcccagaagttatttatttatttatttatttattattattattttttttagtgtaccaagtgtgtatttatttctttttttcttttcttttttttgagacagagtttcactcttgtcacctaggctggagtgcaatagcgcaatctcggctcactgcaacgttcgcctcccgggatctagggattctcctgtctcagcctcctgagtagctgggattacaggtgcccatcaccatgcccaactaatttttgtatttttagtagagacgaggtttcaccatgttggccaggctggtctcaaactcctgacctcaggtgatccgcccgccttggcctcccaaagtgctggaattacaggtgtgagccactgtgcctggccccaagtatgtatttcagtttactttatgcaatttaacaaaaatttagtcataatttaccagatatacataaatgatttaagtagcgaaagaaaattcagctttacaacaataagttcatatcttgaggaaaagtaaaagtacattaagaatgtaaaggcaagtccagtttcgatgcaataagtgacctgtaattcctagaagttctttttacctggccaggcacagtggctcatgcctgaaatcccagcactttgggaggccaaggtgggaggatcacttgaggtcaggagttcgagactagcctggccaacatagtgaaaccccgtctctactcaaaaatgcaaaaattagccaggtgtggtgctgtgtgcctgtaatcccagctactcaggaggctgaggcaggagaactgcttgaacttccgaggcagaggttgcagtgagccaagattgtgccactgcactccagcctggatgacagagtgagaccgtgtctcaaaaaaaaaagtttttttaaccaaatgtgtattacttctacaacagagcatttgttttaccatatccttgtcctacttaatgtttttttcatctttattagttttatagaaagtattatatctctattctgtaggtcttttgtaattaagggatacattaacagatttaaaatttgaattaggctgggggcagtggcttacgcccgtaatcccagcactttgggaggccgaggagggcagatcatgaggtcaagagatcgagaccatcctggccaacatgatgagaccctgtctctactaaaaatacaaaaattagctgggcgtggtggcgctcgcctgtagtcccacctactcgggaggctgaggcaggagaattgcttgaacctgagagaaggcggttgcggtgatcctatgatcgcgccactgcactccagcctggcaacagagcaagactccatctcaaaaataaataaataaataaaaactgaattataaaattcctaaaagaaaataccaaagaatacctacatagagtatttttaaagcatgccttaaggctgcaacataaatatattagcatatttggctatatatgaaattttaaaacttgtgaatataaaaagaaattgcagggcggggcgcagtggctcatgcctgcaatcccagcactttgggaggcagaggcaggtggatcacttgaggtcaggagttagagaccagcctggccaacacagtgaaaccccgtctctactaaaaatacaaaaattagccaggcgtggtggcacatgcctttaattccagctacttgggagactgaggcacgagaattgcttgaactcaggaggtggaggttgcagtagctgagattacgccgttgcactccaacctgggcaacagggagactctgactcaaaaaaataaataattaaataaaaaagaaattgcaagtgggggaaagaagcatccatgcaaatttagatataaaagcaaatgaagcaattgcttttaagataatttttgtagctagaatagttgaaattattaagaaattattatatataatatataatagttgagataggatttttatctattatagatgaagaaggtatataaggttaaaaagtgtcaattcaaaagtttatttgtaatgtagaacattgcaaaaattcttccatttcaagttagttttgatagactgtttgtttgtttgtttgtttgttttgagactgagtctcactctgtcgcccaggcttcagtgcagtggtgcaatctcagcccactgaagtctcttgcttcccgcgttcaagtgattcccctcccttagcctcccgagtagttggcactacagccatgtgccaccatgcccagctaatttttgtatttttagtagagaaggcattttactgtattggtcaggctgatctcaaattcccgacctcaggtgatccgccccactcagcctcccagtgtgctgggattacaggtgagagctaccatgcctgacctatttgttttaatataatggttttatgaccaaacttggaaagcagaggaaagaagcagttttacaatgatgtttaaaaactgttatttagtactttggtttgtattatattagtatgtattaatattagtaattagtatgtagtaatattagtattaatcatatgtatatcttctttgagacctttgagaaatagcatatgctgaagtctttctaacaatatttgttttgctaagcaagattacttttgtcagtcctttaacattttgggggtttgaacctaccacgtgacaggaaagcatactttgctccttgctgaattacgtgtgttcttgattataaatttccttcattatataatacctagcttcattggtgaggaagaacatagatggagtatatggttagcatgcagagattttgagttggtattactttttagtttagattttacattggctttccttcatttatagttttaatacaagtttagaacctcctttacttaatgaactttcatggatataaacagaagacttttaccctgctgctattaacttgtaacaatagtgaaagcttgtaagattaataagaacacgacccttttggaacctaacctgtttgcaaagtgcagacttgcatattttaatggtagttaatagttggagcgtttatgatagggatgatgaacagagaaaaagtgcagtgggacacgctggcaagactcttactgtgtgctcaatggcaactttccatttctttatttcttgtagttcctcactcagcagattaggaattttctgatgctttgtgtattctttctaaatttttaattttttatcattaaaaatcaaccttgtttttaatagagaagagaatgttgaaaagaagtggtacattcctgtgcagccagaatttaaactggaaactggataacagatggatagaaagtacaattagaaggcccaatagagattgcttcacttcctccttcatttcttttctatcttcctttttttcttctctttccctccttccatggcatcaagaagatagtcagaaagttatgtttgtatattggctccatcaaggatgttatttgagactgttctttttagaagactaagaatagactagtgttttggatatacactcataggatcatttttgggtttgtattaaattggtagtttggtaatgaaatgaatgttttttcttgagaattgtaactcttccttctgtatctgttctttagaaattttcccaggaaaaaccttgcttttctactgaagcatgttttcgaaggcttaacattgtacctccatgatgaaaagagataatgtacataagacattattttgaaggtgatgaataaccctgtaggaagaacaggaactctcatttatgtccgagattctaagttcctcttagttgagttagatttagaaaaaggtacattttgctatattcattcattcattcattcatgctataacatgttttatcatctcttagcaaggcctggtagctgctgggagtatagttatgaacaagacaaagatgccttatggagcttatatatcctataaagggaaaaaatataaatgatcaattacacaataaatggtgtaaatacagttgtggtagtactaagacaaataaggcatgttttgaaaatctgttattggggaatcctacatagtctgagaatcagggatggtttccttgaggaagtgatattttgatatttgagttaatttatcattatcataaatgtgattgaggaattcattttaaataagtgcttagggtatacaaaccccaaatacaaattatttaaggtttaataaaaaaatggtaacataaatttatattccatttattcttggtcttccacttgcataattcagttgaaactcttggtttccctcatttaaatagtggcttgcacgattcttagccctatctatatatataatctaagacttcataaacgcagtccattatttacatttgacaattaataaaagccttcaagttataataggtttgaaaaatatttgttaaaatgcattaaatttggatgaaattctattgatagttccttaattaaataaaccaaagcatttctattgtctatctttccagatagactgtgagcttctcaaggataaaggtcctatctccagaaccttgcaggatgtgacccacatagtaagtgctaaataaatactgaacacagcaattatgagtaaactgtaaataaggatgaaacaacttgataactgaccttcacgtttcttttaagtgactttttagtataatagttaatagcagggagcctttgttatcacaagatctggttttgaaaaccagtttcttaatgtgtattcttaggcaagttactaaacttctctaaacctcattttctttatcctcaaaatgagattacgtgtgtaaagtacttagtatactgtctgacacatagtaagtgttctataagtggtggctaaaaagatgtgttaaactttttgtctgtgttagataatatctgtgatatttaaagtagacatgtatagtgacataaaatattagtatgtatgagagcagatgattgacactttccacagttacataccaagtcaaaaagtgaaaaatctataactactaggcttttgcttattcagactaaactaagtagataattatggttcttattgcagtgaatacattttcttcctttataagtcagttttttaaaaaaacaaaatagtttgtgggttttttttgtattttaaaaatgttttttagagacagggtcttgtgatgttgcccagcctgaacagaagtcctgggctcaagagatcctccagttgcagcctccagagaagctgggacaacagacacatgccatcatccagcccaagctgtttttatgaataaatttttgtgaacttctaaaaagggaaaaaatcaaataatctcccagtctttggtgtagattaagatatttgatgtaggaggtttgcttgaattgatgtgtgcataggcatatttaatggacatatttacacgtggggatggaaagactagaaaatctaatttatatgtctaattttcagcttctataagtaaacttagttattttaagtaattcactgtcattctttttacctgtataatgaaaacaaataccattactcttctgtttccgagtatctttatggaagtaaagaatgtaaggaaacaagttaagaaacaaatattctgaagtttcaaaaccaacttgaaaaattttttaaattccttgttatttacaaagttatgatttgctggcaaaaataaaataataaaaataccccttaatacaaaacgaagcaaaaaatgccagcaaacaaacaaaaaatctttaaggactttttattctacatttaaaaaaatgtacttttaaatttttccaacagcaaaatatccacaaattagtgtaaactctaggcattggctgtagtcaagggattagtagaagagaatttggaccagagttctaagaatattaagatacttgattaaaaatattttggggatatatgccctcctgaaaaactttgtttctatacatgaaatattttgattgatttgttggattacatgcttttcagaggactgaaaaggatggaattcaacatgtagtgggagttcccaggggcccatttagagcagtttgcctacaaaattgaaaacagctggcagttttatataaggcaactagcaacctatactcttaagaatgtaatttggtgagtgggatttatgtaataactgatgaatttgcatgtttttctcaaatgactttatttgtatttttcgtttgctcctaggatatcactgaaaattaggattcaggcatttttgcatttttacaattgcatcatgcccatggtcacaaagcagatcattgatgacttggtatctggatgttgatctccctactcttttatccttacatatgttgaattattgtcaccaagtcactttactggttccttaatctacactgattttagaaatcttcatctgtaattcttaagataatttgctaagtattatacagtgtacactgaaaaagtggacttggaaataaaattgcccaagcaaaattttttctctcaacttgccgatatgcatttttgggtatgttttgctgttttaatttattacaggttttttgtttgtttgtttgttttcggggggactgagttttgctcttgttgaccaggttggagtgcagtggcacgatcccggctcactgcaacctccagctcccaggttcaagtgattctcctgctgcctcctgagtagctgggattacaggcatgctccaccatgcccagctaattttttgtatttttagtagagactaaaaatacatttagtttcatcatgttggccaggctggtctcgaactcccgacctcaggtgatctgcctcctaaagtgcagggattacaggcgtgaggcaccgtgcccagcctatttattacagttctatgtttggtctttggcaaaatttgaccatgattattaaaatccatcttccttataattttggtttctaacctattagcagtggttgtgtttctccacttcaaattgcccagcttgagtgttctagagaaaacagataaaagccttatagttattttaaacattcagattactactgtaaactctgttaactttttttttttaaatagaggttcaggaaaatctcaagaaactgaaatttagaatattggactacctataaaaaagcagtataaagggtgcctgaaatcgaactgctcactgacatttgtagggaggtttgatttataacaaataagttgatcaaagaagagtgattgttccaagttagagatctttgtgtgggttagggagtccgattgtaattggatgggaaataaatattttttttcttgaattgtgattggctaaaatccttttctttccatggtattttctaataactgaatctggggattttctctgcttttattatctgaccagtgtgtttgagctgtgtaccagtactaaaagtactaagactgtcgcagacacggtttgtgaaatttcaggacgttgacaagggcccgccacggagcatttgctgttcttataataaagcagtgacgaatttaaatctgtgaatagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgctgccccgcccgcgccggcggaaggagacgcgctgcgcgccgccgctgcccggggagggagacggagcagtactggccgcggcgcggtggcggcggctgggctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtaagagagcgagcgccccccttttcccctgccgcgcccgcacccggctctcgcagacgtaccttgcaggcttccctctggcgcctcgctcagcccggccaactggcggtcacgcccctctgccgaacccttggcgcgtttgcccgcatcccttgcctgggtccctgcgtctctccgagcggcttcccctgtggaggtggtgtcggagcaggactcccgggatagccgcggaggctgccctggcccccatcccggaggggtcgaccgcggctccccgctgtggcgcctgggcggccacggagacctccccgaaaggcggagccgcgagtccggcgccgcgcgggcaggtgggggtagggggcggaccactcatggcgacaggcggccagcttccctggtatctcttttcttggaaaagtcttcatagtgctgtagctcgagacttaaaacttatcctgtaaggttgctgaaggggagggagaaaagaaaagagaccttcccacacagtccggggattcctatgtgttttagaggcagaggccgtggtggtggctgtgcccggattcatcctctccttaatagatgcttggctttctaaccgtaaaggataaaagtgaaaaattttggtatggagggtaatctctctttctgtccccaatgtgcttttcttgttagaaaggtatagttctttggagtcaagctgtttctgggttttatacgattttaaataagacgaaaaatgttgtcaattaaaatgttaaatgccatgcagaattgattatctttttttttttttggtttcttacatgtgacgctgccagtgctttctttgagtagcgtaggtatgtgcatgatattgagctgtaatatgctctgttgtgttccaagtacattctcactgagggacagcttgaaggtaaggggcggagtagagacaagacatggactagacttccaaaggttgatttatgaatacgtaatctgtgaaatttatttgtaatgccctgagccatttactttttcaatgaaaacttcaaatttaggaaatttttttccctttgtgtgcatgaaagcttacaattccaaattcattgtaatatttgtacaggtatctacctaatattttttacctacctattttaatagtttctgagtgtgtttttgtaaactcgggttttcctcactgtagtcaatgatatggttaatgcggcatgtattaatattgactcgatatcgcaaaataggtgtgttttgctgataggtatttctaacagaaaatagaggtagttttgaaggttttggctggttattttcgtatagaaatgtataatcttccttaaaaagtattggtgatgttagtggttctaaaaattatggcagttcaattcagtaactatttttgtttgtgtaaaaggctgaggtaagaggattgctagagcccaggacttattaagagtccagcctgggcaacataggtgagaccccctcatctgtaaaaaaggaaaaaaaaaatttgtatatataaataacttaattgctctcttagttgggaatttaagtgattaaagagttaagtttgcatatgttagtaaggtattaagctggatattaaaaaataaattatctatggatggtagagattgactggaaagaataggagtttcttcaggtgatagaaatgtttcctatcctgattgttggttacacagatatatatatttgtcaaaactcgttgaattgatactatctttgcgtttcaccatatctaaattttaccaaaaaaagaaaaatgtatgttgaaccatacctatgtgaacccttgatgagtttttttaatctgtctttatttgaaaatttgaatattaatttagtttttttagcctagaatctaccattttagatttattcccagattttcttacattcacatttcttaaacgaaacttggaacagtttagcattaacataatgtaatattcctgttcgactttgattactgcagagtagattttaagttacatgaaattaggctaggcacagtggctcacgcctgtaaacccaacactttgggagactgagatgggaagatacttgagcgcaggagttttgagactagcctgggcaacatggcgaaaccctgtccctacaaaaaatacagaaattagccgggcatagtagtacaatgcctgtggttccatctactggggcggctgaggtgggaggatcacctgagctcagtgaggttgagactgcagtgagccaagattatgccactgcactctagcctgggcgacagagtgagatcctgtctctaaataaataaataaatatgtaaaaagaaagtatatggaaaatgttgaataggctagtttgtgattttttttttaaagctacaaatatgtataattaaaaacctgttaagtctactagaagtcctggctggatacaccaggcaggacatgtgccacaaacctgtggcacatgatttggaaggataatgataagaacttcaaagtagttgagggaatattgtgtctcaaagataatcagttattcttattttgggtcttatgtatgaggaattgccacgtgaattaaatttctataattgtttaattaacgtaatcttggtggtttaaatgttatacgcttattattttgtagttctggagatcacaaataagacctggatcttgctgggctaaaatcaaagtgtggcaagactgtttattctaggagagatccattttctttccttttctagtttttagaagctgtccacattccttggctcatggcccccttcctccatcttaaaagccaaccaagttgtatctctctgaccgtttttccctagtcatctccttctaactctcctgcttccccattacacttctaagtgccctgttgattactttgggccaattgacataatccaggataatcttgccatctattaacaaccataattccttgtaaactttaattctcctttgccatgtaatgtaacagttacaggttcctgggattaggacatggatatctttgggattaaattattttttaccacaccgtggtagcaaacatatttcttgtacaatatgaacatatataatttaatacaaataaagtaagattaaaattttattttttcagccaggggttatagtgatattactttctaatcttttaagtaataagtttaattaatagagttttcattaggttatgttggataatttcaaatagtttgtcaacttttaaaaatatggcgtgagaaccttttgggttatctgtattggaattatctttgctaacaaaatatctaagccttttttatgcaggaggaccaagttgttgaagaagttgaaatatatacagcacattgtgaacctttttcattttgagtttcttttttagccccattactgagttttgtcttgggatacatttttgacattactgctgttctactttttgaggaatttttctagaaaattgatagtttaaggaaaactggcagttgagaagtactgttgcataatatttgtctccttgaataatattgtaatattaattaaatagcagacatcaatttactctcctcttgtttaacttcgcttccatttatgatctcagtgatttatttatttgcttatctatccatccattcatccatacacccatctatctacctttctttgatgcttaggttgattgtatttctgttttcaagccagttctgtctaaagtgtaagtatttaataaaatatgtctggttttttcaatagagaaaaggacaataaaaaatcatactgtgtattaaaggccaaacccataaatttgcttgtatttaggggatatcctgggaatgaagagtttaaactgttgaaatgtgtatcagctgatgttattttgcaaaacttctgtcttaaatatgaataatattcatgtttaggaaatttaaagtgatttatgatttcgcatataaataaaacccctttttgtttttgggtctacacatttctgcttagttttctcatttaagtttcttatttagttggtagcattacatttccttgtatgtttctttatgtcagtctgacatttatattgtcttgcatcattattaaaaatgctgatttctggtctgtttacaaaatgttgaatgtatgaatgaatgaatgatttttacttcattggtcaatacgatcttgataggtttactatagcaaaattggtttttttggtaggtagaaagacttctatgtctgatgtaagtatgccaactatttttcacactcgaatttgttattgctattgctgataaagacttgaatataggaaaatgacgaaattgccccaatggtgggacataaactcgtgcagttactaccactagctagttttaaaagaaggtgatgatcgcccagtaaatgttgttaattgtgtttctgtgtaaaattaaaggggctgttgttttatatgatcttttgacccatcatctatatgttctggcacatattttaaatagggtattccaataatttccaataattttaaatagggaattcagtaagttccagtaattttaaatagggaatgttttcattcattagaataattgaactatagaaattttaccatgtgaaaccttatcgtcttcgtatagggatattattgcatgtgaaagtaaaaatgttaactagatatttcaatgtaattgaaagcatacaggctattttcctgtatttatagattttatatattatttttagacaatttcaaattatatacaagaaatgtctttaagtctaaaattcattttctgtcatcttcacatatttagtaccgtacctagcatttacttaggtgtccataaatgcttatggaataataaaggaatgtcataagttacttgaatattttaattcatactaaccatctcaagtttctattactatttactcttttttgagacagggtcttgctctgttacccaggctggagtgcagtggtgtgatcattgctcactgccgcctggaactcctcaactcaggcaatcctcccacctcacctcctgaatagctgggactacaggcatgtgccactatacccaactaatttttaaatttttttttgtagagatgaggtctcactttgttgcccaggctggtcttggactcctggcctcaagtgagcctcccaccttggcctcccaaaatgctgggattacaggtgtgtgccacctacacctgaccttactatttactcttaattgtaaattttttgtttctcttatggcactgtgtaccttcccctccccagtatccattctatcttttatccaattgtgtggtttgactacaggatgggccatgatttttctaagctaacttacagaatagaactccattgattggtacaggccataaatggatccagtcggagggattccaaggatagcattgtgtgggtatgagtctggaactgctgcagccatttttctactttaaggtaaaccaatttgaaggcaaagctgacatagagaggttaatagtattgacacggtagcaggaaaaaatgtgactgaccaaactttttctgaatcctacatactactgtggatttttctcttatggagttttcattttgggagagtaaatttacttaaggtttaagtctgttttggttcctttttctttgccttggaagcaaaagtatgttaactgatatacatggtaatatttcattccactctttttgaataatgaaagcagcattttcttgaaacttttaaatttgttatttggtgttcagacgttagagtcttgtcatactgatttttgtataactctgatgattttcaaaaagggtgatatgttctgcttttatgtgtccaggtgtatcccaaagctttgtaaaaattaatttgttttaatgtgtatgaagtataaatatctaactttctaaatttttacaaataagaaatagcattgagtttttatattaggaagtgtgccataactcctcacagttaaatagaaatttcaggagagatacatcgttaatatttcagaaattagcaagagagggcaagcttggctttttaggtcacatatatcataaaccctagtttatactctgtcagtgttggtcagataaataactgtaggtccactattctttatctgcaattctgaaattcaaatagctgtagcaactacattttttaatgattcatttggaagcaaaacctgattgactaaactcattttttaagtagagcttaataggaattgagtatttcttataggagaaatattaatgtgctccacttttagggttctgttctaaatccttcagagatgttacatgttgcctaggaactgtgctatattaccatagttaactaccataacgtaaggacttgtactatattaccataatcaactaccgtaatgtatgctataggccaagcgcggtggctcacatctgtaatctcagcactttgggaggccaaggcagggagatcacttgagctcaggagttcaagaccagcctgggcaacatggtgaaatcctgtctactgaaaatacaaaaagtagccaggcgtggtggtgtgtgcctgtggtcccagctcctttgggtactgaggtgggaggatggcttgagcctgagaggtcaaggctgcattgagccatgatcatgccactgcactctagcctgggtgacaaagtgagactgttcctcaaaaaaaaaataaataaataaaataaaaaaaaagctatatttaactttataaaaatccaataaacttttaataccaaaataggttgaaagagtttggatgagggattgttatttgaatactaatacgatttttggtggtgtagatttaatggcaacaaatactgctaattttatttgttaggagatttgatagtgatcatatgtctgcctaatttcagatagtttttccagtgtggattttagcagacttttttttttttttaaagacagggtctcgctctgttgcccaggcggagtacagtggcataattacaggtcatggcagtcactttctgggttcaagagatcctcccacctcagccctacaagtagctggtactacaggaatgagccaccatgcctggctaatttttttttactctttgtagagatggagtctgactgtgttgcccaggctggtctcaaacatctgggctcaagcaatcctcctgccttcagactcccaaagtgttgggattagaggtgtgagccatggcatccagcttcacacttttattagatataaaattcttaatctgacaaagaaagatttagggattacgtacttttagttttacaactggtctttactaaattgttaatgttgaaacattgtctgaaattatcgaattggataaaatccctttgtgtagaatttatattttatattctagctagtttacgaaattattatcttaaacccattgatgaaaatgttgatttatcttatattgtagaactattgatttaattatagaatacatggctaagtagaaaaacagcagctcacaatctgtttactgttttgtctggcaaaacaaaactatgcatactgctgacttacgaaaaactgaaaagagtttttgaaatcacacaatcagtaagtgtcagggcaggaatttgaatgcagatttctgatttcaaatctgttatctctgtactctgccatattgcttctgccaatggtttgtgattcacagactctcaaagtaaaaacccgaaattccctttaactgtaatgttatatattctttctgagccctttctctttcttcatttctatagccctatggtttaagtcctcttggacttttatttctccttccttcctgtctgcagttcctttcatcttcttaatttggtatttcaaattcagtcctttgcttactgtttgttgttgttgttttaatcttgttatttcctttgtagaatttacttgtactatgttgcataattactcacaaatctgcaattaaagtttggccttttttcagtttgatccaccgtctctactgtttggaagctttacatgaatgtcccgtgtgtgggtttgaaatagtgtttaaagtataatttattatcttcatgtgaaaccagctgccattttgagatttaatttgaagtttcacctgggcttgaaaacaccttcatcttaaatgtttttccaccttgaacgttggcattaacttagttctgcagatttcttcctttaaattggaacctgctttcccgtctccattcttttcaatttgtactaccacttgctcaaaaccttccttacttgatttatttgggttatatctattgatacttactgtattaaaaactaagctgaaatttttaaaacacaagagcagtttttcataagtcagcactatgcagacatagttttgttttaccagacaaaacacaagtagtctgctgctctgaacactgatgaaagaatgaatggaaaaggcaaataatgtcttagtagtattttgagaagtttttatcttactaatcccttgaatagattttgttgccctggaaacatttggtgaaggtatctgttcatctaattctctttagtagaattatttacattagtatcactaaatagttaaattttaagttgaatttggcttcttcattatttcaggtttcttccagtattttctgtgtggctatattgcttatgaaaattatgtattttgaacgtagaaggttgcatgtaacatgccagaaaatgttaacatggcagtaggaatagtcagcattcctagaatagatttcagattttttcaaagctagaagaggtctgtgtgactaattcatttcttgtgaaagactgacacttaggagctgaaacatctgatccatctgttaaagttaggagttttaagattcaaaaatctttaggctcagaggaatatcaaagaaggaagcagtatgttaatgtttggttaaaattatgtgttatttaatataaaatgactgtatatttaacagaatttatttcctctctatattgtgattctatagatggaatcttgatgcaatacaggactaggagaaatatttgtataagaatttaaagttgatgaactattccaatgtgttgaataacattatactattatttggtctatgttctttttcttctttaaaatcacattgataaaactatgtagagcctattttagagcgtttccactgttcgctagaacattttattgccataattttcaaaatctctgatcatattttaataccaaagtgaatcattttgagggaaaccattttactttacattgttcatgtgaattaagagagtaagttgtgaatatgaatatagactatatgtatttcacctttccgtaacggttttgaactatacaaacatatacacatagttatataatagaaataattattaagaccctttgaactactaagtataacaaggaaaaaagcaaatatgcttacagttaatataatattgcattaaatttgcctcgattttctcagtcttaagagcaaaataagaattgtgattaattaaaatatcatttattttcagtgttttttcactaggttctactgcctttttgaattgctttctttggtgtcttggaaaactaagtgaccagagggtataggagacaagaaacctgagagtactgaattctcattcttacccctttcaattagaacaccactgattttatcagttttatttaataatgatttcataggccagaaaattagattacacagttcttttttcagagagaaggaaataagccatttttaaagagagaaacttttcttgaaaaaaaaatctgaatctggtagcttaatacaagggaaatagcaaatgaagagctgtttcttggtaaataagaatccagtgtgtcattatgaagtatcacttcatgaggatattcctgcaagagattaaaataatattgagatatgtaactgtataatgatcagtggaacctaaaggagaagaaactaataataaatatgactaaagttcatgattgtcaaccttttatttcttgtattccagtgtcccagtggatagggttaagctttaacgtgcagaattgtggaggaaacatgtttgaatggtttttttctagacctcatacccagatactgtgatcttagatatggagtataggacaaaaatctgtactaaaatttattaacttttttgactgggtaccacagaaacataaagaagtatattttgaataatctcactcccacacctgccccgatcagcctagtttaatctgcatctcttttaaataaccatttttgttaatttcttatgttttcttccagagttttttgttaaaaataaagatgtgaacggatgcacgtagtcttattcctcccaggcatatgtaatcaagctgagcataacctaaaggaaaataaccacattataggtgttgcgatacaatacaacaggaactacacaattcaacttatgaagtatttttgccaagaagaactgaacctgaatataatgaagcttctagattctgacagcagtttacaggacatatggaggtagaggaacatgtgaaactacaccatgaggatacagtcagccatattcattatgtggggaattacagagctgtgcttttcagtatggtagccactaatgtgtggcacttcaataaaatgaaaaatcaggctaggtgcagtagctcatgcctgtaatctcagcactttgggaggccaaggtgggtggatcacttgaggtcaggagttcaagaccagcctgggcaacatggtgaaaccctgtctctactaaaaatgcaaaaattaactgggtgtggtggtgcaggcctgtaatcccagctactaggggggctgaggcatgagacatgagaattgcttgaaaccaggaggtggaggttgccgtgagctgagatcgtaccactacactccagcttgggcaacagagtgagattccatttcaaaaaacaacaaaaaaattagctgggtgtggtggtgcaagcctgtaatcccggctactctggaggctgaggcatgagaatcttgaaccagggtggtggagcttgcagtgagctgagatcatgccactgcactccagcctgggtgacagagggagactcagtctgaaaaagaaaaaaaaaaaaaatcaatttctccttttagagctccgatcacattttgtacgcttggttgacacatatggttaatatccacagtctcagatagtacaaatatagaaaatttccatcattgcaaaaagtgtagatgtggctattcaattggatacagctattctgtagtaaccattaaaaagttaaaaattaaaacatgtaattttctgactagtagaaaaaaattgggatgatacaaacagaattggaggccgggtgcagtggctcaagcctgtaatcccagcactctgggaggctgaggcgagcggatcacctgaggtcaggagttcaagaccagcctggccaacatggtgaaacccagtctctactaaaaatacaaaaattagctgggtgtagttccagctactcaggaggctgaggcaggagaatcgcttgaacctaggaggcggaggttacagtgagccaaagtagcgctactgtccttcaacctgggcaacagagcgagactctatctcaaaacaaaacaaaaaacaaaaaaaaactattgctttttcacatgcaagttttttcctagtctcttgccgtttttaactacttatagtacattattctgtatggctttgcttgacagacgcaaaggatcagtaaaaatttttcctttggcatcaggcctttgtttcagcttaagaaattctttctaatttgaaattatattttaaaacattcactttttctccagtaatataaaatgtctgtgtcttttgctatattttaggaatatttgtggactatctgttatattccatatatctttctgtttcttgtaccgcaagatcagagtgttttaatgattgcagttttatagaatcttaataggtaagcaaatctgttcattactcttcattttcaataatggacattctttaaaaaatttttcttattgtaaaatatatgtaacaaaacttacaattttaactatttttgttttggtttgtttgagacagggtcttgctctgtcacccaggctggagtgcagtggcgccatctcggctcactgcaccctccgcctcctgggttcaagcgattctcatgcctcagcctcccgagtagctgtggttacaggcacctgccaccacacccggccagtttttgcacttttggtagagatggggttttgctctgtttgccaggctagtctcaaactcctgacctcaagtgatccgcctgcctcagcctcccaaagtgctgggattacaggtgtgagccacgcacagctcattttaaccatttttaagtgtacagtttagtaacattaagtatattaacaatattttgaaattatcagtactatccattgtcagaagtttatcatcccaaacagaaactctctatctaatgtctctgtgaatttgcctgtccttcataaaagtggaatcatacaatatttgtacttttgtgtctggcttattttaacttagcataatgtcaaggtttatctgtgttgtagcaagtatcataacttcacttcttttttatggctgagtaatattccattgcatatatataccacattttatttatctaccaaagggtagaaggattgcttctaccttttggctattgtgaataatgctgccatgaatatcagcatatctatttaagtccctgctttttacttccttggggtatgtacccagaattggaattgctggatcatatggtaattttatgttttgtgaggaaccactgcacagttttccacagtggctgcaccattatatgttctcaacagcaatgaagatggattccagtttctctacatcctagtcaacacttactatttcctgggtgttgtttgaaaatagccatcctagtgagtgtgaaatggcatttcattatgataattttcccaatgattagtgatttttgagcatcttttcatgtgcatgttcacaatttgtgtatctcctttggagaaatgttttaagttgttcacccagttttgattcagcatgttttgttttgttttgctttgttataggagttctttacatattctggttattagtaccttatcagctaaatgattagagatatattctctattctgtgggttgccttttcacattcttgataatgtcttttgatgcataggaaaattataaattttaatgtagttcaatgtatccatcttttattttgttgttggtgcttttggtgtcatttcccagaagttgctgccaaatctaatgttattgaagctttcctgtcttcatttgcttctaagtcttctatagtttcagctcttgatttagttcttctatccatttttagttgacttttgtgtatggtgtaaaataagggtccagctttattttcttacatctgttaatctcattttctcagctccatttattgaaaagactgtcctttttccattgaatagttttggcacctttttcaaaaattatttggccatatatgcaggggtttatctctggtctctgtcttcatctgtacagttgtctctcagtatcgtgggggattgattagagcccccaaatccatggatggtcaagtgctttatcagccttaaggtggcatagtatttgcatgtaacctacatacttctttctgtatatgttcagtcatctctagaatacttaaaattcctaatacaatgtcagtgctatatagtacttataatacctaatgcagtgtaaatgctctgtaaatagttgttatactgtatttttcaaattcatatttttttaatttttttctgaatatttttgatctatcattggttgaactcatgaatgcagtacagaggaccgacagtatagctgtctttatcccagtcctgcagcgtttttgattactgtgggtttgtagtaagtttgaaatcaggaagtgtgagttattcaactctgttctttttcaagattgttttggctgttaagggtcccctgcgattccatgtggatttcagaattgatttttctatttctgtagaaaacatggggatattaatagggtttgtatgtattgaatctgtagatggctttgggtagtgctgatatcttaatatcggattttctgatccacaaacacagatgtctttccatttatttgtgtgtttaatttcctttgatatgtaccagtcatttgtctccttggtttcttacgtattatttttttgatgttactgtaaatggaattgctttaataatttccttttcagattgtccattgttgatttatagaaacacaactgatttatctgtgttgatttttgtatactgcaacattgccgaatctgttagctctaagagttttttttttttttctgtgtgtgtgtgaaattgttagggttttgtacataacaaattatgtcatttgaacagaggtaattttacttcttcttttccaatttgaatgtcttatctaagtttctgactagtccaatgctgcgttgaatagaagtggcaacagcaggtatccttgtcttgctcttgatcttagagaaaaagcttttagtgtttcaccattgagtatgatgttagctgtggaatgttcatacctggccttcattatgctgtattttccttcttttcctagttggtagagtgttttatgaaaaaatgttgactttgtcacatgctttatctgcatcaattgagatgatcataaaattttttttcccttcattatgtgaatgtattgtatttattgacttttgtgtgttgaaccatcctcgcattccagcaataaatctcagttatggtatataatttttttttaatttctctttttaagagacatgatctcactcttttacccaggcagtagtcctatggctgttcacaggcagagtcatggtaataatggtaataatgctgctatggtaataatgctgctgtgaacatcagtgtatgaatatccttttttacacccctggcctcaaatgatcctcctgccacagccttccaattagcaggaactacagatgggtacctctgcacctggctttaattgcatttaactaaaaaaaaaaaattattttgtgatgcctttcattgtttctttgcctttctcacactaataccctggtctaattttgcttttcttttcctctttttttgttttttgttttttgagacagggtctcactctgtcacccatactggagtgcagtggcacaatcacagctcattgtagcccggacctcctgggcccaagtgagcctcctatctcagcctcccaagttactgggtccacaggtatgtgccaccatgcctgcctaatttttaaattttttttgaagatggagtgtccctttgttgcccaggctggtctcaaactggcctcaagtgatcttcccacctcggcctcccaaaatgctgggattacaggcaagaaccgtcacacctggcctaactttgcttggaattgtgtacagttttatagactaatttaggaagtatgaatatcttttcattactgagtctgcacttcaaataacatgtagtatccctccagctattcatgtttgatttttttaaatattctccagtggatatgattttcttcatatacgtcctgtgtttgttaggcttattcttagacactatatattttgacacttagatgtatattgatatatgcctgaatcattaatacatatcttttactcatttgtttcttcagacacaacttttggaataaaaataatgtgatctttcttttcccagtatatatttttagctcatataatagcttggtagcttttttcattcataggcttaataaagttacagtagactttatatatatgaaaagtgttataaagaaaaagtgaaataatgttactagcttcttaaatcttgcctaaagttttaataaactgttcaagatgttatttccttatcatgtcttttgttttatcattatgatcaatggaaatataatatttattttacagaatttcacttttagattgtgtaccagttcatcttcaagtgaaactgtaacaaaaaatttctcattcaaaatacagatttaaaaacattttagtgatgattatttactatacaaagcaagtatatattagaatcctttacattttattttattttattttattttatttttgagacggagtcttgctctgtcatcaaggctggagtgcagtggtgagatcttggctcactgcagcctctgcctcctgggttcaagtgattctcccgtctcagcctcctgagtagctggaattacaggcacacgccaccgcacctggctaatttttgtatttttagtagagaaggggtttcaccatgttggccaggctggtctcgaactcctgacttcaggtgattcgcccacctctgcctccaaagtgctgggattacaggtgtgagccaccgcgcccgacctcctgaagtatcttaaacactactttttcaaaatgctgttatctattcaatacaatcccaatgtgtttagcatgatatatatgtagaccttttatagagttcttttaattctctgcaatagacttcaaatgatttctcacctctgtcaagttttagagaactgctttatttctatttctctagaacactatactttagcaagggttaaaatttggagaatagcaaactgactttctcatgtatttccttcaggttctaatgtttttaaacattgatagggttgaggaaataacagatcagaatgtatccacttcaaacaacaaatggttatactctgaattcttggctgaggtacttgtgatattttaaaatgtattagggctgggtgtggaggctcacacctgtaattccagcactttgggaggccgaggcaggtggatcacttgaggtcaggagttcgagagcagcctggccaacatgatgaaacctcgcctctattaaaaatacaaaaatgagctgggcatggtggcatgcatctgtaatcccagctacttgagaggctgaggcaagagaatcccatgaacctgggaggtggaggttgcagtgaggggagattgtaccgctacactccagcctaggtgacagagcaagactccatctcaaataaaataaaattaaaataaaataaaatgtattgggaaaatgtttagttttactaaattcagtaatgcacaaaggatgaaaagaggataggcgctttaggtatttatggtctattaatgtctttttttatttttacataggacaaaagcaataaccttggttttcacaatactttattagactttgtttcaaggaaattttttctttctctctctctttttatttttatttttggagacagagtcttgctccatcacccaggctggagtgcagtggcgtggtctcagctcactgcaacctttgcctcctgggttcaagtgattctcctgcctcagcctcccaagtagctgggagtacaggtgtgtgccaccatacccagctgatttttttatttttagtagagatggggttcaccacctaccttcccctatggttgacatactgcaactagatggacaatgcacttatactgctgattccttttagttgtgatattgatgccacaaaaccatagaaaataagatttgatcacttcaggttataaactgttacctttattatttctgtccatctaagtaatttggaatattatgattcatgttagagtacccagcagatgtgaaggaaaatatataagcttagtgaaattttgactggtcacttaattgttcattgggaaatgaaagaggtctagaatatgttgaagtttattacagacaaaaataaaaatgaaggggaatctaaatgcattaacattttgtaccttttaatattatagtttttttcttcctctgttccaaagttttccagatactgtagcctgctttttactatgttgataaagaggaggtgtctgagaagctttgtagaaataatgtgggaacatggagaagaactgaattgaggtcagggaaactataaacctttgagtgcttttgtgatgtgatgtgctctatgggaggctgtgtatgagttcaagcttgagaaacttgcttgataaaaatgtgactattaacacttactgttccttcctcttgttaagagtctcttgagaagatgaatttttatttaaatactgttttgtctttttttttttttcctggttataaaatgcttacagatattttgtccttagagttatacctatccctcacaaataacctgaaacataaatataataacagagtatgtcacaaagataggaaattcctggtgattccagagaaactggaatctctagtttgtaaggaaaatagtctctatctttggcttctttggcttgtaaagtgcttggtattatacagattgtccccagtttgttgactcctattatgacttgaacctgctctagaaaggcttttgcccccattactccaaggaaactgcagtgatcaaggttgcaaattacctcgtctttttaaaatcaagcatcattttccagtcttcattttactgggcttatcagcagcatttaatatggttaatcaccttcttttccttcaagtactttgtttattttgcatcctaggacattatgctcacttggtttttctcgtatctgtctttcttgcctctccttggaaggttttcctcatatctacaatcctttaagggctaatttcttggacgtcttttctagctacgctcttgttcttggtcacatctattcctataacctttaataccatctatatgctggagacttctatatctatgtccttgtttggatctctcccctaaatctcagactcttgttgaaacagcttattcattgtctctatttggatgtctaataggcatctcagacttaatatgtccgcagctgagttcctgatactaacctgttctgccttgagtcttcattatccagtaaatagcaactccatccttctagtttaggtcccttgcagtcatcctggactcctttctctcacatcccatatccaaactgtcaagaaagtcttgttggttctatctataaaacatattcagatcccaggcggggcgtggtggctcaacgcctgtaatctcagcactcggggaggccaaggcgggtacattgcttgagtctaggagttcaagaccagcctgggcaacatggcaaaactctgtctactaaaaatacaaaaaattagctaggcgtggtggcacgcacctgtagacccagctacttgggaggctgaggtgggagaatcgcctgagcctgggaggttgaggctgcagtgagcccagatcacaccactgcactccagcctaggtaaccagagtgagactctgtctggaaaaaaaaaaaaaaaaaaaaaaaaaaaaattcagatcccagcacatgtcattttttctattagcattatactagttcaaacctacattatcttttgcctagattttcctcttaagagtctgttgagtctatttctagtagtcacttaactagttacttgtaactagatatctaactgcctcctaactagttcttacccataaaagtctatagtgcctatagcaaacagtcagattatgttacttttatggtcagatgcctccaaaggcttctaaactgattaagaataaaagatgaaggccttataatgggctgagagactctacatgatatcctgctttccagtcattccacatcgacattatcttctattaccctcttacttggcctttttgctgttccttgaacatgtcaggtctggtctccccttatggcctttgcacttgtttctctgtctagaattttttccccaaagatacccacatgactccatcacttctttctggtaagtatgttcaaatgttaacatgcttgctcattttggtcttctttgaagactaccttatctaaaattgacctcttccctcctctgtcaacattttctatcatctatcaccaaatatcactctacttgctttgtctcttatttcttttttaaaataaaaatcatttaaagactggctcttgttctgtcacccaggttggagtacgatggcgtggtcatagcttactgcaatctcaaattcctgggctcaggtgatccacccaagtagctgggactacagatgtgtaccaccacacccagctaattttttttaattgtttttttgtagagactgggtatcactatgttgcccaggctggtcttgaactcctggcctcaagcgatcctttcacctcagcttcccaaagtgatgggattacaggtgggagccactgcatctggcccttgtctcttatttctgtcatactaaacattgtacttctttttctgcattagaattaaattgctccattaaatggacttttatcagctttgataaactgtattcccagcattgagaacattgcttagtggatagtaggtattcacaaaaaaattagctgggcgtggtggtgggcacctgtaatgccagcttctcaggaggctgaggcaggagaatcacttgaactcaggaggcggaggttgcagtgagctgagatcgtgttattgcactccagcccgggcagcaagagtgaaactctgtctccaaaaaaaaaaaaaaaaaagatagtaggtattcagtaattgtttgtttaattaattaaatagaaatgtccaccgggtacggaggcgcacgcctgtaatcccagcactttgggaggccgaggcaggtggatcacttgagttcaggagttcaggaccagcctggccaacatggtgaaacccggtctctactaaaaatacaaaaattagatgggtgtggtggcatgcgcctgtaatcctagctactcgggaggctgaggcaggagaatctcttgaacctgggaggcggaggttgcggtgagtcgagattgtgccactgcactccagcctaggtgacagagtgagactctatctcaaaataaataaataaataaataaatagaaatgtcctagaattttttgaaatttatctttaattctttgagatgcatcactttttattttgaaaaaatcctagtaaaaccaataaaataaaactctgtaatatgcatatatgaaatcagaaaactcctcagtcacttactgttatgaattgactctcagtaaatgttttgaatgtataaatatcaagtattgattatgtatgtggtcagtgttgtaggctaacatagcatttaagaagtaaacccgttctcaagaaatttctacttctagtggagagagttgatgaatattcagcggttgattcatactactgtatacagttgtatatttagaaacatgtttgttatttgttcccagttcctggcacagagcttctgatacccttggactctcccgagtgataggggtgatagaagtgtcatttcttctatgaggcaacccttggtggacttctagataacttcagggtatggtctggtcaccagaaagaccagaccttgaatagaagcttggaacactctcatctccatgccctaacctctggggagtggggagtgactggagatagagtaaattaccagtggcatatgtaaccaaacctctataaaaggtttgcatatgtaaccagacctctataaaaacctgtcaaaaggctgggagcagtggctcacgcctgtaatcccagtactttgggaggccaagttgggtgggtgcctttgagctcaggagtttgagaccagcctgggcaacatagcaaaaccctgtttctacaaccattacaaaaattagcggggtgcggtggctcacacctgtagtcccagctactcgggaggctgaggctggagaatcacttgactcaggaagaagaggttgcagtgagccaagatgctgccactgcatcccagcgtgggtgacagagtcagaccctgtgtcaaaagaagaaaaagcaaaacaaaacaaaaaaaacaaaaccctgtaaatgatgggatttggagagctgagagggtgacaccctgagagagggtgtggaagctggaagctcccttacttcctacctcaccccatgcatttcttctatttggtggttcttgggttgtatcctttataataataatctagtaagaaaatgctttcctgagttctgtgagttattgcaccaaattacctaactggaggagggggcctgggagcccccaattattgctggtcagttgatcaatcagaggattggggaaccccatgcttgtgactggtgtatgaagtaatggcagtcttgtgagacttaaatctgtggagtctgatgctaactctgggtagtgtcagaattgaattgtagggcacctagttgatgtcagagagtcggagaagtggtattggaaaagacatcatgtatttggtgttaggaggaaaaaaaactcaatacttaaggattggattatgtagtaataagtgctgtagatattaagagaaggaacaatatgaaaatgtggcattgttatactttctatgacaggaaggcttaatggagaagctggattatataaaggatgggtaagagttgtgtttgatgaagagactgtattccagagaggagaataatgtgaatatttgcttggaggcaagaaatgtatggcatggaaacagaaacacttgccacatttttatgccatcttgaaaactttctcttcgttttctggttggttacattttgaattataatgcatttattttatgcacattaaatacataacattctgctgcattgctagaagttacagatgatataatgacctaagtctcttctttttagaagtttataagtttaatcgttcttgagtcaaatctgaaacaaatatgaatacacatactttcttcatatatattcaacattgtcttaatgtattttgtgtgtgcgtgtgatatactttaaactgcattgtaagttctctggtatcctagatttattaagaataactgatttcaaattgatatatacccaggtttaaaaattgttggcgttttttctccctggcagtctaggacatcctactctgggcttgttcactatactctttaccctgtaatggcaaaactcaactcttgattagatcagtcttcctgaatctttggacagtatttttggttgcttgtctgtacatcattttaccaggtctaattttcttgctgaagatctcaccagttacctcaaccagtcatcagtatgtacatttaataccttagatgtgtagtccacagaacagtgctttacaaataacaggtgctatataaatattcttgaatatttaaatgtctagtacatgttattcacttgggtctcccatgcttcaaaaacacctaacgctgttaacattgagaagaggattgagaggagcagaatacaaaggtatttattaaggtgattataatagccgtagaataacaggccagagaactgaaagtgattgaataatgagaataaaaacaaaggaagagggttgagtgtggcagtacaaagggatcaaagtcagggtttttttcactcccaccatatgttggagttaaccctttaagtcagcagctgattatgatgtgattttgttgaaaactgggtgatgcttggaaaaggaaaactgagaagagggcgttaagtaaagttgaggaactcaaaatgagataattttgagaaggacttatgatctaatgcaggaggaagggaggagtgattggtattagttcccattaatatagtacttcctgtgtgctacgtattgtcttaatcttgagcactttatatgtattagcttacttcgtccccatggaaactttgtaagttcattactactattatttccattttataggtctggaaactgaggaataaagagactagaagaatttctccagctcatgcatattataactgataactagtatttgaacccaggtcctatgactccagagtccactttcttttgtgttatactaggtcccagtaatagaatccaaggacacctttaggagttacagaattaagtgactgtcaagattcagtctaaaccgtgtaaaaaagggagagtcttctaaataaatggattaaagagagctttcagttcttttgtatatgcaatactgttttacacacggcctttttctgtttgtgcctttttcctacaatccctttgcctttacacctactctgtgcctggttaattcctactgtccttttaaagcacagttcttccaggaagttttccctgacctcaagcacttttcctcctacttgtttgtgttagtgacttcatagtaggttgtcttcataactgttaacttgtatgatttaacctctctgaaccatggcttttttgatctataagataggtactattttacctaaaagggttgttatatgaattgagtgaaattgtatgaagcagttaccacagtgccgttttatgtttcttttactaaacctggttgtgcacacttagtgttagggagacttcagtagacagtacagtaataaaggtcagtaacctcaaggctcagtcttcaaggaagatattttgaattaaaatatccagcaacagtctggtggttctcttccttctgagactcagttgtctcctggggttctaagaggtagatcatagaaactttttataaaggctaccattatttggtggatgctcagagaatgtgtttgaattttgttgattagaaacttctgaatgaaaaacaatgtaattagaatcatttgaggtattataaaggcagatgtgaatgtctggatgtttactgaaattgcagaattttcttattgatttgagtaatacttccttaatcgactctccttcgtgtgctcgcacgcttgcgctctctctctctctctctctctctatatatatatatatttttttttttttcttttgagacagagtgttgctcttgtcacccaagctggagtgcagtggtgcagtcttggctcactgcaacctccatctcccaggttcaagcgattctcctgcctcagcctcctgagtagctgagattaaagtcgcctgccaccatgcttagctaatttttgtatttttagtggagatggggtttcactatgttggtcaggctgatctcaaactcttcacctcaggtgatccgcccaccttggcctcccaaagtgggcaatagttactgaaaaaatatccatcagtaatcctggttagttttctgtaatgtgcctatgtttctcagtgtctttacactgtctgtagattaaggttgctttcatatctcactgtcaccttaggcatcattgtatctcattcccttgctgcatacgcactgttctctaattggtaggtattgtcatccttgtagctgatagagaaataagttcctagttaactttgttatgtcaaattacttaaaaaaataaactgtagactagaaggactgcagtatatatgtcagtgaagtgacttcatgacatataagtgacttttttatgatctacatgttgtttttatatatgatagtattagagaattatacggtctgtttttcaattatttacctaaataaaataatttgaggtgacttttgttaaggataactatgaataagattgataaaatagaaataaggccttaaaaaccatccgtgtaaactgaggtggttcaatagaaatatcctcctcaacttaaatgtatgaacaaatggtaagtgtttaattctgaaatttgttacttgtgtggagttgttgagagtcagggatatatttggtaagtaatgaaataaataaatttttaagagattgtttttcctggctgagtttaaaaagaacgcatttctctttaagtaatattaaatgttgtaattaatagtgatgtttataatagttttgtggtttgcgtggaggttcttcatgtggctgttaaaaaataataattctcagtgaaagccaggaacagaacattacacaataacttactgttgtttctacagagaagaaagctactgaggtctaaaaatacagctttataaaatgatagaattttgagtatgtactaatgggcattaatactttatcctgtggtatttgaagaccgttttcacacaagcatcttcaaatatcagtgttatttagtctttgacaggtgttggatagcagttaaagattgaagtatgagggggcaatcctagatttatccattcagcagatacttattgcatgccttgtacatatcaggcactgggaataaagttgtgaaaggaagtggatcaaattgctgcccttatggaaatcagtttatggaaggagagacaaaagataagaagataaatgagtatgatgaatggtatgtaagataaagtaccaggaaagaaaataaaagcatgaatgttgagggggcggaggtgacattttagataagggagccagagaatgcctctccgagtaggtgacttttgagtgaagacctgaaggaaacaaggaagctagtcacgtagatgtctggagtaagtaccaggcctaaggaagagcaaaatacacagcccctgagattgggaatgagcctagcgtatttgaggagcagtgaatgtggtatggtcagagagcagtgaaaagtgggagaggagaaggaaaagatcagaaggggaacaggatggcaggggatagtttgtgaaggaccttatagaacattttaaggattaagctttcattctggatgagatgggaaggcatgaacgaggtggttttaaaaggatccctctactttctttgttgatagtagactcttggggtgtggggtgaggcagatgcagggagagcggttaggaggcaattgtaacgattctgtggtagcattagatcatggtgatagcaatggtagaggtggtgaaaaatgctcagattcatatttatttccaacacagaattgataagagtgggttgctgaattgcatctgatgtgagagacagggtttaagatgggttctaaggttttggctcctgcaaaacatagagttaccattttttttcagatgagaattgactggaggagcagacattttggagagtggtggtgatagcggtaataatactggggattgggaatctgtcttttagatgtgttaaatttgagatgcttatttagacaggcagttacttaaagtatcatgtttgttagttaaagggagaggtctaggctggagaatctgggagtagtcagtatataaatggcatttaaagctatcagactgaatgagttgatgtagagagtgaatatagaacatacctaagtgttaaaccctggagcagtttttaaagattagatatatgagaaagaagggacagggaggtatgaaatccagaagtgatgttcagaaagcttagtggaaaaagtgtttcgaagaggagggattactggttgtgtcaaatgctgcttagtgaagtaagataaaggctgagaatctacaattcagttttagctaatgagtcattggtaaccttgatcagcagtttcagtgtaatagtgggaacaaaagcctgataaagtgagtttactagagaactggaggtagtagattggagacagagattattgacaaggcatttgggaaaaagagaaatggagcagagctttaggaggaagataagattttgtaaaatggaagacaatataccatatttgtatgttgatgaaaacaattcagagataggattaagttgatgatgcaactaaggaggaattactagaaccctgtctttaggtagtagtagaattggccttagatagtaccataaacttaatccctagtaatagaagagaagaaagagatactgtatttgagaatagctgtaggtagctaggtagtgagagagaggtaagagcttgtggaaatctgattgcttctgctttttagtgaaatagcagctgataggatttgagaagagaagttatgaaatagtcatctaggggagtaaagattgaatgaaataaggaaattatgtacagcaaagactgacttgacattggtcatgattttttaactgacatcgttaatctttgatgaattcatcattcatttccctacagtcactcatctccagctatgttcagctgattgattagatacagaaacaaagtaggtggagagttggatttaatgatgattggggtttggctggaaaactaagatgcattcagagatgggcaaatgaattactctaatgatagacctaggattttacatttggtgagcaaaaaagtgagaaaatgagagatgaatagcaatgaaatggtgttgagatcagtgaatcttaggtccaggggaacttgaatgtgaaaaagaaaaataggaggtagtggcatgagagagagaaagatgcttgaaatcgagatttttgagggattgctgtttggggccatgataagggtctaagataggatttcttatgtctgaaaggataatccataggtttatattgcctgagtaaagttaaagatcctctggtctagagtatgccatggtaagtcagtggttgagataaggttgaggacaaaatcattaaagaagaggaaatcaaagaaatgagaaatggaacaattaaaacagtcatcactgtggatactgaaatcaccagaaatgattattggacagaaactaggacagaaataatattgaatggcatgatgaataacattttagggtacgcatgagtgtggtggatgactggttgatggtagtaggttagtataatgtgctgttcagatttcaaggtactgatttttagagatgagaggatagaagtctgaaaatcatggtagaggaaacagctacaccaccatacaagagagctagtaagtagcttcaaaggagattttaagagtgattttaacttggggaatttaagagctggagtcattgtttacttcactgtggcacctttgaaactgttacattaacataaggtaattgaagaattgttattcctcttgtattcaactgaatatttatggttagcttacagaaatttgcagttgtgaaacagaacagaaacttgtgttgaattcggctactacttaaatatgcatttttaatactctttaacacctcctccctcctcatataatctctcaaggcctgtgattacatattgcatattgaagtcacttcttttttctctttcatagatattaatgccttccaatgcactgttgttgatagaatataaaactatgaggtaaaaatatctcagggttttgcctttctttgaatatagaatctaacctttccaccatattgggtatttatttagagagggtactcaagtattttgccacactcttttttagtttgtttgtttgagacagcgtcttgctctgtttcccaggttggagtgcagtggtgcgatcttggctcactgcaacttctgcctcctgggttctagcagttctcatatctcagcctcctgcgtagctgggattataggcgcatgccaccatgccagctaatttttgtacttttaatagagatggtgttttaccatgttggccagattcgtgtcgaactcctgacctcagccagtccacgcgcctcagcctcccaaagtgctgggattacagatgtaagccactgcgcccggcattgtcaccctcttaagtcattttcaactggaattcaggagtcactatgtgggacactgtgagccggtagaatattctaaaactcagaaatacatattaatcctcagaaattagaaatttcttttccaagtttttcattttccatttcttggactatttgctgttacaatctgtgtttactataatctttccaaattaaatattagttttgtctctgttctacttatttgatttattcagtcattccctcccacttttcaattattcagcctgttaaaagtacaactgtttcttttctggaaaaaataagccaaagctagaaattgttcaagcaggagattttgtttgtggagtgaaagtgaacctcactaaaatagcagtgtgttacatcctggactggcatgtatacagaaaacagcaaattgatctgtaaggcactgttgtagtaaaggagtgcaagttataatctcagctgaatgataaaaggtgatttatatgagaagattacaggtcaggaaatgatttattccaaatgcaaatacttgagcgcattgttcagtagagacaacatttttgtgtaggctatttcgcagacaatgtgagattttaattggtgttctaaagatatgctattggtatgaggaagtgttgtgaggagggcattttacagcagatattattctagggcaatttttttgtccattacaaatctttgtgagttttttcagtgccctgtaaattacgaagttaatcactccaactgttgggaacaggaactattccaaactcaggtgaacttagagaatttcactctctcattctttcagtttgtttcatccacctttgtgtagcttcttaaaagcacataggcttggtcaatcttttttttttgtttgtttttcttaatagatgcgctctgactttgttgcccaggctgatcttgaactcctgggctcaagtgatccttcccgccttggcctcccaaagtgctagggtttactgcgtgagccactgtgcctggcccaggttggtcaatctttatctcattgcttagagagaacctcctctggaaatcttcctctctcggtagcttattcctctctagtattgtgtcctgagaactccagagtcttagcctccctggacttctttctagccttatctccttgacttacaaaggctcctgaatcccatgtgatttcccccttctttgcaggatagtttggaaacttcagtcagttaaactggtttgatcagaaagcttacataatttgtttcccataacctagtccattgccgtttgtaacgtatgttgcatcttaattgtttcatctgtttttccaggttttttgttgtttcaggcagaaacataaatgccaactctgctaattcatctcactgaaaacagaagtctgcttattaaattttagctttttgttattaaaatttaaataaaatgtacatgttgggtacccaatagatgttagccccaaagctgcaaaatactggcttgtagaagtgttttgttggtttatatgacaatttagattttgggacattaaacataaaaactggatttgggatttctcttgatacgtttatactgtaatattttgtttgcatttcagcatttagctgtaactgaaatgattcctagtttagtcacagcataccctctctaaattgttagcttaattttcccttttttttttttttggaactcaatttatatcgtatgggccaggtacagtgactcagacccgtaatcccagcactttgggagactgaggtgggaggattgcttgaggccaagagttcaagatcagcctgggtaacatagtgggaccccatatgtacaaaaaataattaactgcatgtggtggtacacgtgtgtagtatcagctacttgggaggctgaggtgggaggatcacttgagtgccagaggtcgaaactgcagtgagccatgatctcacccttgcactccagcctcagcatcaaagcgagaccctgtctcaaaaaaaaaaaaaaaaagaaaagaaaagaaaagagtacattgtttcttgcccagtagagtttgaaaattgtcattgaggagatatgaatattatcatcatggtttgtgaatgacgtaattgaattatgagttattcctgatgttacagttaagccattgctgctattttttaaattctcagtatctaaataaataaataactcccttaggccgggcgcggtggcacaagcctgtaatcccagcactttgggaggccaaggcgagcggatcacctgaggttaggagttcgagaccagcctgaccaacatgaagaaacaccatctctactaaaaatacagaattagccgggcatggtagcgctttcctgtaatcccagctactcgggaggctgaggcaggagaatcgcttgaactggggtcggggggcagaggttgtggtgagcccagatcgcggcattgcactccagcctgggcaacaagagcaaaactctgtctcaaaaaaaaaaaatgataataataaaataaataaatcccttgtttgagatccatgtatataggaaaacagattatttttattttgtgtttataacctatggtaggttgacagtgaagagaagaactcaggacagttaatgaaagcatcaccttttctttactgagatctcctgtgtaaggaaatcattcagttagtcttagaattgtcatgaaagattaagaaatgttcatagcattgtgatcatcatcttaggtattcagtcggtgaatttctgtttttaggtgtaatctaaaagttctgtaaaataaacatcaacaatgttgtatgcttcttatggctgttctaggtctctgtgtttttattatgaacttgtatctgatcttttcaagtttttgtctcatggtattttttcctcaatgccaattaacagtggttaagcaaaatagataaggttttccttctaagtccagaagtagacattccagagttgatgtgatcatttaaggatgccagggctgttgaagactgggctgttgttctcttggtcttttcctcatggtcagttacaatatagctgatactgttgttgtcttccttagttcagctccaggcaggaaggaggaggaagcagaaaagggcaagaaggctcatagtgtcacacacacaatgggtgggttcatttgcttggtggatgacaagtccagtgaccacaaccaagtatgatttcacagggggattttattacttgcaccaagtaaggaggacactagggatagtcccaaaggcagtgcctccccaaacaaaggtgaacacccgggctagttagctgagtcattgtattagaggtggaataaaggcagtgcaggcacatttatcatgcttttacatacatcagatgtatagaaaatggcacataaactacttcctgggtggggattttagtatggtagtgaggagagtttgccagaagttcatctccagtttagtcatctctggacccaaccactgggctgagcttctttctggaacttcttgaaacaacaagaactcaaggcgcaacagttacaaaagtgagttttctttttctttttcttttcagacggagtcttgctctgtcgccaggctggagtgcagtgacgccatcttggctcaccgcaacccctgtcccctgggttcaagcgattgtcctgcctcagcctcccgattagttgggactacaggaatgcaccaccatgcccagctaatttttgtacttttagtagagatggggtttcaccttgttggccagggtggtctctatctctggacctcgtgatccgcccgcctcggcctcccaaagtgctgggattacaggcgtgcgccactgcgcccggccgcaagtgagtactttttcacagtgcataccccaaaacctggggaccctgagttacaatatcaccttagtttgcccctagtcaaggagctttctaaaactcaccccaagtcatctcaaatattacatcttatttaccagaattacgtcatattatcgtctctgtcttccagaaccttaaaaattttaggatagtccattattgcacctagcaaaatcagtgttcttttggtaagaaagcaggagtagatggatactgtatttacaacttgaagtccctacctcagaaaccaccatactttaggagccttctgttatacccataggttggcctcattttccataactgtgcctcttctgaaagcataaaactacaatatgtcattcttacatatttctgtacattaatcttattttttcccttagcttttattctcttaacttcctcaataattaagttggtctttttgaatgagatggttgccctccaaatgttttgaaagcagaagtgattaatgtttgtaagtcaatatatgttatagtattttattgttcatactctgtcatttcctcctttcacagaccagtagatatacttggttataaagtctataatccctgaatttgtttgcttttcatgaccatctgcactggttttattgtcatctaatgtaggtgttaagccattgtcacttttttaaaaaaatagttttgccagagtcagtggatcacgtctatactcctaacactttgggaagcgaggtgggaggattgcatgaacccaggagttcgtcttcatcgaacgaaacaaaacaaaacaaaaattagccggtatggtgttaaacaccttgtagtcccagctactcgggaagctgaggtgcgaggatctcatgagcccaggaattccaggatgcggtgacctgtgatcatgccactgctctccagtgagtgagctcttgtctctaaaataaataaattagatagttttattgagatataatttacatagcataaaattaaaccttataaaattcattgatttgtagtataccacagagttgtgcaaccatgacccctatctaattttagtatacccccaaaagaaactcactatccgttagcagtcacttgtgttcctcttcctgccacttccagccctttggcaaccgcttatctactctcttgtctctatggaaatgtctgttgtgaacattccatataaatgaaatcatataatctgtgcccttttgcatctagctttctttcacttaatgctctcaagatttattcatgttgtagcatgttgttaagacaacttccttatcagataatgatttgcaaatattttcttctattctttagcttgtcttttcactcttgattttgatgaagcccaatttatgttttcttttgttacttgtgcttttggtgtcacatctaagaaaccattgcccaactcaatgtcacaaagatattcttatatgttttcttctaagagtttgatagttatgggtcttacatattggtctctgatttgttttgagttagttttgtatatggtgtgaagtaatttcccaactttattttttgtatatggaaacccagttgtcccagtactatttaagagactcttctttcccccattgagttgtcttggaaccataccaacttttttaaaaagtggctttagaaatagttgtgcataaataaacatgatttttttattcttaatattgaatctggatatttagaaatgggatagagtttttagtccttagataagagcttacttccctgtttacaattactaggatagcaagtagctcacagtaggaactctgaataggtttgttgaatatatatggatggtgtcttgagaggaaattgagtgggtgaatttaaatgctgttggagcattcagttagagatactaaaatcataaaccttcttatttgtagtaatatagtgctataataagaggcatagtgatgattcttctttttgctttggttttttattttgattgtgctgagtattcatacttgtttgagatgccaaggtgctgctttctcaactggcaaatgttttagaataggaaaacctttgctcacaacattttccctgcaggctactttaaattttgccttgaatctcaaagcctatgtaacattgtatcaaagcaactcgttttatgcatctgtgttggtcattaatgctgtttgccaaatagtttttgttctcatccttcatgttaggggctgtgactaattctggccaataaatgagttgtgagaaaaacagatgtttgaaaggaaattgtgcatcctaatattgctgcagtatttaagttccagtatgagatcttcaaagctgtcttttttttttcttcttccgttctcagatcctgaggcaacattttgaggtgctattccccctgagttaaaaaagacctgtcaggctgggctcggtagctcatgcctgtaatcccagcactttgggaggctgaggtgggtggatcacctgaggtcaggagtttgagaccagcctgccatcatgaagaaaccctgtctctactaaaaatataaaattaggcaggtgtggttgtgcatgtttgtaatcccagctacccgggaggccgaggcaggagactctcttgaacccgggaggtagaggttacggtaagctgagatcgtgccattgcactccagcctgggtaacaagagtgaaattccgtgcccctcccccccaccaaaagaaagacctgtcaataaggaatggacagcctgaagaagtaaattttattttaagccagagattttatggttctttgtgtagctacataacctggcttaccttgaccgagtatttttttcttgttagattctgagacttagataagagtattattattataatagtatgggtatttcagaaatacttagataaaagtcaaggataagggaaagttaagatacatggtattgaacaattagcatttttgagttttactttcttgcccttattgttttttctctttttttcattgttcttaattttcttttatgttttgtttccatagtctaactggtgaggtaatcacgatcaatagtaacttgaactgaagaatggttttgttccagtatatgtttctgcttatagtcactgaaaagtttctcatctattccaaagccctgcttctgtgcaaatttagttcctactacatcaagaaaggaattttaaggatcagaactacagaaacattcagttgatttctttgacctgttgaacactgttctgacatttcaagtagtgaatgttttgtaatgaatgagtcttttgtaatctttgtgaaataatttgtaaaatttcgttaattgatcttttgtcaatattaatgcaagttagagaaaaatgttctttactggcactgtgtaattgaaatcagttacaaagaatattcttagtatgcaaacttaagtatatacatttgcaaaggagaattttatttaaaaaaagtgattgatgtagtttctttactgtgaaaagaaaaatgttttcctgtttttaaggtgacttgtttttttagtcccctcctctcatatgaattccttcataaaatctatgatgtttggtaaagtaattgatcagctgtcttaatatatatatatgtgtgttgtgtgtatttttagggctggaaattgatttttaatgataaagtacagtggacagcacagagggggctaagccaaactgtctgggatgctgtggtggcaatgagctggccacacaaactgctgctgctgctgcttctaggtggctgccttgctggtgaggtccttgccttctctgtagctgccagtgccatctcctttgcctgctccttggcttccttggctgtctcaacaagtgttttagaaggggccttgcatttcatctttgccaagatatattcaaaacccttcatagtcttggtcacgttgcttttgaactgggcaagaccaaattcctggacacttctggagacaccaaataagctagaggagacccaggcttctctgcggatttcggtccagccactgttgttagagttcatacagtaaacacactgtttctccaccaccatcagccgggcatggttgatgttccaggtgaaggtggtcatggtctgattctgtgggtccacaatagagtcctccaggatgtacactgaatgaagaacattggcaggaaacagttgcttggcccagtgggacatcctgttggtcttggtcaggagttgctgggacagcagtttctggtcagcagtcacctcccggtgtactgtgtcttccgtcaagacatgtttgctatagggatttgggtactgatgccagaaggcggcaacactggcagaactctggatcactccctgacctagatatactttacgaacgagacagtttgggtcannnnnnnnnnnnnnnnnnnnctgcgcgtatttatccctgcttttcacgggatgccacgtggatccttcagccccgtggtgaaagaactctggagcacgccctggcccaggaaatacttcaccatcgtcccggctggagtgggctccagagttcctgggaccaggtgttcaccgccttctgggagacacgcggggaccggagctcggcgaacacccgccgccaggctcgtagctcagtcaccactgcaccatgcccaagcagctgctgccgccaccgccatgagttgtccgctgtcttaatatatcttaaaagagttgtgtatagcaaatgctgttataagtgtggacggcattacttacatacacaaaccacattataaaccatgatacttatttttaacgaggatgtcttaaagttatttttaaatctgtgctttttaaggaaataatcgaagcaaagggaatgttaaaacatctgattagttagttttatacttgatgataaagtgtatttttaactatgctaaatcagtaatggagtcatgaagccaagtacattactaattttctatctttttctcttttggagaaaatattatcttacactagatactcagagtaagacttctaaaactagtggtgaaaaggaaaaaacttcatatatttcattttctttcttgtgaaatgagattttcataaggatagtaagtaacctgtggctaaggtatgtgttggggatgattccattgtcttttttttttgagacggagtctcccaggctggagtgcaatggcgcgatcttggctcactgcaacttccgcctcctgggttcaggtgattctcctgcctcagcctcctgggtagctgagattacaggcgcgcaccaccacgcccagctaatttttgtattttcagtagagacggggtttcaccatgttggtcaggctagtctcaaactcctgacatcgtgatccacctgccttggcctcccaaagtgtcattgtctttttatatttactgtgtagtagtaatacagtctcttacgtttaagaattttttttttaatagatagggttttgctctgtagcccagacttaagtgcagtggtattcatagctcactgcagccttgaactcctgggccccaaggatcctgtgaggactaccagtatgcaccaccacacctggctaatttttaaatttttttgtagagagagggtgggtgttgctgtattgcccaggctggtctcaaacctctggcctcaagcaattcttctgccttggcctcccaaagtgctggaattacaatcgtgagccaccaggcctggcaagaaattcttaaatgcattgtgtcacatccttttacatcttaccgaaaaataaatatagaagaacaatatagaaaaataatgcctacaaaaatgtcttaaaatttgtttttaaacttatgcctgtgtatgtgttttccctaacttacatagtaaacattgacattcagtagggctgtgtccttggcctttgcatatctccaaattcaagaacactcacatagaatatatttccgttgaggggaatgtatttgcagagtattcggtcatataaaatgtttaattattgtttcaacttttgtgtttttattttgaaacagggtgttgctctgtttcccaggccggagtgcagtggtgcaatcttggctcactgccaccttctcctcctgggcctaagcagtcctcccaccttagcctcccaagtagctgggatacaggtgtgcacaaccatgcctggctaattttttttattttttgtagagatgggatctcgccatgttacccaccctggtcttgaactcctgggctcaagcgatctgcctgtcttggcctcccaaagtcctgggattagagacatgagccactgcgcccagacttttcagttttgactgagattttatttgtcatgtgatatgcagtttggacatggtttagagaattcacaggagcagtttcatcactccttatttctttgtagattgtatagagacttttaatctcataagatctaaactaccactgaattttttactgtgttttaaaattcacctaaaaattttggctttctggcctcccctgcatgcctgactatatcaaaattcagttttaaaattttttataatttaaggatatagtattaatagcttcatgtcagtttaaaggaaatatattatttgcagttgttcaaaattttatctgtatttatacctatattttacttcagggttcccatcttttccacttttatttttttcccagaaaataaggtgaatttctaaaattagaaatagcagttaagtagttagtgcctgtgtcctgtagttctaggtgtttatgtgtaatagagtagaaattatggaaagatattttcaagctggtaagttggtgagcggccacagttaaaagctgaagggttgaatgtttcagcatgagaaatagtggcgggaggatttctaacttactcattgattgtgttcagttctgaaaaagttttcttgatgtcccattgcagatttgaatgtggtcttataataccccaaatgtatcatcacttttatttctctgagtaaagaaaatctggtgtcgagagtttgcttttgctgattgagcagtttatacttttttctcaagaaattgtaataccttttatcatgatgttcaggtctgaatgatagatccagattatttaaaataatgggttttgggccaagcatggtggctcacacctgtaatcccagctacttgggaggctgaggtaggaggattgcttgagcccaggaggtcgaggctgcagtgagccacagtcgcatcattgtactccagcacaggcaacagaatgagacccggtctcaaaaagaaaaaaaaaaaaaaaaaaaaaagaaataataatggtttttgtgtaagttaaagatgatgttgagcaagccactttaaaacaacactgatttttccatataaacaatagttttatatgaagaagtgtcattttgtttttcatttcaaaaatacaggccatgtgcagtggctcatgcctgtaatcccatcactttgggaggccatggcaggggtattgcttgagatcaggagttcaagaccagcgtgggcaatatggcgagacactgtctctacttaaaaaaaaaaaaaaaagctgggtatggtgatttgtacctgtagtcccagctgctactcaggaggctgaggtgcaggaggtttacaccttcagtcacttcagtccatgaggttacagtgaaccacgataatgctgacagtaagatcttgtctctaaaaatccattttttaattaaaaaaatacacacaatcatatgtctgacaatggtttaatatgcagaatatataaagaacttctaaaacttgaacaacaggaaaacaacccaattttaaaatgggaaaagggcttgaatagaaattgctacaaagatatgaaaatggccattaaacataaggcaagatcgtcagtatctttacgcaaatgtaaatcaaaaccactgtgagattcaaacttactaatatgactataatttttttaaaaaatacaaaacctggaaaacatcaagtgttggagaggattggagaaattggaaccttcatacattgatgatgggaacgtaaaatggtttagccactgttgaaagcagcttggcaattcctcgaaaagctaaacatggaattaccatatgactcagcaatttcaattctacatatttatccaaaagaactgaaagactcaaacagatacttgtatgccagtaccattattcaaaatagacaaaaggcagaaataacccaaatgtccagcaacagaggaattgataaataaagtgaggtggctatataatacagtggaatatcattggtgcctaaaaaggaagttctgaggcatgatacaacatatggataatccttaaaaacactatactatgtgaagtaagccagacacaaaaggacagatatattattccacttaaatctagaataggcaaattcatagagacagtaaattagtgattaccaggggatggggggagatgagaatgaggagttattgcttaatggatgcagagttcctatttgggatgatgaaaaagttttgggccaggtgcggtgcctcacgcctgtaatcccagcagtttggaaggctgaggtgggcatatcaccagaggtcaggagtttaagaacagcctggctaacatggtgaaaccccgtttctatgaaaaatacaaaaattagctgggtgtggtggcacatgcttgtaatcccagctactcaggaggctgaggctggagaattgcttgaacccaggaggcaaagtttgcagtgagccgatatcgtgccattgcactccagcctgggtgacaagagcgaaaactcagtctcaaaaaaaaaaagaaaaaaaaaaagttttggtaacagtggcgacagttgcatagggtgtgaagttattttagtgcccttaaattatacatttaaaaatggttaaattaactttatattatacatcttatcacaatttttgtaaaaagtacatgtgaataccttttcactaaactgccctctcgttagtatggaatggcaaaggctatatcatccatttgaatattttctgtgcccatgatttaaactttcccaagttccactatttatttttgtggtaatcaaattcaggaagcatattattgccctcatgctctctacgcaaaaagtagcatatagtttggaagtccagtacgtttaatgttcattgagtgggtctacagtagagactcctgctttgaatatatatgattagaattaatgttctgaagaaaagtgcttgggctgagtagaaaatataagatattccagatggaggaaatcttgtaagcagaagtgtgaaaaaggtaaaatagatctattatttgccatattaacatgagcaaatggcaagtgttcttttttttatttttaaatgagacatgagacagagtcctgctctgttgcccaggctggagtgcagttggctcactgcaaccccgcctcctgggttcaagcgattctcctgcctcagcctcccaagtagctgggattacaggcgcacaccaccacacatggctgatttttgtatttttagtagaactggggtttcaccatgttgaccaggctggtcttgaattaccaacctcaggtgatccacccacctcgatcttccaaagtgctgggtttacaagtgtgagccgctgcgcccagccccttcttttaaaatacacattgtttttataataaatggtgtctctctcttctatgatctcaaaaaatgtttcattgtatttttatctttaaatttaacaccttgtatttttaatcttttaaaaagtgaaacgggactgtattagtttgctagggttgctatagcaaaatatcatagacaggtagcttaaaaacagaaattaattttctcacagttctggaggccacaaattcaagatcacagtgtcatcagggttggtttctagtgtgggctctcttcctgggttgcagaaagctgctttcttgccatgtcctcacatggccttctcttgtgtatgacagggtaagagaagcaaagaggaagtgaagctctgatatttcttcctcttaaaagtactccagtcttaatcagatttcacttcagggtctcacccatatgatctcatttattcttaattatctccttaaaggtcctatctgcaaatatagtcagacacatcaggggttaggacttcaatatattaattggggggaaggagcacagcagttcaaaataataacaaaaagtacacaaagtacaaatgtacaactcaactaatcattctgaagagcacctgtgtaactatcccccaggtcaagaactagaatattgccagcactccagaacctccaccagttcaacttcccaatcatcacaaatctcttcttctacctagagataattgccaactttatggcaataattttcttgctttgctctatatagttttgccatcttaagtttacatcttttttttgagacggagtttcactcttcttgcccaggctggagtgcaatggggcgatctcggctcacctcaacctccgcctcccggattcaagcaattctcctgcctcagcctcccgcgtagttgggattacaggcatgagccaccacgcccggctaattttgtatttttagtagagatggggtttcaccatgttagtcaggctggtctcgaactcccgacctcagatgatccacctgccttggcctcccattgtgttgggattacaagcgtgagccaccacacctggcctgagtttgcatcttataagcaatgtctaagatctgctgcagtgtgtttttcatttttttgtcttgttgggatttttttagtctcaccagaaagttatcagtttcaataatattttcaaaaatgcatgttttggttttttggtctccattatacaatgtttgttttgtactttgttgattttgtttgttttgtactttgttgttttctgctctgctctttattttctttccttttactttcttagagtttgtctgttttgcagttctctttctaattttgtcaggtgttcttaactaattctttctttcccagcctcctttttttttttttttttttttgagactgggtctcgttttgttacccaggctggggcaaagatggctcattgcctcctcagattcccgggctcaagtgatcctcctgcctcagaccctgccccgcgccccccaccccccatgtagctgggactaaaggcgtgtgccaccatgcctggctaatttttgtattttatgtgaagacggggttttgccatgttgtccaggctggtcttgaactacaaagttcaagcgatctatgctacacctgcctctgcctcccaaactgctgggattacagaatgtgagcccccatgcccagcccttttttagtctttaaatgggccttaaagacccatttgagcctttagattttcccctttattcttacactgtgttcacaaattttcatatgtggtacttttgttggcatttagttttacagaaatacttacaaattttgttgtttattgattctgctggtttttcttcatgtcaccttattttctcatgtacttgtttatctgtgattgtgtgctgggcccttcatttgaaaaattagttgtagaaataacttaatgtctggggtgatttttttttttttgagacagcgtctcctctgttgcccaggctggagtgcagtggcgtgatctcggctcactgcagcttctgcctcccgggttcaagcaattctcctgcctcagcctcttgagtagctgggactccaggcgcgcgccatcatgcccggctaattattgtatttttaatagagacggggtttcaccatattggccaggctgctctcaaactcctgaccttgtgatctgcccaccttggcctctcaaagtgctgggattacaggtgtgagccaccgcgcctggcctttttttttttttttttttttatttcatggaggatttgtatttctttcatccaggtgcctggtgatagggattgtctgattaactatccttttcttagtgtgatttgagattttctaagccaccttgattactcaaagctggactgcagaccataaaggaactgacttaattctgggttacttttgctcccaggatatagcctttctgaattctaactcaatcagggtctttacctttgttggaaccctagatttggacttttttagatctattctgtagaagccaccaagtctatttcttggcctttcaaccccaggacaaaagtagctgacagtgctttgcttatttctctccctgggtttctcaccttttcaggtcttggctcagtagttcttgtctgttttattagtacatggcttaaaacccccaaacttaaagtatatcttatctatatatattttttttttcgagacagagtcttgctctgtcgcccaggctggagtgcaatggtgtgatcttggcttactgcaacctccgcctcctgggttcaagccattctcctgcctcagactctcgagtagctggaattacaggcgcctgccaccatgcccagctaatttttgtattttttagtagagatgaggtttcaccatgttggtcaggctggtctcgaactcctgacctcaggtgattgaccctcctcggcctcccaaagtactaggattacagacaggagtcactgtgtctggtccttatctagatttttttttttttttttgagatggagtctcactctgttgcccaggttggagtgcagtggtgtgatctcggctcactgccacctccgtctcctgggttcaggcgattctcctgcctcagccttctgagtagctggggctacaggcgcgtgccaccatgcctggctaatttttgtatttttggtacagacagagtttcactatattggccaggctggtctcgaactcctgacctcgtgatcccctgcctcggcctcccaaaatgctgggattacaggcatgaaccaccatgccaggccccttatctagatttttaatggtcatgggaatgtttgatgctgttctcaaatatacgggaagcagaaaccccccccacatgatattttaattatttgtttatatgtctgtcctttcagtagggtggccttttaaatttatttttagtatttctctgctgtaagccttttattgtttgtaactcagcacctgataatgtctgatacataagtgcatagaaaatattaactggttttggcatggctttaagaaaaaattgtgaaggtatcctttcctttgagccataaaggaaaattgagattaaatctaattgttttatttgttgtaccttcagtaccagacataataaatttggatgttagtggcagtggaaaatcatgggataatttctgaataaccacttagtgcctcttaaatgtggttaaagggaagattaatttcaaaactgtatgcaggatagatgagatattttgtcaggatgcattttataagtattctatagtatggtaatttttaaagtgtggtccccagaccaggtagcattggcattacttgggattttgtttgaaatgcaaattatctgatcctgcctcagatcttctgaatgagaaactatagtagtatggctaagcagtttgctttaaaagccctcaattaggttctgatgcatacctaaattattgagctactgctgtaacacaataaaacagaatatgattttgatttaggccccttaaaagctaaaggttatttatctttctatgatgagaatatttttggaaaatatttaacgcagtctcaatgttgatctttctttagaattaagttttaagcctctataaagtcattaggtttattagagcaaaattatgacctgaaatagttgagttcgttgaaaaataaaaacttgtctatgttacacaggaaaatgataccagtctaattgttgacaataactggcttattccagttgccttgcagtgttccttaagggagtggattgtttaggacctaactttcttaatacaagtttcattagaagtaaattctctattttttcattgtttggaaggaaatatttaacatatacaatatgatggaacttctgtagaatatagcataatcacagagacagttgtatccatccatttcctagtcagtttcaccatatttttaaatgaggcacaagattactgtgttatcaaaatgttaacattaagctttttaacaagtctgtgtagtcacttgatttttcagattttgcccactaattttatgagggccattgggcaaagtgttttaatccagaatttaaaattgttcatttgtaattgggcaggcttataaaaaggggcatattttaaatctttatcatcactttatagccataatatacatactaaaagtttggtagcaatttgagtatttaactacatagggtggtactttgaaggaaaaagcattttaagttgagctttaatttaatttctgcttttaaaaacccaatatagtagtacgtcatctatgtatgtacattgagcatgcttcttaacatatttaacttccaattctttgataaccggttgcattcaattacttgtttaaataattgggcaagtttcctgagttgtaggctgtgaaatattttcaagatggtttgggtaaaaaattttttcaaagtaggtgccgtcagtgactttgatcacagagaaatcagtatgatcctgtgacaagtttagttttaacaatgtaacttcttgtgtaaactcagtcacctagtaatgtgaattagttgcaaagtgattctgtattcttagtgacccactgttagatgttttcagactagtaaatgataaatatttattgttaaaatcatccttaaaattttatttgaacatgcagcactttttgcagtgtgaaattgaaaaatcaattgtttagtttttaccaaaggaaaattagagttttgtatacatatttgatgaatacagtaaacaggttaaaatttagcaaatagaattttgtaagcatttttaaaatgtgtgaattctgtgataagggggtggctttgctacaatttattacaaagctaagttatatttcattacttatgtaaaatagtgttctttgtttagcttcttaaagtggtaggagaattgtataattccattgattggttccatgcagtggaaatctgacctttagcagatgtttgagaaattgccagcacagcatgatcagccaaaaagacagttttccccttgttacttgacaggcctttcatgctttagtaacatgccaaagaaatgtttaaattatttttttataatatcacatgctctctaaaatattaagaatacattgaaaaacatgcataaaatgagatagatttttcctgcaattacggattgcaattcagctgacttttaaatgtttattattaaaaaaaaaaaactaagataaatgctgattgttttgtgaattatgtgttactttgagatttaaaatgtcttcggctatgtagttaattgttattagggtttgatgtgtgttattttttccatgatcatgttttccatgatcatgtataacaatttaaacactgttataagtttctcttattttagtgttatttaatcgcaagtatcgtctttggttggcttttttattttttaatagaggctttttgataggggttaaatgcatcacagagaagttatcctatctggaacttctcgctaagggcaggatactgcatgaatccactttaaagcctcttctctgaaggacagtatttctttagagaatgaaatgggttcagctgtgtagttgtgggggttcagctgtgtagttgtgggagttcagcaaaaacactgtaagctctgttttcttcaacttcatggattgagcgtacaggaaggggaaggagttgccttaatgtttaagaatgaagtgatgaattgatagtatcagcagttgccagactgtatctttttctgcaggtgcttattttctgtagggcattgcagttgtttttcattgtgttaggttatgagacgattttaaggaaaatttaaggaacatgatcttacatagtttcattttacagttttgtaactgttttgtatgtcttaggtttatatactgaattagttcttccagaggattatgattgaaagttttggctgtgtgtacctatcaccttacaaaaataaaaagatttttttaaaggtcatgttcagtatcagtagttctaagaatatgctaaattaaaatttaaaaatcaaacacctataataaagttttgctgaatccacatgaattgaactaatggtttgtaataccagttatattacaagtgagaactagtttcatattttgatatataaaagctttgaaggaagcataattgataactgtttattaatatcacataatagttaatctttcatattggtactttctgataaggttttattagatggagaagggttatataatttagtaaactggcagcttttaaaaaatgaataatgacactaaaatttaaagatttaatcataatgaggtatatctgatacgtagtacctgtgatattatatattaatagtaaagtcattttatataaggaaaaattttattcttaagtggggttttctaagtaactatatgtttacacaaagtcatactgttaacatttagtcacttccagagtcagtggagttgtatcctgaagaggattaaattgcaaagttggcacagcacataaagcaaaaatgcacttaaattcagttcacttttaaggccttgttgggaataccaacctattgtttgtcagttcatccaggacagtttttttttttttctctagtgttggaataatttttttttttttttgagatagagtcttgctgtatcgcccaggctggagtgcagtggcctgatctcagctcactgcagcctctgcctcctgggttcaagtgattctcctgtctcagccacccgagtagctgggtctacaggcacctgccaccacacccggtgagttttgttgttgttgttgttgttatttttagcaaagaaagatgaagtttcaccatgttggccaggctggtcttgaattcctgacctcaagtgattcaccctcctcagcctcccaaagtgttgggattacaggcatcatctactgtgcccggagcagaataaatttttaatatatattttgataggctgattttcttgcatctcgatttttcttgtatgtcagtaactggaatcacagttaccttttgagcacggtgctcacattatgagagttgagaaaattacggggaacaaactctggccttatggtgattctggttagacttgagatctctaaattgatatttttaaatgagaatatataatacacagactaaaatatacattttaaggttaaaaaaagagaaactgtttactaagaatgtttagtagattcagttttcttagtgtttaatactagaaaatacacagtattggctgggtgcgtggctcatgcctgtgatcccagcactttgggaggccgaggcaggcagatcacgaggtcaggagatcgagaccatcctggttaacacagtaaaaccctgtctgtactaaaaatacaaaaaattagctgggcgtgttggcggacacctgcagtcccagctactcgggaggctgaggcaggagaatggcatgaacccaggaggtggggcttgcagtgagccaagatcgcaccactgcactccagcctggtcgacagtgcaagactccgtgtcaaaaaaaaaaaaaaaaaaagtattgatagcatacttttaagaaatccaaatgtctttgtaaaagtaggtatttttcattctttcagtatcagttactcttcactatggttctttttcacatttaaatagaatcaaggaaccttttatctttggtttatctggtatttttcagtgttagcaattttgaaattctctaatttttaccacaaacatttttgactctttcattcagcttataatctgaattgacagaaaaatccagggagaaaagttaaaatacttcctaaagttaaaatatttgctttatttagatttctagtatttcttatcaaggaaaaaaatactttttcattatcttatcgcttgataaccgttttttgtctcagctaaacggaagaaaagttacctggcagcataagatagctatgaagaatctttcccccaccagaaagaagtttagcaaactattttactgaataaatctaagacttcctccttcccagtagttgcccacaattttcctccaatatgagattatgtctctattttgtaattctgctcagaaaacctgtcttaaaatctacacatattaaactataatatgtcataaattttaagaatgttatttaacagaggtaaatttatcatgaataccatatatttaaggtagcaaaacataaagagagtaataacctcttttgatactcaacagcagaccaggtaaagtccaaacagttctgtctcatcaaaataatgaaggttgcttgtctttgacctcttttcctgttacctctttaagagataacacacatatacatacgcttttgtagatgagaccattctaaaatttataaattgtgttgtatatctttgtctgcctgattaaaatggcttgtcttaaggtaacactgaactgcttagtctttcaataggaatttatttagcaactactttgtggtattgttttgatatactctatttttgtgtttcggctttttcttatttattttaattaaatcaatatcatccctcgtatacactattcttctgtgcagttgacacttgaacaatgtgggtttgaactttgagagtcaatttatatgcagatacttttaaataaatatattgcaaaatattttagagatttgcagcaatttgaaaaaactcatagatgaaccatgtagcctagaaatatttttaaaaatttagaaaatgttaggtatgtcataaatgcataaaatatatgtacatcttagttttatcatttgctaccataaaatatacacaaatctatttaaaaagttaaaatatcagaactttacccacacagagacgtgacatggcactatttacagtagagagaaatataaacaaacataaagatgcagtattaactcataactacataaaattaactttagtacatgctgtgataggtttttagccacctcctgtttttactgtgttgaactcaaatgttgcgaatgtctgcttaaaactcagtgtgatgctgacatctccatgtgagtagttgacctctccactaaataccatattgcaataagaaatgatctctcgcagtccttgcataatttttaatgttgtttagtgcaatctcgcaaacttcgaatgataccatagaacagaaatttaggaatcaataagtacagtactgtaaatgtattttctcttgctcataataacttctctagcttactttactgtaagaatacagtatataatagacatacaaaatatttgttaattgactttatgtcattgttaagacttccggtcaacagtaggctattaccagttaattttatggggagtcaaaaattacattcagcttttcgactgggcgggctgtcctcagtcccaacccctgaattgttccagggtcagttgtacatagctcttcatgtttttaaaaaacacatttttggctgggcatggtggttcaagcctgtaatcccagcactttgggaggctgaggtgggcaaatagctggagctcaggagttctcaggagttcaagagcagtctgggcaacatggccaagatcttgtctctatttaaaaaaaaaaaaaaaaaaaaaaattgggccaggcgctgtggcttacgcctgtaatcccagcactttgggaggccaaggtaggtgggatcatgaggtcaggagatcgaggccatactggctaacatggtgaaaccctgtctctactaaaaatacaaaaacttagctgggcatggtggcacgcacctgtagtcccagctacttaggaggctgaggcaggagaatcacttgaacccaggagttggaggttacagtgagccaaagttgtgccactgcactccagcctggacaacagagtaacactccgcctcaaaaaaaaaaaaaaaaaaatcaggccgagtgtggtggctcacgcctgtaatcccagcactctgggaggcccaggcaggcggatcacctgaggtcaggagttcgagaccagcctgaccaacatggtgaaaactcgtttctactaaaagtacaaaaattagccggacatggtggtgggcacctgtaatcccagctattcaggaggctgaggcaggagaatcgcttgaccccgggaggcggaggttgcagtgagccaagattgggccacctactccagcctgggtgacaagagcgagactccgtctcaaaaaaaaaaaaaaaaaaaaaaatcagtgacacatttgtatctactcatgtaactaccatgtttctcactcactgtagttaacctggtacctctacccagtctataccgcccctctgttccactgatctcagttctatcaccaaagatgagattttcctgttgttgaacttaatataactggaatcattcagtggctttttacactcagtataatatctgtgaaacttaatatattagattcctagggctgccataacatcacaacaaatttggtggatggaaacaacagaagtttattctttcattgctctgaggaccaaaagtccaaaacttcttcattaaatgggacatagactgattagtaacaagatttacttgtctttctccatggtttcaacagtgaaaagtagttttaatgttgactgaaagttgattagtgcttaagacctgaaaatgcttaggattgtttgctgttggaagatacggctcttatctacttttctccattagagctctggagttctcttgggcctagaaagaagtaatttggaacagttagtgtagtgtggggtattatgaaaaccaaaatagagtattataataaaatatataataaaaacatacataaaattactggtttgggctcagtatattttttgtctttaaaaagaagatgctaactcaaggaaagggtaataaggtatgctggaaagtttatttgcttagaagttaggactgatttctggtcctggctctgtcattaataattatgtctctggattcttatggaaggtttttccagttcttcatatgacagcttggtattagcagtggtcctgacatttatagatattatcactttctttcacctcactcactcttcatttccttcacagtattaacagtaaccttttctgttacattttgttaactttagaaatagtagatcatgttagactaagtagagatcacaaaaagatgagatttaggagaaatccatagatgttttgaactgtggatgaatagttcaccaactatttcctgtacacaaaagccatgcaatatatgtgattaaatttgtgccttggtgaaataatatgttatatgtcactgtatgtattgtggggtcatttataaatggttacaatattttaaagtaggaatacctagggtctgcttgtcgttagttttctgtgatagatattcgacagtgcttcctggcatttaggaaggggcagtgagatcttttaatacatctagagaagacacttccttatatgatcttttcatttattcaaatatatatttattacttcctctgtgccaggtactgtgtggctgagcagcctagacttgattctgtaaaggaaattaaaaatcccaggacccccagactccttatgcaaaaggaaagttaatcctggagtctgagtcatgcaacacactctttcaagtgagtagctgttactaacattatgccttaaccagatcctcatgtaaaagtaaaagacctcaggcatctatgaaagacttcccctacagatcactgaaaagcaaatgcttcgctggtctcccacaaacagatacatgccaattgtaactttaggtgtacaatctaagtgaagctcctaaaactaaggtctgttctgtgccacactgataatgtcatttacaatcttaccttctcagatgcagaacagagacaagaatagtcattcttccactgacccagagatgtctgcagaattgatttttcctttactctgtttttccttcattcacctaatattatgtaaaatatagtttttactagataccaattaaaatctcacaggaatttaaccattcacgttactgcctacctgtccctcttcctacatgcctgccccgctttaaggaaacacataaataggaaacctcctgaaaatctctttggaaaaacagttacatatgtgttggtttttcctggatgggccctaaagctggcttaataaaccttgattggttgagactgtggcctcagtcactcattttggttgccagttccatccctcccagaattttctgtgtatggaagttgttttatgtatgtagtaagatgtcaattacgagtggtttgtaatgactgtgcttttgaaatggtagtacttattaaacattagtaatttgagaaattaacctgcatgagacttaagagagaacattaaagtaaacatttaaaagttttatttctaaaatgtcaacacaatttttggttagctacttagtatatgttgacttttaatttcttggaaaatactatttttttggaattaatgatatgtacttgccactgattaatcagatactccctaagttacgtaaaatcatttcagtacattcaggtttgtatattaggtatcctgtcaattttatcttctttatgaaatctttcctcaggcctttatatctgtactggccctccaggcctcttgattttatgtgactatcatcttggtgatttccttgactcacttttgctggattcttttcgtggatttcttgtcttagtttattctcttgtatcgatggagtatatcttactcctttaaaaaaaaaaaaaccaccctacatttaggatatacttgatggcccgttcatctgaaaatatcttaattctactctcaaacttgactcagacctgactggatatagaattctagatgaaaaattagaaatgatttttcctcagaatttgggaagcattaatcagtgacttccagattctgaatttgcttttaaaaagtcagatgttgttctggtttttgatcttttatataaaagaaacttgtgggatcttttcttgtgtctctgcttggaaatttcacaataactttcctagatgtacattgatttttatctgttttttttttctgagacagttttgctcctgtggcccaggctggagtgcaatggcgcgatctcggcttactgcaaccttcgcctcccaggttcaagcgattctcctgcctcagccttccgaataactgggattacaggcgcccgcctccacgcccagctaattttttgtatttttagtagagagggggtttcaccgtgttagccaggatggtcttgatctcctgacctcgtgatccacctgcctcggcctcccatagtgctgggattacaggcatgagccactgcaccaggtgatttttatctgttgtgcttagcttttgaggagttgcttttcagttttgaaatttatgagtgttagttctgaaaagtttttctgaattgtttctaagattctcttttttctctgttatgtttctcttttctgaaacttgtgttgggatattgaaccacactgattctgtttttccctttgtctcctatatcctttatgttctacttggaaaaattttcagcttccttttctaaacctattgtattttttatttctgctatcataatttaatttgctaaagatttttttctgtttttttttttgtttgtttctccagattgttgtattttgatagcatccttttgcttttgattatggtattttcctcttacctcattcagaatattctttttttttttaatgttttgttttcttctctttggtctattttcttcctgtcatttttccctatgtatattttagtctctgtattttatgtctaatgttttcttcaaatgaaattcctgacaattctttcagactacttgtatgtaatagagtaacactaaaaaagtacattggaaactctgagcatgtgggtggactttgttggatgtcatcttatctatttgagatctgctcatttccataggggaatacctaatgtctgtatatttagatttttttaaagtggttaggtttccaaagaaatctgtcagtgctttatctggctttcagagttatgccctatgaggaaagaagactgaggatgaaaggagggtctagtcctagacatatttcattatgtcagctttcacttaatccttcttctgtttcaatggtaatctctgccctcaacctgttttaatatgcttcttggtccagggaccctttcataaccttttctaagaaataaacctttttttcgtaccataatgggaaaggagacagttgctaggctagagtcagggagaaatctgagagtctagctgctgcttcagtagactatggtcagtcttcctgttagccctactttacccctactcaatttttgaacctttggggcatagcttatctttggtaatttagcatattaatcagctttccctaatatttggctttagattaagcttctttttttttccactaagttagctaccactggttttgctgttattttaaaattagtttattttacccatcttttcaatctgttgaaaccttacaatcctcatcatccagcatgttaattattattctttgagtcctacattcatttcacaatttgacttttgtaagtgtcttgactgaagtgtaatgatagagccctgtggaatatatttgaagacattttatcaattttactttagttcttggttaatattataagttatggttgtttattccagctatcagtacctgcttgtgctgtattattgagtttttatttttttattttattcctaagaatattttcaggatattttcccatactattttgcttaaaaaaaaatctagtgttggattagttatactagcctacctaaaaagaagaaatttattgataataaaaatttaacatcacttgtagggaaataaaattacctcttggtgtagccttttttctttttttatgcctttaaaccatcttacaaataaaaacttctggactttgatatggacacatattgatggattattaaacttttacacttgaaacttctgtgattgtttgatacatattttctaggaaacgtttttcttcatgtccaaaattgcttattagaaactgttctcttccagtattgttttccacacattggagatgcatacatgcctaattccgacctgtgattagttaagctccacagaaaaaaactaaatttaaaagtgactagatattctctgtcttcttatttgctcttcatttactttttaactatgtttcttctaccttttccagttttttattcaattctccttagtggagaagatggatacaaagcaggaggtgtgagtagttgtttattttgtctgcatctgttaatattacaccatctttcccatgtaatattcttgtttcttcttagtttagcctcctgaatttatgcaggcaatgggcttgtttggttttcctttgtattacttataaaatgtagtttgttctgataacgttcttataagattgatgatattaatctgtatatatgcatatttgtttctctcctgttatatatatgtcctttaaaaattggacaccagaaactatgtagcctcattgttttactcatccccttcatttattcagtccactgacagtaagttcctaatgtatgtcaggccctgagaaatcaaatattgatattactttttactactagagttactactttcacaggaaatgtctgctgcattttcttattagaattattgacatctatagaattaaaaaatacatcttttgcttttttgtctcccatccatattgtcaagtactgtttccttttaaatgtacatgtggggctgggcgctgtggctcatgcctgtaatccccgcactttgggagactgaggtgggtggatcactcaagcccagaagtttgagaccagcctggccaacgtggtgaaacgtcgtctgtattaaaaatacaaaaaaattagctgagcttggtggcgcacacctgtaatcccagctacttgggaggctgaggcatgagaatcgcttgagctttggaggcagaggttgcagtgagctgagatcatgccactgtactccagcatggacaacagagcaagactccatctcaaaaaaaaaaaaaaaaaaaaatctacatgtggtattaaagtagactcaggtttgaattctgactctcccatgtattagctgtgtaacagataaatcacttaatctttttgggtcttgagttctcatctgaaaaacatatttaatacctactttataggatttaattgagagaattgaggtgctaaaaatgaagtgagagaatgtacatacatgtgttgtataaacttcttaaatttaaaaagttatatgatggtagtatttttataaggattgctattcacatatttatccttgcactctgtttgaaatataattgtagttatccttgggagcaagaactaattgtatcatgttgatccttaaacattgcagctggtaaatagcaaagactcctactttttggattgaatttcttcagaaaatggacttagaacaagtgttaaggtagttgctatttcttttcaccccatgtactgcttttgtttcattttaaaatttaatgttaaaacattctttatatgaccaatttttgttacatatttataagttaataattgcttctctttatcctccttccctaattactatgttgtcacccttggctttatggattttagatgttttacatctctgctactcagtaacctttcttgttcagatctgtttttgaaaagataaattatacagacgtgttactatattccaatcataaatttcatttttcttcttttttcatattaagagataatttttacttcttcatgttaaaatctcaaatatatcttaatacttactgggtatgctagcacgtagctatagttattcagctactcaggaggctgaggcacaaggatcccccggagttcaggagtttaaggcctgcctgggcaacatagcaaggccctatctgtttaaaaagaaaaaaaaattagcatgtggttccactactggaatataaaaagccaagattaaaaatattagtgtgtcgtatatcttttctctctctgctttttttggtctcgtttgttttgaaatgagactggccaatttatctgttggttcttcctaaaatcaaatttgctgtttctctaaataactgcattttatgtgtccttactctttttaacgtttcattacagtgcagtcttgatcatggtgacaaatatctgtccaaatattgtctctctagtctttatgaagtacatcattcactttttttttttgagatggagtcttgctctgttgcccaggctggagtgcagtggtgcaatttcagctcactgcaacctctgcctcctgagctacagcgattctcctgcctcagtctcctgagtagctgggactacaggtgcgtgccaccataccaggctaatttttgtgttttttgttgttgttttttttgagacaagagtctcactctatcgcccaggctggagtgcagtggcgcaatctcggctcactgcaacctccgcctcctaggttcaaatgattctcctgcctcagcttcccaaagtgctggaattacaggcgtgagccaccacgcccggcctttttgtattttttagtagagatggggtttcaccatattggccaggttgatctcaaactcctgaccttgtgatccgcctgccttggcctcccaaagtggtgggattacaggtgtgagccactgcgcctggcctgtacatcattcttttaagttggaaaaaagaaaggaaaaccaatgcttaaacagcgttcgcacttaaggtctgttggttactttgttaagtccttttgttgtcatgcttaatccttaaaacagccctctgaaatactattaattttgactaacttgaaaactaaggctcaaagacattgtgttcaatgtctctggttctaattccaaagaacattgaatatgtcatttcacaagctcttatatggtattacctatgtaacttgatcatctgatgtgaagaccttaagtgattttaagtaccacctttattagattttagaaatattataagtactctttattcattgtcagtcttactaaattggtacttatctggaatgtactttggaagtttgtttctgaagttttaaaaagttacacagtttggataagtaatgtacatttgagtggtaggatgacttatactagctttgggcatcccttggctttcctggtgacacttaaatttccagcttgctgacactaacctctttctcttaagaaaataaaagcagagatccagagagtggtctgtccgtctcagtttttccttaactttcttttggtttcaaacattatttcaatcatgctttccttctaccgtgatggaaaaatgagcttggtatgttttaggaataggaagaagattaccatactgatccgtagagtaagggacaagtggttgttagcaaggtcagaggagtctgcagaaaccagatcttcagggacttaactagcataaagagtttagattttattctagtaccctggaatgctaaattttaaaataaggggcatgatttgacatcttttttgaggtttttaacatgttattccacacacaaaaaggaagatttaaaaatatacccattaaactgctaaaaagtaaatcgagtggtgagaatctaacagaagtctaatttctagtatgtttattatatggttgtagttacagggactcttcctagcttaaagctggggctctggaggctattttatactttagtgcaacatgatagggaattaaagtgcagaaatgttggtttattatcacatttttctatcccaaagtggcatgaagaaaacagctacttgactgcacagcttttgggaatggggataaggcattatgatattcctaaaaacatcctgttcagatgagtgttacatatcatcaggtattaagcttctgctcatttacacagtcacaatttcatttattcactcaacacaaaggactaacaatttttaaaaagaaaagggaaagtggaaagtttattttaacgaaatgttacaagtattcttcgtaaatgtacttactttctcattttatatgtaaattatggttttaattttttatttctctgatgatttgtgatattgagcatttttttcatgaattttgaccattttttagccctttgtatgtttgcttttgaaaacaatcccctgcccactttttttgtttttttttctttttttttgagacggagtttgctcttgttgcccaggctggagtgcaatggcgctatctgggctcattgcaaactctgcctcccaggttcaagcgattctctttcctcagcttcccgagtagctgacattacaggcatgcaccaccacgcctggctaattttgtatttttagtagagatggggtttctccatgttggtcaggctgatctcgaactcccgacctcaggtgatctgcctgcctcggcctcccaaagtgttgggattacaggcgtgagctactgtgccctgctgggtcctcttttattagggtattaattctatacatgaaggctctgctttcatgtgttagtcaactcctgaacgccccacttcttcataccatcccaatgatgactaggtttccacatacgaattttagtgggggacacaaacattcagaatataggagatatttataaaacaatccccaaagcttcataatgcacactcttttcaagtgtacgtggtggtatgttcatcaggagagaccatatgctgggccatgaaacaatcctaaatacattgaaacagacagaattaatacaagggtatattctcggaccaaaatggaattaaatttgaaatcagtaacaatacaagaggcctaggtggggggattgcatgaagccaagagttcgagaccagcctgggcaataccgtgagatcctgctctacaagcaaaaacaaaaagtacagtatctaaaaagaaacccaaatatttttacattaaacacaacaattttcgacaacctgttggccaaagtaatcacaaggaatattaagtctttttgaactgaattataatgaaaataaagcaaattagaatatgccagtgcatcttcaactggaattagagagaaatgtgcatcttcacatgcttataatagaaaagaatagaggttaaaaaaaaattgacctgaagttctaccgcaagagaggaaacgaggccgggtgcagtggctcacgcctgtagtcccagcactttgggaggccgaggcgggtgaatcacctgaggtgaagagtttgagaccagcctggccaacatggcgaaacttcgtctctactaaaaatacaaaaattagccgggtgtggtggagggcacctgtaaatccagctactcaggaggctgaagggagaactgcttgaacccgggaggcggaggttgcagtgcactccagcctggtgacaaaagtgaaactttgcctcaaaacaaaaacaacaacaacaaaaagggctggatgtggtggcttacacctttaatcccagcactttgggaggcgaaggtgggtggattgcaaggtcaggagttggagaccagcctggccaacatggtgaaaaacatagtgaaaccccgtctctactaaaagtacaaaaatcagccgggtgtggtggttgcatctgtaatctcagctactcgggaggctgaggcaggagaattgcttgaacctggaaggcagaggttgcagtgagccaaggttgtgccatggcactccagtttgagcgacagagcaggactccatctcggggccgggggaaaggcagaaaagaacaaagtaaactcaagaacaaggcaggaaataaagagcagaaatcaatgaactagaaaataagcgggaaaaaatgaaccaaactacactgagttaacaatgttcacctataaggtagtccctcacttggcttctcttccctcaatggacaacacacccaattggtgagactctagaggagaggaatggacacactcacatgttgtttattggaatgcagagtggtataacctcctataatggggttttgtcaacatcatctttgatctaggaaatcctaccttaggagtatgccttaaagatagaatggcaaaaatacaaaatgacatatgcacaaggatatattcattgcagcattatttagagtagcaaaagattgaaacaacccaaatatccatctgttagggttctgattgaataaaatggttcatgccccaagtgggatattatgtaggtataaaaatcaaaaacaataccttttaagctgtgattgctactgtacattttgttaagtaaaataataagatacagaacagtgagtaaagtaggctttttatttaagtaaatatatttgagtatgtgttcatgtgtatatctatgtttctacttttatttttttttaaaaaatggaattaacccaaaactaatttattatagggaacaggtatagaaggactagctagaattctccgaatataccttgttttctagatgtgactttgaatcaagtatgtcaatattttacataatcccaaaagaagtttttgtcattaaaaaaaaaaatcctaaaaggaaaagcaaaatgaaacagaagcctaagtggcataaccataggaagaaactattttaagagtttttaacatagtgatttaattatatatgcctgggggttatacctttgtacaaaaagaatggaataaaaaccatttaatcatagtgttagtattattatttctagactgttgtatatatattgtgtgacaaagtaaatgagtttatgttgttgcataacaagattttcagtataagagaaataaaagatcaaggaggttgaaaaacagtgtagaattttatttgaaagtgtcagtatactaattctgaccactgtaaaaaggcctagaaaaggtgaccaaatcaggagtaatgagcacccctagcactctgattgttgtttctgaacactgtttcccgcagaaaagtaccagggttccttggatatatggttgatttcaggtctggggcaggaaatggacaagatgatcctgggatattttgtaataccagaatcaaagaagctattaagagattactaaggttgtatctaaaagacttaggagctaccttgaagattgtctcactgaccaaggatggaaaatttgacatcagtaagaataacaactgcagtgatttgatacgtatcacatttatttaaatccggaaagtttatgatgctttccctaaaaaacatctattgtttactgttcagggaagtcaggataccaaccgatttcaaaactcataaaaatcaaggatttattcttctttttagaaacaacctccaagaaaccaaaggtttgatgagggaattctcacttaaaatatattccagtggccaggagcggtggctcccacgtgtaatgccagcactttgggaggccaaagcatgtgaatcacacttgaggctaggagttcgagaccagcctggccaacatggtgaaaccctgtctctactaaaaatacaaaaattagctggatgtgatggcacacgcctgtaatcccaggttactcaggtggctgaggcatgagaatcgctcgaacctgggaggtggaggttgcagtgagccgagattgcgccactgccctccagcttgggtgacagagtgagagtctgtctcaaaaaaaaaaaaatttttttttttcagatagtaaatgatgaagcaattatagttagaatatcattatttgcaaatctcagtgaattactagatttagacaattatcattggctgctgttacataaaaatataatcagacaacacatatgtgcctcttgatgaagaataccgtattatgtatgaggtagtcttttctaattatcaaccttgaatttgattaatactccagttaaacaattactggaaatacaagaatggagaaacatattttaaaatgccacagaatagtaaaatacaggtaattgaaggctgtatgggagaaatgactttatttctttaaccaaggggaaaaagcaagaggaacctataaataatagatttaagagtcatatatggttgggtgacctggggaagcaagaaaaaaaaagtcatatcaaacagttgcaatatgtggaccttatttagatcttaacttgaacaaactgtaaaaacaagaaaaacaaacaacccaacctgggaaacttgaatactgcctgttaaataatggatagttttagagaattaatacttctttcagttaacacaaggtttgccatgagttgagaattgttgaagctggatgatgagtacctggaaatctgctgttactgtctctgtaacaaaaggttaaaaattttaaaaagaacaattaggttattttcaaaatagcattttgatattccaaagttacacattaagagactaaattgctgaataattatttatgaactttaattatttgtaactttcactctcttatggtgatgaaacattggttaaaagatcaagccagacactgtggttcatgcctgtataatcccaacattttgggaggccaaggcaggaggattgcttgagcctcagagttgaagaccagcttgggcaacatagtaggaccttgtgtctagaaaaaaataaaaaacttacctgggtgtggtggcacatgactgtatcccacctacttggacagctgaggtgggaggattgtttgagcccaggaatttgaggctgcaatgaaccgtgattgtgccactgtactccagcctgggtgacaagagtgagatcctgttcaaaaatacaataaataaaaaggtcagatcaaaataaataggccaggcacagtggctcacacctgtaatcccaacactttgggaggccgaggcagacagatcacctgaggtcaggagttcaagaccagcctggccaacaaggagaaactccgtctctactgaaaatacaaaataagccgggtgtggtggcacatgcctgtaatcccagctattcggggggctgaggcaggagaattgcttgaacctgggaggcggaggttgtagtgagctgagattgtgccattgcactccagcctgggcgacaagagcgaaactctgtctcaaataaaataaaataaaataaagatcagttcaataaataatagttacttttgtttgaagactgtggttatttattaaatgtaagcactatagtggatccagtaagaatgaagagatcaaaacaattattaatagggtttgataggaaaaattcaatccattaatttgtcaaaatagagtgttactgaaaaaatatatacatgtaaatagtcttagaaaagctttcttcagtcatgattgtgacacttaactccagcttagacaacgagagtgagaccctgtctcaaaaaaaaaaaaaaaaaccaaaaaccagttcttcttgaacgtggctgtgatatgaaggtataaaaaatgaaaatttctatgaaactgagatgtagtttgtataccagttgttactttccttttttaaattttatactttttttttttgctgaatctaaggaagtatatcacaagacatacctaatgctctgtgcctattgtattattagtttctcttctctacaaaatagaaatattctttctaacatttccctggaaacgaatgtttctgagcttgtaaataagattccatatcctaaacttttctgggacccaagatttaccacagtttcatttagggaatactattctgttaatgctttctctttcaaccaaattcgctacattgcccgttgtatatcatctgatttgttgtgtgcacaccacatgtctttaatctcaagttggcagcgtttctatagctgctttctcacccctacttttactcctatatttgcctttttaaagcaaaaaataaaaaaggagaggtggaggtgaatatgtcagagaactaacaaggctgttcttttttatctcttaggaaatactgttcagggactaatttgtgctgtgataatggggtataagttcagtaatcttcggcccacagtgtgttaggatatagcctctgttcgagattattgtctcattcttctaccctttaacataaaaggcacgtgagatttagaatgtatagtataatctctctgtatatatatcatcattgcctttgggagaagggagtggcatgggttttttttaagtcatgctgattcccactttttaacttttttatataaattctctacttatgcatttaatttgtttttaattagagtaaaatttacttacttttaaaaatttataaattaggacaaatgcagtcttgtaaccatttcgacgattaagacatagaacagtgcaatcactcccctataaaattacttttgctaccatttctttgtagtgaaaccttcatctgtctttttttctcaactctgaacattagattttcttgtctttttcttgggtgtcgcatgaatagaattatacagtgtatagagttgagtcaggcttcttttaattatactaaaacattagaaattcatctttattgttgcatatatcaacagtttgtttattgctgagaagtatttcattatattatctgctacagtttgtcccacttcattttggggacatctgggttttttccagcttttgtctattaaaaataaaactgctttaaacattcatgtacaggtttttgtgtaaatataggttatttcacatgggtgaatatctaagtatggaattacttttcttaagtagtttatcattttgcattcccactagcatccagagttagttgctttgcatccttcccattcttttgggcagttttaaaaattttagtcattcttttttttgagacagagtctccctctgttgcacatgctggagttcagtggcgcgatcttggctcactgtaaactccgcctcctgggttcacgccattctcctgcctcagcctcctgagtagctaggactacaggcatccgccaccacacccggctaattttttgtatttttagtagagacggggtttcaccatgttagtcaggatggtctcaatctcctgacctcctgatctgcttgccttggcctcccaaagtgctgggattacaggcatgagccgctgcacctggccaaaaattttagtctttctaatagatgtgtagtagtagctcattgtggtctttatttgtatttctctaattattaatgatttttaatatcttttgatgtgcttacttgctgcctgtatgtcttctttagtgaagtacatgttcaaatcttttgcccatatttttgaattaattttcttttattgagtttcaaaagtgttttatatattcttgatacaagtcttttgtgaaatacgtgatttgtaagtatttccttacagtctgtggcttgttttcattttttttaacattgattttcacagagtaaaacgtttccaattttgatggcatctaacatcactttttttttttttttgtgatggagtttcactcttgttgcccaggctagagtgcaatggcgtgatctccgctcactgcaacctccacctcccaggttcaagcgattctcctgcctcagcctcccaagtagctgggattgcaggcatgcgccaccaagcctgactgattttgtattattagtagacacagggtttctccatgttggttaggctggtctcgaactcccaacctcaggtgatctatctgcctcagcctcccaaagtgctgggattacaggcatgagccactgagcccagcccacattttttgttttatggattgtgcttttgatctcatttctaagaattctttgcttaatccaaggtcacgaatattatattttcttggacaaagttttaccttatacgtgtaagtctgatttatttcagtctaatttttgtatatagtatggattgaatttatttactttctccctgcaggcattcagttatcgaagtatcatttgttgaagagactatccatttccatttgaattacctttgcacattttttaaaaaaattcaattgtcagttctgtttggatctgtttctggactttattctcttattcatctgtgtgtctagttttttttgatgccatatacctttattgtagccttttttttttttttttggagacggagtctcactcagtctccctggctggagttcagtggtgcagtctcggctcactataaccactacctcccggattcaagcgattgtccttcatcagcctcctgagtagctgggactgcaggtgcgcacactaccagtccctgctaattttttgtatttttaatggagacgaggctttgccatgttggccagactggtctcgaactcctctcgacctcaggtgatctgcctgccttggcctctgaaagtgctgggattacaggcatgagccactgtgcgtggcacctttacgatagctttatatgcagtcttcaaaccaggtaatgtgaactgtgcaactctttgttctttttcaaaattatttagcaattctatttccttttccctcccccatgtaaattttagaaggtacacaaaatttgtatataaattccacatttctccatttattcatctaccaatagttgagtagatgaagaaaaatcttgatggtattttattatgtatatattctacattttcttcacctattcatctgttaatagacaggttgattccatatcttgggtattgtgaatagtgctgcaataaaatgggggtgcaggtatccctttgatgtgctgatatcttttccttggataaatacccagtagtgagattgatgaaccatatggtagttatatttttagtgttttcagaagtccccatactgtttttcctaatgactgtactaatttatattcccgtcaacagtatatgagagttcccttttctctacatcctcaccagcatctgttattttttgtctttttaatagtagcctttctcactcgagtaagatctcgttgtggttaagatatatacatttccctgatgattcatgttgttgagcattttattttctttttcacttttgagacaggatctcactctgttgcccaggctggagtacagtggtgcgatcacaggtcacttcagcctcatcaactcaggctcaagtgattctcccacctcagtctcctgattagctgggactacagttgtccaccaccacatccggctaattttttgtattttttgtagagacggggtttcaccatgttgcccaggctggcctcaaactcctgggcgcaggtgatctccctaacttggcctctggaagtgcttggattacaggcatgggccgctgctcctggactcatttttttcatatacggtgttggctgtttgtatgttgtcttttgagaaatgtctgtttatgtcctttgctcacgtgtgtgtgtgtgtgtgtgtgtgtgtgtgtgtgtgtgtgtgtttatgtacttttttgcccaccttttttttttttttttttttttggagacgaagtctcgctctgtcaccaggctagagggcagtggcgtgatctcggctcactgcaacctctgcctcccgtgttcaagcagttctcttgcttcagcctcccgagtagctgggattacaggtgcatgccaccacgcccagctaatttttgtatttttagtagagatggggtttcaccgtgttggccagaatggtcttgatttcttgacctcatgatccacccacctcggcctcctaaagttctgggattacaggcatgagccaccatgcccggccttttgcccactttttaatgggatttttttttaaactgttgagtttctcatatattctgaattattagtcacttgtgcgatgagtagcttgcaaatactttcttccattcaacaggttgtctcttcattctgttgattgtttcctttgccgtgcagaactgtgcagtttaatatagtcgcatttatcattatttatatcgcctctggagtttcaggtcttagccataaaatctttgcataaatctgtgtcctaaagtgttctccctttgttttcttctagtagttttatagtttgggtcttatgttttaagtttttaatccatcctgagttgaattttgtatacggtgagagataggggtccagtttcatttcatgtggatatccagtttttcacataccaattatcaaaatggttgttttttccataatgtgttgtgtgttcttggaaccttagtgaaaaatctgttggctgtgagacggtgtttgcaaaattgtaactgaggaaattgcgacagtgaaagaaatcagtggttttaaatacatgttacactgttagcaacttttacttttggtttaaagcctggttagtacatgattttaatttaaccaataccatcctattttggccactgtaggcttgtaatatattttaaagtcgggtagtgtagtgtgattccttcagttttgttctttttgctcaggattgctttggctccttaggctcttttttacttccataggaattttaggattgttttctctatttctgtgaaaaatgatgttggtattttgataaggattgcattgaatctttgtatcgcttcagacaatatgatcattttaatgatgttaattcttcttttgagcatgggatgtctttctatttgtgtcttcagtttcattcatctgttttgtagttttcattgtaggcatcttttcccttttggggtacatttattcatggatgttttttctttaggtattataaatggaattgtcttttttgttgttgttgttgttgttgttgttgttgttgagacggagtctcactctgtcgcccagactggagtgcagtggcgcaatcttggctcactgcaagctctgcctcccgagttcacaccattctcctgcctcagcctcccaagtggctgggactacaggcacccgccaccatgcccagctaattttttgtatttttagtagagacggggtttcaccgtgttagccaggatggtttccatctcctgacctcatgatccacccgcctcggcctcccaaagtgctgggattacaggcatcagccaccacgcctggccaccttcttgatatgtttctcagctattgcattattggtatatagaaatgctactgatttttgcttgttgatttttttatcttgcaactttactgaattgatcagttctatgaggtttttggtgggatctttaggttttcctagatacacagtcacattattctcaaagagggacacattgacttcttctttcccaatttggatgcctttatttccttattttgcctgattgctctggctaggacttgcagtattatgttggataggagtgaagagagtggcggcttttttgttttgttccagttcttaaagggaaggttgtcagttttccccattcaatattatgctagctgttgtttgtcacaagtggcctttattatgttgaggtatttttcatctgtgcttagaatgttgagagtttttattatgaagggatgttgaattttatcaaatacttcttctgtgcctattaagatgattcatgactgtcgatttacatatgttgaaccatccttgcatccctgggaaaattttcacttgatcttgatgtttttgatgtgctgttgaatttggttttctattttgataagaatttttgtatgtatgttcatcagagatattggcctgtagttttattttgttgttgttgttgttgtagcattcttgtctggttttggtattagggtaatataatgctggcctcttagaataaattaggaagaattccctcctcttcagttttttggactagtttgaggagaagtggtgttagttgtttcaaagtttgatagagttctgcagtggggccatctgatcctgaactcttcttttttgggagattttttactactaattttacctcattacttgttattagtttgtttagattttctatttcttcctgattcaatcttggtagttgtatgtgtccaggaatttatccatttcttcaaggttttccagtttgtttttgtatagttgttcataatggtctctgatgatcttttgtatttctgtggtatcagttgtaatttctcttttttcgtttctgattttgtttatttgggtatccttttttgttgtttattctcaacaagcagttaattgattttgtttatctcttcaaaaaacagtttttcatttcattgatcctttgtattttgttagtatctgttgcatttgtttcttcttgatcttaattgtttctttccttctgttaattttgggcttgccgtgttctattctgttttcatgggatgtatggtttgacactgtatttgaaattctgttactttttggttataggtattaattatgaacttccatcttagcactactttattaaatattctctagattttggtatgttttgaattgatttttatttattgtaaagctacatttgatttcatccttagtttctttcttgacctagtggtcatttaggagcatgttgttcactttccatgtattcgtacacttcccaaagttcctctttgttgatttctagttttatttcattgtggtctgagggtttgatacaattctaatttttaaaaatttgttgagactctatttgtgtccaaaaatatggtctatctgggagaatcttccatttgctggtgagaagaatatgtgttctttagctgtgggatgaaatgttctataaatgtttgttaggtccatttggtctaatgtgcagtttaaatctaatgtttctttgctaattttctgtctgttagcatgcagtgagtttttgggaaaaaaaaaaaaggaaaaaaaaaagaaaaacaaaattctgtctagatgactagatgatctccctaatgctaagagtgggttgttggaaaccccaattattattgtactctttctctccatttagatcttttttctttttctttttttttttttttttgagacagggtctcactttgtcacccaggctggactgtattggcacgatctcagctcactgtaacctctgccttccaggttcaagcggttctcctgcctcagcctcctgagtagctgggattacaggcatgtcaccaatttttgtatttttagtagagatagggtttcaccatgttggccaggcttgtcttgaactcctgacctcaggtgatctgcccaccttggcctcccaaagtgctgggattacaggtgtaagccagcacacctggtctccattgaggtctaataatatttgctttatacatctgggtcctctgctgtttggtgcatatatgtttagaattgttatattttcttgatgaatcaatctcttttatcgttatataattaccttgtctccttttactgcttttgactgtttaattgtagctacttctccccacttttggtttctatttgcatggaatgtcttttgtattcctttactttcagtttatatgtacctttataggggagatgagtttcttttgggcagcatatagttgtgccattattttaaatcatttcaactagtctgacactttaatctgttttattattaacatgtgagggcttattcctgttattctattacttaatttctggttgttttgtgtattcattgttcctttctctcttcttgttaacattgtggtttggtggttttctgtagtgctatcgtttgaggcttttctcttccttgattgtatttgctctaccactggggtttatattctgtgtgttttcatgatgatagataccattctttattttcccagcatcagactcctttaagcatttcttgtagatttggtctagtgatgatgaattttcttgcttttacttgtttaggaaagactttatttccccatcatttatgaaggataacattgtttggtatagtatattcggcttttttttttttctccttcagctttttgaacctattatcccattgtcttctgccctgtaaggattgtgcagagaaactgccgttagtctgattggggttcattaataagtgactagatagttatgtcttgctttttaaagaattctctgtctttgacttagtgacatttttactataaggtgctctggaaaagatatttttgagttatatacctttggggatctttgtgctttatctgagtatctaaactttttgccagccttgcgaagttttcatctattattttgttaaacagactttctagcccttcaagttttcttgttgcctcctcaaacacaaaaaatttgaaaatttggtagctttatgatgtcctatatgtgatgaggatttgctcgttctttaaggaaatttaaattttcttttttcggccaggcgcagtggctcacgcctgtaatcccagcactttgggaggctgagacaggcagatcacaaggtcaggagatcaagaccatcctggctaacacggtgaaaccccgtctctactaaaaatacaaaaaattagccgggcatggtggtgggcacctgtagtcccagctactccggaggctgaggcaggagaatggcaggaacccaggaggtggagctggcagtgagctgagatcacgccactgcactgtagcctgggcgacagagcgagactccgtctcaaaaaaaaaaaaaaaaaaaaaaaatttttttttttcttttttcttctgactgggttatttcaaaaggtctgtcaagttctgagattttttcttctatttgatctagtctgttgaaggtttgaatgtattttgtttgattcgatgaatacatcaggtcccgaatttgtttcatccttttttatgctgtctctttggtgaatttttcattcatatcctgaattgtttttcttttctttgtattattttctttgtgtctcagtgtaacagaatactttagtatcaatattttcaattccaagattttataaatttctttttgattggaatctgttgttggagaattactgtgttcctttgaatttattatcatggattcacattttcttgcttcttcttgtttcttttatttctacattgatatctatgcatcaggtattgacagtcacttcttccagtagtttgaatttcctttcataggggaggaatttttcctagagatgtatctgtggtgttggttgggtagggcacttttgctttgattctggatatatgcagtggtgtagactccatgtgatttttttaggcattaaacagggtcagtgttgtctgtgatttcttctgtggtttagtgggtggttcttaatggaagctgtggtgacattttattagggaatgggttgccacatgggccactttgggctcctttggtggtagtcagaagatcatgtctgttttggggcttcagtgtggcgtatgctgccaccagagttagtgggtctgtgcaggtcgattcttgggcttccaggcagcttgcttgggtgccaggaatggcagtagtggggtgaatgagtgggcaggttactgggccctgggcggtaggcgtggcatagttgatgtcagtagcagtggcaagacaaccccctggaacccaagcatttcactttggtgttggcagaggttgtgacaggctgactaaatcagtctccaggcctgctgcaggtgcccacatgtgggtgggtgtcagctttggtgatagtggtcagttgaatggaccctggcccctggaaaaagtgctcaggtaccaatggtggtagactaagcaaggtaatctccagaccctgagcaatgtgcttacatactggagggggctgagcttggatgagcagacccgtcctcaggttccctgattgtttgtgcaggcactggctgtggtcaacaggggtggcatgatccccagactaccagtggaatggtcaggtgagggctccagccatcatgttgcagccctgctactggggaaggtgggttgctttctgttggagcagctgtaggcaggcaactggtaactgggcaggtgcactttgctagggtgttgaccctggcagcagtagcccacagtacagattctggggtctgtgaagtttgtatttagggcatatgaaaatgcctagttaccccactgctagggagggtggggtccggctagtaccttgtgttttccttcagggctgttgatttgggagataacttactctttttggggtgtgtgtgtgtgtgtgtctgtgtatgtgtgtatgtttcacattttttagggttagcctgcatccaaagagagtttattctttacaatagtgaatcttttcatttgtgaacacagtgtatctatttaagacttaagtttccatgtttggtgtattgtagttttcaccgtatatgctctgaacatttttgttatatttcttcttcatttttttctactttttattgtcttaaaatactgttcaaatcaggatctggagtatcctgggttatacaaacctatatataagtaaatatacattttttatcgtagtttgctttattgcacttagcagatgctgaatgtttttaaataaatttgaggttttatgataggtgaaatgacatgcacctgtaatcccagttactcgggaggttgaggtgagaggattgcttgaggccaggagtttgagaccagcctgaacaatatagcaagaccccatgtctaaaataaatttaaaaaagaaacattagccgggtcatggtaacatgcacctgtagtcccagatgcttgggaggccatggtgggaggattgcttgagcctaggagttggaggctacagggagctatgatcttaccactatactccagcctgggtgatagagcaagaccctatctcttaaaaaaaagcaaaaaaaaaaaaaaaaaaaaaaaaaaaggcgggggcagggaaggcatgggatttgtgacaactttgcatctattaagtctgtcggtttcatttttccatctgcacgtggaaaaatattttcatgggtctgttacatttcaattatcacgatatttcaaacttttattattattactattacatctcttatggtgatgtgtcatcagtgatctttgatgttagcattgtaattgttttgggcaccagaagccacacccgtataagaaggcaaacttaatccagaacactatgtgtgttctgactgctccactaaccagccattcccctgtctctttccctcttcttgaacctccggacctccctattccttgagacacaataatattgaaattaatccaattaataatcctatagttgcctgtatgttttcaagtgaaaggaatagtcacacatctctaacttgaaatcagaaagctagcttagcgaggaaggcatgtcaaagccaagacagagcacaaagctaggcctgtagcaccacacagttagacaagttgttattgccaaggaacagcttttgaaggaaattaaaagtgctactccagtaaacacagggatgataagaaagtgaaacgttgttattgctgatatggagaagccttatggacaggccaactctcttgttagggactacagtaactggtgactttttgttgaagtcattgctcattgaccattccataaatcctagggcccctaagaattattttaaatctactttgcaggtgctctgtaaatggaacaacaaagcctggatgacaacacatctgtttatagtaggtttttctaaatattttaagcccactgttgagatgtactactcagagaaaaagattcctttcaaagtattacttctcattgacagtgcatctggtcacccaagagctctcaaggagattaatattttcatgcctgctagtacaattttcattctgcagcccatagatcaaggaataattttgattttcaagtcttattatttaagaaatacattttgtaaagctatagctgccagagatagtgattcctctgatggatctgagcaaagtaaactgaaaaccttttgtaaaggattcagtattctagatgccattaagaacattcatgattcatgggaggaggtcataatatcaacattgaggtgtttaagactttcaagggggaagtcattgcagatgtggtagatatatcaagagatttgtaatcaaaactagagcttgaagatgtgagagaactgctgtaatctcatggttgaacttgaatggatgaggcattgtttcttatggatgggcaaagaacatggttttttgaaatagaactgaatactacttaaccgttggtgataatgcaaccttagcttgtgagaggattgactccagtttcaaaagaggttcagctgtgggtaaagtggccaacaatattgcatgccctagggaaatctttgatgaaaggaagaattaatagatgtgacaaacttttgttgtcttattttaagaaattgtcacaaacaccccaccttgagctaccaccaccctgagcagtcagcagccaaaaacgttgaggcaaggcactttatcggcaaaaagatactacaactctctgaaagctcagatgattgttaccgttttttggcagtaagaacatttttaagttaaagtgtgtacattgtttttgatttttattttttgagactgggtcttgctctgtcacgtaggctgcagtgcagtggtgtgatcatggctcattgcagcctcaacctccctggctgaagcaaccctcccattttagcctcccgagtctctgggaccataggcacatgccaccatgcctggctaatttttttcattttttgtagagacaaggtcttactgtgttgcctaagctggtcttgaactcctgagtttaagtgatcctcccacctgtgtctcccaaagtggtgggattacaggcaaggaggtacccttaacgatgggttttattagaaatagccagctgttttgttggcttcttccttgacttggatttcttccttgacttggtatggatagttaactagaaacagatgttaactccttgaccagtgcatttctctttcctcattctaatagataagctttaatgaatatctttagtggatattctaatagataagctttttttttttttttaaagaagcttcctagtgggcagcagtataaacaccaccaaatcaaacttaaccttttaccaggttgcttttattttttaaagaccatgattgagtctaagagtcaggagatttttaatgttaattaaaaactttatatgtatgcagcactgtagtgagcactaaaaataaatgaaagaacagttctaccttaagtgagtttacatgcataatttaaagatacttttattacacttaaaaatataggacggtatttgcttatatactaatacagtgtaagctataaaaaaagtaattgcagtagaaattcaaagctaagttggagttgaagttgggggatgtaaacatcatggaagaacttgagctaggccaaaagagcaaccatgattcaaataagtggaaatggaaactcttcaggtgtaagggagcagaagatgggtggcagaattaggataaaaatataagtgatgagaagactgcttccagcgcaaaagaatgaaagtaggggagcgaagggttgaatgattgaatgtcctatgagcatagagtcagcttcagttttccaaattataacatccttgtcttgttcccatcttaaaggaaatgcttttgattttttactgttgtgtatgatgttagcagtgggtttttcatatagacctttttatatttagatattttcatcctgttcctagtttgttgcatgtttttaatcatgaaaagccatggaatttggtcagatgctttttctgcatcattaaagatgatttttttcctttattctgttaatgtatattacattaattgaacgtcatatgttgagccatctttgtaccattgactacctttgtaagtaatgttttattagcataaagtcaagctcaattgtttacatattgtctgtggttgtctctgtctgtgacagagacagaaggaaacaattatgacagaaaccatctggtttgcaaaatatgaagtatttactatttactctcttctgtgtgtgtgtgacggagttttgctcttatcacccaggctggtgtgcagtggcctgatcttggctcactgcaacctccgcctcctggattcaagccattctcctgcctcagcttcctgagtagctgggactacaggcacccgccaccacacccagctaatttttgtatttttggtagagatggtgtttcactctgtggccaggatggtctcgaactcctgacctcaggtgatccacccgccttagcttcccaaagtgctggaattacaggcatgagccatcgcgtatggctactatttactctttaaaaacattttctaacctctccttctagagtcatcagtacagacatcattatttagtgtacatttagaagataatgggctaatctttactgatcaacactctgtaaattgctttacttgatatagttatggtttatctccctgtcataactaaggggtataatctgattaagggaagttaaatgatggttttatgaaaaatgttaagttaaagaatgaatttgttaatgtcctttctaattcaagttcatggcttatattttgaaatattgttatactcattaaccaacctcttttcttctccccccttcacccatcctagtctctgataaccatcattctaccctctacctccatgagatccactttttgtttgttttttgaatagacagagtctcattctgtcacctgggctgcagtgcagtggtgcgatcatagctcactgtagctatcatagctcactgtagcctcaaattcctgggctcaagtgatcctcctgtcttagcttcctgagtagctgggactaaaggcatgtgccaccatgtccagctaagttttttacttttctcttttgtgagagtcagagtctcactatgttgccaaggctgatcttgaagtcctgggctcaagtgatcctcccatctcctcctcccaaagtgctggcattacaggcatgagccaccatgctgggtcaagatccatgtttttgactcccacatatgagtgtgaacatgtgatatctgtcttttgtacctggcttacttcatataacataatcacctccagttctattcatactgctgcaaaagacaagatttcattcttttttatggcctaattgtattctattgtgtatatataccacattttctttacccattcatatgttgacagatacttaggttgattccattatcgtggctcttaggaatagtgttgcaataaacactgatgtgcagctgtctcttcaatataccttcctttcttttggacatttacccagcagtgggattaccagatcctatgatagatctacttatagtgttttgaggaacctccatactgttttccatactggaggtactaatttacattcccaccaacagtgtactagagttcccctttctgcttcctacaattagatagaaggagtaagtgctagtgttcgatagcacagtatggtaaccatagttagcaataatttattgtatttttcaaaatagctagaagaggattggaaatgtttctaacacaaatgataaatatttgaggtgatggatattctaattaccctgatttgatcattacacattgtgtgcatgtatcacgatatcatatgtaccccataaatatgtacaattattatgcattagtaaaaaaagatataccactcttctattttgctaattgaattttgtgtttttgttttcataggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcaggacaattgcttgaagccaggagttggagatcagcctgggcaaaaaagcgagaccccatctctaccaaaaaaaaaaaaaaaaaatagctggatgtggtggcacatacctgtggtcccagctacttgggaggctgaggtgggaggatcacgtgagcccaagaatccaagtcaatgtgagttactgtcacactgctgcactccagcttgagtaacagagtgagaccccatctcttaacaaaaaaaaaaagaataaatgaaaatttaagactaagaattaaatagaagtttagattcatcttactgatttataaattaatatttttgaagagtctctgatgaatctggcagagattttaaaacactgccttcattttgttaaaacaactttaggtgtctctttgttagtattctgtcagcgtatgtagttaatgaataagtttattctatcaaattaaaatataaattggattaaagggacctgagagatagttgactgtatgccacgtggaacaactttgctgaatgaaactttgttaagtgggagatggaacatactttgtattaaaacatttaataacgagtaattcttcttggtttgttaatcagtaaatcattgtgggtgatagatgtttaatgtgtaattattcaggtaatggattaaattacttatcaggacatgtttcatttaagaaaatataataattttcagtaaattctctggtactttgaagagttttatttaagaaaagaaacaggaagtaaacaaggtcattaaattgtattaggaaaagagccacattcatttaactattgttattgctgttttctggcagaacatctagcatataacaaatttgcaatatttgtaaagttttcttcttatgttactatcaaagaaatattttaaaagctgctgaaacattattgcaggtatttgatataactaatgagttagggtagttcctttcaattttttaagcctgcaaattaactaattacaaggatagcttctgcttgctaataattttaatgcatataacttttctattttagttaatcctgatgcttttctgtatagaatagaaatttaatagatctgtttatttgattattcttttttaagaagtcagtggagatatgaataaaaagacaggataggaagggagggaagagagtgaatggaatcagtggcatttttaaaaacaaaatataatattgaaagatgaaaataatatctgtctgtgacctgcagtttcaatagaaaattttgcatagcaaactaaagaagataattttatccatagtaggttttaaaaaatatttaatgagtatgttgaattgttcatataaaaagtttaaaccattttaaacttttacagaccttaacccaaaagcatgattttaattttatagaccttaacccaaaaactggatacaatttatgagaaattatgaataattagatgtataggtgaattttatatgagaattctcaaaagcacgaagcagtagcatcaataatatgaaaaactatacatcagtatcagagttaaaaaattaataaagctttagaaaaatctttgcctttttgtttttttgagatggagtctcactctgttgcccaggctggagtgcagtggcatgatctcggctcactgcaagctctgcctcccgggttcacgcagttctcctgcctcagcctccggagtagctgggactacaggcgcctgccaccacgcccggttaatttttttgtattttcagtagagactgggtttcaccgtgttagccaggatggtctcgatctcctgacctcgtgatccacccgcctcggccctccaaagtgctgggattacaggtctgagccaccgtgcccagccaatttttgccctttcttaaaggcaattaagattgagatgaatttctgttgtattcataaaatactgattttagagagaatttttattggaaaatactgtttaatgataattttgtcataattttacaaagttgtttctgttgaaaacctcttagccttgaaattaggcctacttaaacaatcaccaaccttttctttttaactttatcatatacaaaagaaaaagtgatgaaaaatttggaaaacactgtggtatgaaagtaatagaggattatctttttagtcctattactaagagataactcatatatattatatatatactaatatatataatttttgatatattttcttatgaaacatattgctctggttcctttttttttttgccatactatttattttatttatttagacaagatctcacttttccacacaggctggagtgcagtggtgtgatcacagctcactgcagccttgaactcctgggctcaaaaaagatcctcccaccttggcctccccagtagctaggactacagatgtgtgccactatgcctagctaaatttttttttttgagacggagtcttgctctgtcgcccaggctggagtgcagtggtgcaatctcgtctcactgcaacctctgcctcccgggttcaagcaattctcctgcctcagcctctcgagtagctgggactacaggtgcctgccatcatgcccggctaattttcatatttttagtagagacagggtttttcaacatattggccaggcaggtcttgaactcatgaccttgtgatctgcctgcctcagcctcccaaagtgctgggattacaggcatgagtcaccatgcccggccctctgctaaattttttaataaaaatttttaattgtggtaaaatgtacttaacataaaatttgccattttaactgtttttgagtacacgggtcattggtagtaagtacattcgtgttgtgtgttaccactattgtcatccaaacacagaacattttctgtcttgcaaaactgaaactgtactcattaaagagcagttccttattcccccgtcttcctggcccaccattctactttcggtctctgagtatctcatatgaatgtaattatacagtatttgtccttttgtaacgggctcatttcactgacaatgtcttcagggttcatgcatgttaaaccatgtgtcacaattttcttcctttttattgcaaaataacattccattgtgtttatacaccacgttcttttcatccatttgcccattaatggacagttgtgtcacttccagcttttggctatagggaataatactggtatgaacatggctgtataaatatctgcccaagcctctgtgttcaactatttgggtatatacccaggagtagaattgctggatcagatggtaattgcatttttaattttttgagacactttcatactgttttccaagtggctgcaccatttttcatttccaccagcattgtgtaagggttccagtttctttacatcctcaccaacatttactttcatttttttggtatttactttctcagtaggtgtgaaatggcatgtcattgtggttttgttttatatttttctaatgcttaatgtgatgttgagcatcttttcatgtgcttcttggccatttgtatgtcttttgagaaatatctattcataaagttctttgcctgtttttgaattggatcatttgttttttttggtgttaagttttaggatttctctatgtattcttgatattaatccccttttagatacatgatttggtaacattttctttcattttacaggttgcctttttactgtgttagcagtggcccgtgctgcacaaaagttttaaattttgatgaagcccaacttgtctgtttccgcttgttgcttatgcctttgttgttgtattaaaaaaaaattgccaaatccatgtcatgaagcttttccccttatgttttcttctaaaagttgtatagttttagatcacaaattttggtgaattaattgattttaagtttggaatatcatgtaagggtccagcttttttttacgtgtagatgtccactttttccagcaccatttgttggaaagactgcctttgccccagtgaatggtcttgacactgttacagaaaatattttgactgtatatgcaagggtttgtttctgggctttctattccattccattggtctgtatgttcttatgctgataccagctcactgttttgattactgttgctttgtagtacattgtgaaatcaggaaatgtttttccgtcaactttcttctttctcaggatagttttggttattcagggtcccttgagattctgtatgaatttcaggagagatttttctttttctccagaaaaaggtcacttggattttgatagggattgaattgaatctgtagatggatctgggtggtagacatcttaatattaagggctgggtgctgtatcccagctctttgggaggctaaggcgagaggattgcttgaggccaggagctcaacaccaggctgaacaatgcagcgagcccccttctctgcaaaaaaaataaaataaaataagccgagtgtggtggctcacgcctatagtctcagctacttgagaggctaagtctgaaggattgcataagcccaggagttcatggctgcagtgagccatgattgtgtcattgcactcaagcctgggtgacagagtgagaccctgtctctaaaactacacacacacacacacacacacacacacgtgtaaatattaagtcttctagtctttgaacaggggtgtctttttacttatgttttctttaattttgctcagttatgttttgtagttttgtttatttcatcttctaggtaatttattcttttttgatgctcttgcaaatggaattatttgttaatttcattttcaaattattcattattgttatatagaaactagtcagcgtgagcctgtagtcctagctacttgggaagctgaggtgggaggatcccttgagcccagaaattcaaggctgcagtgagctatgattgcaccagggcactccagcctgggtgacaaaccaagaccttgcctcaaaaaaaaaaaaaaaaaaaaaaaagccaatttttatgtgttgatttcatatcctgttgcttaggtaatatcctagtcaatggtgaaagactgaaagcttttcctctaagatcaagaataagacaagggatccctgcttttgccatgtccactccacatagtatttgaagttatagtccagaaattagactagaaaaagacaaatagcatttaaattggaaagaaagaagtaaaattgtgtctgttcacagatgatataatcttatacttagaaaaccataaagacttcacaacaaagcctactggaactaataaatgaatttggcaaattagcaagtacaaaatctctgccttcttttaaacatagttttagctaacactgcattaaaattgtagatcctgcttttttgcctaacatctatcctctacatttctcttcatgagtagtaatttaggatcatttttaatggctgcataatatttaatcttataatgacccatttccttaatgtttgacattgtagtttccagttctagggagcattataagcaactgggataaataccattgcaagcctttgtctgcatctctgattttttaaaatgtatattcatagtagtagaattaataatcacagggtatgaacttgaaagccacaaaaatctatctcctgacactcttcacaaattgtgtaaaggttgtactgactgccattgtcctcagtcagtgttggggtgtttttatctcactcatcacacccttgtaagcattaattatttatttgcagtttatcttgttttaaaacacaaatatttggccaaaacaggaggagttttacatcctaaggggatgcagcattgaatgttactctttctctgctaattggatatttgaaaataatatttcgttgtttcaatttgcattcctttaatagggtgaatttttttcatgtttatgagcaacttgtcttcaccacggggtggaagtacgcgtcgnnnnnnnnnnnnnnnnnnnntttatgagcaacttgtatttttagtgaattgttatttagtacttattagggttttgagttttttatatttgttatgagctttctttatattattacagatattataacctttttgtcatatttcatagtttgcttagccagttgtttgatagtaagtctttttgaattgtatgtttattttaaagtctatgcaacgggatattgtcattaattccagtagtcaggttatgtgtgcttgccttccttccttttttcttttgttttaggagattgtaaaaattaataaacaagtgaagtgagaatgcttgtttgtaataattaagaaaatagtcaatttaagtttcataagcattttgcaaacatttatatacagttgatatgactgagattttattgtttccttttttgttcattaaaatttggcttctttaaggatgtctataaacagcaattataaagttaagcgttttaaaattcctacagcgtaatgaaatactatatctacagatttgagaaatttgagggatctgtatatgagatggcaatagaatgaaacagtagaaactaatactttgtctttaattttctacaaatttaatgtttctatttctgtgcacatgatacttgctttatgttcttttgtatttaaacatgtttgtatttattatcttctttctagttgtttcactcctcgtgtggtacttgtttaatattacatatcagttacgttatcttgtctacctcttatacctagaaattagtggaaactggcagtgtacctgctgtttcttgagatcatgacaagacaaaaacaaatcctgttgtctcattaacatattttaaagtatattttttaaaacttaacataattgcatcttcagcaaaatatgaatagtataatacccaggctccttctctggaattgtctggttcctctttctttctaggatatcagtagcaaaacatttatgggagcaccacatgtaagatgctgaagtggtgtctttttttgcttggtcctgtacaatcagagtaccacttgaggccattctaatgctgtaggctgaggtaacttgcgtcttcatgtaagttacttaatagattgttaaattttatttactttttaataaagtaaaatacttgtgaaagcacatttatcggcaccagggaaagaaagtgttggcattcataattgaaatcaacgaatcacctacctaactgggttagggccctggctccatctcctttaggaaaaccttctgtggggagtggggcttcgaccctaacccaggtgggctgtaacactgctgtgttttctaaggggcagagttttctactacttttccgctggcccagccttccagatcaccccaaccagtgctcctatataaccatcctgtgctcctatagaactttgttttgtacctctgttttaacaatcagcacattctgctttgtattatacctatttgtttgcatgtctgtcttcccttaatagattgtaagttctttgaggacaggagtcatgtcttagtcatctatgtatggttccttggagtctagcacagtgctttacccatctcagaaagtaaattcttattttaaagtgatgaatgtgctgcaacccagctagtgaaaaagaaccctactgggagttatcacaagttttctgactattaacatatgataatatcaaaggacaggaaagcagaatcacccaattgtggtaaaactgtgagttaccaattttaaacatgtcaatatataataaaaaatactaaaaagcttataatgccaattctcatcaggtacaaatttgattcctgaaatcaccaaggggaaaaatgtaaaattacctgaaatgcgttattttaaagatgttaaaggaagaaacagaagtcctcacaattgacttaaatattcaaatctttgataatttacttgaatttctgaattgagttttaggaaactcagactactttttctcaatgtagcttttccttcatagataggcaattctggttcaaccaggaattgtgatgacatcataaacacgtaaactcttagcaatttatttattttaaaatattctcttagagtgctttttacttactatctgttccaaaagaaaccccctcaaaggagaatagagttcactgctctttgggacaagattacctttatatccagcagttatcaaagttggtttagattatggcctcaagcaaattttactaaaatgtgaaaatatgccaccttccaagtcagaaataaactttggagtatgttcatttaaagagtttttacatatttataattgaatttccacaattagaataaacagttgcatgtctttttgtactttgttaaataatgaaatggaagtaatgacaatataacttcaggattgttatttctctacaaggtaaagcactttaagagatcaaattatacataataaaatattaagctttttaaatgataaactctaatactggcatgtattgcaatgaacgagttcacacactcatatcttgtggattataaaatgacattattcttttggaaagtattatgttataagaaccataagaagttcatactctttgattcattaattctagtcttaggaaacgatgcttgaaaaacagtttttaaaaagtgtattcagtttagctaatgtttgtcacgtacctcatacgaattagacactgtggtgggagctgcagattaaaaaaatgaaaggtttaatgttattagaagaaagatgtttattgcagtcttattaaagaggaaaagaaaaatggaacaaccttgatgttcaacaatttgtgaatgctgttaaattaatattttggcatattatgcagctttaaaagtgataattgtacatactttaggaaaatgtagagaaaatttaagtaaaaaaaattaattacatcagcactagaattatgtatttaaaaagtcttatagaccagggacagtggctcatgcctataatcccagcactttgggaggttgaggcgggagaattgcttgagtccaggagttcaagaccagccagggcagcatagctataccctcatccctaccaaaaaaaaaaaaaaattagcctattgtagtggcgcaagccttgtagtcccagctactcaggaggttgaggtgggaggattgcttgactccaggagtacaaggctatggtgagctatgattatgccattgcactccagcctgggcaatggagcaagaccctgtctcaacggaaaatatatatattataaagtaatggagatcattattttatattatggcagaattttgcctgaccaaaattgtcttttccctaaaaaacaactattatttcctagcaaattggaaatttcatataatgatgttattcagtattttatattttggaggtagtcttcttcaaatgagttattttagtaaacttgttttatgtttctgttaatatactttgataggtattatttgtgttttgctattgcagcatttaaaaaactgtccttaatatacaaagaattaacacttaataaaaatgacagcttaaaccataacaaagtaaaatataatgaagattatttaaggcttgttttaagtctgtctgaatttcttgtttacttctagatttgcatggcttgaacgttagaattggggggaaaatagcagttatcaaggaaggtagcataatatgttaaggacatagactttgtggcatatttcttggttcaaatcctgattcttccatttactgttaatgtcatttatactctgtatgtctcactgtgttcataatagtaatatctaccacacagagtagtgaagatcaagcaagacagtatataaataaaa

SEQ ID NO: 1625 - DNA, 1188 bp, Homo sapiens
tagcttaaacatgtaattagtatcaccacaaatgagaagaatgaaaggatcacattttccccctcgttttcccttgaagtcatgaacggttggttctgctgtgactttggggcttagttttcagtagaagtgttgtcctgctctgctgctgttactgcgggactgctaattcaggctaactcaggcggcgggcgctgtgtgctctgaacatcaaaccgcgggtgaggcgtcaacccaggagtttattttgtgatcagagtggaaccactacacttcactttcccctcacctccacctctgagggagcaacgaatacaaaggtagacccccaaaagctttgaatagctgtcgcctactttcccgcggccctcttcattttttcgtctcccgctgccgccgccgccgccgcctctggatctggacggacccagtggccgctgccgcctccgcagggccgggcactactttccgtctgcggtggttccgccgaccctcccgcggctgctgccccgcccgcgccggcggaaggagacgcgctgcgcgccgccgctgcccggggagggagacggagcagtactggccgcggcgcggtggcggcggctgggctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattggtaag

SEQ ID NO: 1626 - protein, 296 aa, Homo sapiens
  VARIANT (1)...(296): Xaa = Any Amino Acid
GSNEYKGRPPKALNSCRLLSRGPLHFFVSRCRRRRRLWIWTDPVAAAASAGPGTTFRLRWFRRPSRGCCPARAGGRRRAARRRCPGRETEQYWPRRGGGGWAASGSSTAALGFVSVFLCGAAAQGCESGSPKECLRGGPEVAVSGAERPVRPESALFRVRCCVPVRSPQHERPEAAAASAATAMAVETRAELVGKRFLCVAVGDEARSERWESGRGWRSWRAGVIRAVSHRDSRNPDLAVYVEFDDLEWDKREWVKVYEDFSTFLVEYHLIWAKRNDPSQTQGSKSKQIQWPALVX

SEQ ID NO: 1627 - DNA, 374849 bp, Mus musculus
  misc_feature (1)...(374849): n = A,T,C or G
tttttataactgtctcgtcattatatctgggaatcagataactgcttttataattcatagatggagagctactttcttccaagttccgtgcataacttctttggattatttaaatgaggtttgatttgaggctgaggccgatgctggaatggttagatgtgaaaaagttggcatgagttgaatgtagtttgccaacgagaaggagatcaaagaacagattgtttaatcttgaagcaatgattcctcagattcatgtgttgtagtctgtcaaaatgtggatctttagtatcccccaaattctgtataagtaaaacttggttcctagcatgctgctgccgggaggtggtgagtctttgaagagaacttagtgagaggttcccaggtcagtgggattgtgttctcaaaggagcctagggatccagattgcttcttatgatttttattatctaatcacaaggtgaatgatttttccagtacatattcatgctatgacataatcctgcacaattttaaagcaatgggtctaaggactaacatccaatgaacatctttaaacttgtaattccaaatcaattttctatgctgtttaaattacttgagttttagtgtttttatttattatctagtaaatgttctgctgtcgtttgttagagtagattaaaaataagaccatacccctaactctcaaagtggcctactttagaggaaatatcttcacagagatgttaaaattgaaatgaagacacaatggttggccttaatgtaatgtgactgatgtccttataacaataggtcacttggcagtagacatgcatagaaggacaataggaagagacagatggagaatctatacaccaaagagacctaaaacatatttcctcaaaatctacagaaggaaccaaccctttaacacctgtacttggacttttgacttccagaactgtaaaagaatgaacttctgttggctaagtttttgttaaagtttgcataaggctatgaatttgaaggagggtggggaggggtatatgtgagggcttggaggatgaaaagggaaaggggaaatgttgtaattaaaatataatctcaggtatggagagggtcaagtaggttgtcttattttgggttttattgctatgaggagacaaggtgatcatgatgactgttataaaggaacacataattgcggctggcttacagtttcagaggtttagtacattatcataatggtgggaagcatggcagtctccaggctgacatgctgttagagatggatctgagagttctacagcttaatctgaaggcaacaagggagagactatatatctcattgagcatagtttgagcataaatattctcaaagcctgcctctatagtgacacaaggactccaacaaggccatacctactacaataaggccacacctcctaacagggcctctccctttgggccaacattctagcacatgagtgcatgggggccgtttctatttaaaccaccacgtagtcatgttccttttggagctcatgtatagagctttatggcaccactcatcagcagagacagggtacctttgcctataatagtagtccaggctatcttttgtattctccatggttgccctagtaaacaactatgtactacttgcccattgctcgtggatagccaatgtgtgtgtgtgtgtgtgtgtgtgtgtgtgatttaaatattatatttattacttttgttgtgtgtatctgcacaaacttttgtgtttgcaagtgtgtgtgttgcagtgtaggtgcggctgaccaagaacaattttcaggaattgattctctctttttaccatgtcgaggtaagatctctcttgttttttttgcagttttctccattggagtgatgctggttgtgtgagccacactctagggcaattcccaggagcaattgaccaacacaaagcaaactatatgggttttgtttgtgtttagaattccttttttgccttactttctttgtttgttttaaattttgagggttttgtttgtttttgtgtaagaagaataaatgaaatcagtttggcagggagaaggggagagtgtgggagttgagagaaaggaaagaatggatcacaatatttcaaataaaaatttaaaaatgaggaaaaaaatccttaagttctggaacagaatgtatgtacaagctaaatggcagctctgaatagagatctagggtcagatagcagagaaaaacaaatcatactcataatttgaaaatgaggaaaagtcttgagtacttaacaacagaagtcctatagataacaggtaagcacaaagatagggataaggagtagctattgagatgtgtgaactcagtgtagcatttagaacaagtgttcatctgctagagtcactaaatcaagtgcatactgacaggaaatgctaatgagcatgtggagcagcggaatgctcatacacagcccaggggaacacaaaaggataggtttattctgcaaaacaggttgacattttgttatatctatatatacttgccataggaccaaagacccccactctgtatatgctgcgtgtttaccatacagcatcaaatgcaatgttcttacagaacttggatatgcatctttgtagaaattctattcataattgcctcaaactaaaaagagcccaaatatctttcagagacaaaaagtaaatgaagtatggtgcattggggcaatggagtcctattaggaagtgaaaatgaacggattattaataaacgttggctccattttgaagactctatggtctcgacggtcaaatacgattccatttgtataacattgttgaaaagataaaaccttaatgacagataccagatcagagatgccaggggttagagatgtgtgggaaatttgatcataaagctgtaggatgaagcagttgatgagtgatagactattttagatcctgactggaccaaccacatgaatgtagactctcttgaaatctttgcgataaggctcagcatgctcatgtataaaagcctttcatttttatatctgttaatatacttttataataggaagtcaaatgggaattacttctaaattctaagatcccatagtcctagtaaataagcttccattttctttattattaagtagcagacatcattgttgtagattttagagaatttttcaacatgagcaagcttacaataacagtcttagtgattaagcttatcttgactttcagtgaggctgtttcagtgttactccctattgtttcctcttctgtttttgtttctggtgctggggaattaaatgccgggccttatatattttaggcaaggcctctttgactgaggtaaaaccctaggccttaaatcctcatttgttaatcattttcttgatatatatccttgtattcttttaaagttcactaaaccttgatgaggaaaatgttgttttgtgaaatagcttgaaaacataaacaaatgtctctataaatactatccttctcctaagagaaatgcactaggttggatgctattgtgtttccatctgtgctcggctcttatgttgatctctgtggtatcactgtgagatggactttctttctttctttccttctttctttctttctttctttctttctttctttctttctttctctctttctgtctctcggtctctcggtctctcggtctctctgtctctctgtctctgtctgtctctgtctctgtctctgtgtctctctctctctctctctctctctctctctctctctctttctttctttctttctttctttctttaatgtatgtgtgctctgctgcatatataactgcctgcctgaagagggcatcagtttccctcgatagatggttgtgagccaccatgtggttgctgggaattgaactcaggaactctggaaaaacagtcagtgctcttaaccaccgagccatctcaccagtccgagatggaatcttaagaggtaattactgtacctaacctctttaactatagagacatcgaggctgtagaactttttcttacctcatcacagaatatggatgacataagagcataagcaaaaggtaaaagctaattttttttaaaaaggccatcccaaatatgcctagcactgatgtgagatcacttttacagaatgtttgctggaaggttggaacgatctttgggaactggagtaccctctctttatgcagctgtcaaatacctaccctgaaaacaagttctctctttgtactttgggtatctgactcataactgctgtcacttggtggtacagtgacttaggaaacaaaagacacttcctcagtatttttcttctatgttatctaccatcacagaaggcacctagtgcaagaggctcctaaatctgtcactccagaaagcatgggatagagagcacttgccaagtctgtaccaccaggcaggcccccagcagaggctacagcacattgggattattcatttacactgaagtgagaatgtgaataacaataattaaaaaaattatagcaactgtctaggaaggactataggtaccaaaagacaaaatccaacttaggcaaaagaaatatgtgggtagtacataactccctcagtgttgctcataaatcctgactctacttttactatattaggaattttctaaccctcagtaacaaaaaggcaactaaaggaattcctaggactaactgattattgccagaatcatactctaaacaatccattaattgttcaaccactatctaagaagatggagcaaggtcaagcagatgccacctgactaggcctggtgtgtgtctttgagagaattatcacatgaggaaggacacaagacttgtggctcacaggttaaataaagtagactttaaaaaagtatacgttttctaagttggatataagaatttgagaaaaggaaggagaccgagtttgtgatatggtctctggtaggttacccacaatctactggatggccctacacccatgggaagtgatcaacagcacaagcatgcattggacttggtggttataaaacaaaaaagaaagaacaaggtgttgggaggggtgaagggtggtgttgggaacagttggggctgatgaagaaatatgataaaaattcattatattattgtaggaaattctcaatggattaataacaatttcacacttttaaacaataaaaatcattaacacgaaccctctcaagttcaagagcagtagtttctcccattttggtttgactgcccctctctcattttacttctcactggaaagataaatcatttcctcagtcaattagtttaggaaatacttgccatgtggtaggcattcttcccagagtgggattataggggtggaaaaaataaagcagtttccttcataaaaggtaaagtctaggaagattagcaagcaaatagtatattacttactgacaaagagaaggaagcagagtattgtagccattgtcatgtcaacaggacaactgagaagtctttagtcatatgccatgtagatagatactgggaggcaaggaaggaaatcatgtaggtacttcttgcacaccatgtttaatgaacaaagagaccacgtttctggagcagagtgaggccagagggcagaatccagagaggaggccagagaggagctgcagatagcagagcaggggtgcactggggtccctgtaggcttctgtggcttttcttcttggctatgagaagctactggagcatgttgaatgggcagttggttttttcataatacacccccaggaatcacatagttgtcccagtatctgtgatgcaagctcccatcttactcctcagggtgcaggttacacaggtgaaaactgatcctcactaatgatgagtaattaaatatgagcctatggataaaaaaaaagccttaacattatcctatggtcactatggtcacttcagagttaagaagtttagtacttaagaagataaaattcctgtaatatgacccactctgggatcaaggattccatcttctattcttttaggtgtatttataccaatctcttcaggagcactgaaacagtatactcatcaatgcaatagagtatgaagacctgggtttacctacttgaccattccttaattctacaatttttgtaaatggacaaaacaatgtatgttcagtgaacaggtattatgcactatctattgaacattctagaaatgcaggataataagcctcacaatggtatttagagcccagtacattacatctgtatcttgtttggtactgaatatcaaacttagggccgtgagcatgcaaagcaaggtctttaccccatgagctacacctccagtacttcccccacttagacttcatttagaaaagtttatagtatagcacaatgaaactgagttccagagatgatggatgctaaaggtctcgatgtcatcagtttatcatgaaatggaggcatgaaactgttcataagatggaatgaacacttcagtggaaagggatgcttcctgtggcgccattccagtggctgtttctttatatgtatcagttaattgtactttccctagatgaatagaaacagttttttctattctgtcctgcattatgtttctttcaatcatgctagaatgattctccagctccatttcttagcattgaaactgtaatttgtatcaatactgttttgtaaaagcatccccactgtttgttacttggaagtggctatagtcctttgttggcacaattcctttcattacctcgccttggactgaagaaaaggaattgaagtgtcttctgctactcagatggcatattgttttggcaagaaggagctagatagtgaaatagataaagacttaattatgaatttgactgttaatagtgttagctttaactacactcttttaaaaaataaaattcttgtgaatatgctcttttgtctcagatcttcaatttcatattcatagtaaattatacagctgttattttgaattcagtgttgtgctaagacaaagccacaggaagttcaattttatgtctttaaaattgtttagttttacaaaagtcagttgaaaatgatactcagagaaatttaattcaatggcgactttggaagttcaaattttacactggtatcaatagaaaagactaattattttatataaaaccatgctattaaaaaaggtgatgggtttttaaaacatttaaaactgttaatgtttgaattataaacaccattttattggtaataaataattggcctttctttacagcttagaaaaaaactgaaatgttactaatatatccccaatatttataagaaataattgtcttttactaagttattttattctttactctatttctctgagagcatggtgataccagagatttatttatctaatactgagatatactatagatggacttttcaagaattcacaagggtatatatttataaactgatgaagtgggactactaatttctccttttgaggtgccaaaggaattacggagataggaaggttcccttttggtttactggatgtttcttaagcacaggatgccagtatttgaacctttaacacttcccacaaggcttggtcgccagctcgtgatgctcctggggcactgaagttcaagggaggaaaactggaccacaggggacatggcctcgagaccccagccctgcttttctctctgtttatttataaacattataagtatgaaaaattcaggctatcggagagtctgattatcttttaaattttgcattctagttaaccttcttggttacccttgtttcctccaggggtaggtagggatatcaggttatatatatagctttgagaccattggcagactgaagacaggtatgtgggatgccatcaagaggtgatataagcagcattctcctatcagaacctcaatttacacttagcgatattagggctacacaatttgccattactttttttttttctgagaagacattcctaaaattcttatttatctcgtcagctttgaaaattaactatgagaaatggctttaatgaatcccacttgctattttatttttgctaataggtcactgtgaatcatgatagaatcatataatctcaggtcccagttttaaaaaaatagtattttgggtaaaagacttgctgcagaatttagcaaatagtgggtagcgttaaccacattttctccatattatcaacattctatcttttcaagatactcaaaatactttcagaccccaagaagctgcactaaggcctgcctagacaaaagcactttataatgaaataaacagtgctaccaggagtcaggaaaccggagtgggagatgtagtgatgacatcagtcaccaggatggatttggatgagtcccttcagtcccctggctctgtttcctggtttgagaaatcattcataaaccaggaacattcagccccatctaagatttcacgactgcacatctgttcaccatgtactttagttagttgtttagatctgcacatctgttcaccgtgctctttagttagttgtttagatcatgatgggttttcagaagtggtacttaaaagtcagtagtttaagttccagtcccttccctaaggtttgcagtgggatgcctttctcctacccagaggcgatgttctgccgttatttagccctctaatcttcagcacatttttagtgtgtgacagacatatagagagatttatacagctggacgaccctacacattagtgtgaaaatgaatgtctgattttcactgaagtcctactgtgcatctttaccttttctgtcattcttgctgattaatcctatcgtactttgccacatttatttgagatcaacctggatccaatgaccatcactgtgaataaatattttacaacatgcaatggacctcattatacttcagtatgcctttaaatatatagaagctgtgctctcatgcccaagaagagaaaaagaaaaaaggaaaaaaaaaggcaaaaagaaaagaaaagccaagcctagccaggttgaagacattccttgactccatggcttctcacaagcaatgtagaaacccactctctggtgcacacaggcacaaagatacacaccttgtgcacctctcagcacacacacaaacacatgcacagtacctaacttggggtgcatgttttttctggctcttacttccatttcagattaggggtgctttggccatcagaagaggcattcagtatcaagtggcttatgtgggcagattgcaaacaatgagcctaaagagaacaatgagagtaatgtttattggaataaaaattaggttttgaattccttggggaaatgaaccaaagccaatgttttcctgttaagtgacattttgtttttttaactgatgctgcttgggatcttctaaagaaggaagtggggtgggggtaggggggggggaacttccagcaattcagctctttgattcagaaatggaatctgaaaagctgttttattgaggcttttggcaatccctgacttaatcagttttgactgtgacaaagacgatagcctcacgaatttagtgcaaatccgagcagtggagggtatttttcaggggggagatagcccagttgtttaaagaatcctgggccaatagcgtttgataggcggagttacggcggtgctttgctgagcaagataattctgaatgaagactttaaaagcacatgctggatgggctctggttccgccctttgtgcagacaaaagtgactgggtggccaggctttgcttactgtccgagttaatgcagcttgtttgataaggttttctttaaaaaaaaaaatacatataaaggatttatcaaaagccctcatgaatatttcatgagttgatatattcagctgaatggattcagtgagtctcagtgtgtaacttgcagacaaaccccatccacaaggaggctggtgacagaggaagcactttggcgcattttcagaggcaaaggcagcctgataaagctccttgtgacaggctgtcttgccagtctcccagtatgctcctcttgctctgaagtgctccaggattgaaaccacagcttcccaaattagcctgggaagagtgtgcggacccagcagccttttaacccgcgtcagtgcctttgctatgttcaagactgctgttttggatggtgaatgctagctagcactccatacgagacatgacagcaaaaaattctccaaaagaatttactgcttcggaatctgaggtttgcataaagactttcaaggagcagatgcgcttggaacttgagcttccaaagctaccaggaaacagacctacatctcccaaaatttctccacgcagttcaccaaggaattcaccatgctttttcagaaagttgctggtgaataaaagcatccgacagcggcgtcgcttcacggtggctcatacatggtaagagtggacttaaaggcatcccagtgctaggcagattcttggcttctcagtagtgatttagaaaggttgagaatggaatgtctgagttttgctcggaatgcatagcgcaagtctgagttgaaggggtacagtaggtcagctaagaatacagaagtgtacagtgtgcttaagtatctttgtgctacctgctgtttccagataaaataagcctctgaccgtggagactcttcgaagtgactgcttataaaaatgtcttttggaaaatagggaattgagggaccttttaaaagtaagatttttgtttcatttctgttctatgattttagcagtggggctttgtttttgttttgtttttgtggtacaagaataggtattttcatctcaattctaatctattccttaagataacttataaaagcctcaataaatgtgttgtctcatcatgactatggggcataaccagagtgagctttctccttacaaacttttatctttacattacttaaagggtagggaaactaagttctaacttacaaagtgtcactgacaatcagttgtattatgattccaaaaattttgtatcttttaggtatgccaagtataagaggttagtgtctctgtagaagctgagttgaactccctacctccagcatatattttatttacactggatgtaaaaacacgaggctggcctccttaaagcagtgcagtgaagaagcacaaggagagaaccccaacattaagttactttgacctgaaaagcctgggccacctcaggtttctttgaagggatgtgtctttcaaattaagataaccttccaaattggtatttgcagctcagtcttatttaataggcaacatggcaagaaaagcaggatgtggttttttaaggtaatccccacagcaattttgtgcctacatgctagagtgccagctagcataatcaaccaaggccactggatattcgaaaattaatatgcactgtgttgtttcctcctcaccaggaaaaaaaaaatgtgctcgctctgtgcacaatgtgttgattaatcatagctacccatagaaagatgtagctcactttgacaaatagccaatgttctgccaacatatacttcacatagttagagatgatctattttctcttgcttctgactgtggtgtggtattatttcttggagaactgtttggtcattttgatgaagcgtatgctgttatttcattgtgctcggttgcctgtagaacacacgtggttaggtttttcaaagcctaccaatggtgatagcatttgtagaaagagggtgttcatgtaaaactatgtgctgattggaagcagtcctttctctcattctttgcctctcctccaacacatgtgactttatagttaatctgctgagtggtgtaactgaatacaggaagataagcacgagcacagttctcattaaaggaacatatgtagggaaatatttatttaatgaataaatgtatatgtcttgctaactgaaggactagcaaatcattatattgatatgaaggacttttaattttaggtgtataattttcaaagtctggataatcttcttaaagttctgatattttcactaatgtggaatttttggtactttataatcatgtgacctttcttcttcttagaatagattcttgatgtgatagaagcaccgagctataaatactagtgattttttttcttttcaaaagaatgaagttttagaatgattaaagagtcagttttactcatgcattacacaaattttcttgcaagttgcaaaaagaacaatgtaatgatatgtgaggttacttatgctaataaaatgatcttttagatgagttaaaacaaaagttcccacaattgccaaaaaaagaaacaagacattggcataatgtaattcaatacaggcataaagaagtcattaatcatcagacttctaaaacatctgtaggtacgattgtgttcacactttcctcccagttcacattccttccctttatgtgtctttagtaaagttgattctcaacttgtttgcagctcctgattaaatctccagtgatgtttctttttgttattggatctgttgtaagatgcttaacattttccaagtttattgtcatgaaataggcaaggaaaatagatatgcctcttatgtatttgaatgattttttccccaaatctcaagagcccagtgctgtttcattctctttttgtgtgatgaagcttagcatgcccgccttagttttgccgttttgtcacgatgaaatgtaactagccttttctgattagtgattggcattttctagaccacgcacttaagttagaaattctaagatatagactcagaagtgcctaaaatcatgctattactttatagcagacagtagacttctttcaagaggactggattgttttgattcctgcaacaaaattaaagtacttttcacgagaaagctgagcaatgcagaaggtccaggtcacattctaacctttgctttggttatttgtagatttcatactttgatggactagacatgcagttctggctttggagacctgaactgtgaagttgggcttcacaatagatttaacacacatttgtatagttctgactctggaattattttagaaatatcgaaagaaaagtagatatttgatgtgttgtcattgttaatcatcatgtttacacaaacccaaatctggaagaaatttgaataattatcttcctgctccctcttacccttgggcagaaccatgttgctccatctttgacatatggacatctggcctacttttaaaactgaagagaaaaaattccaataacagcacttaatatacagcactttgccatgtcatattcacagatattagaaaaacattcctctgactcaactggtttaattgttacatagtatatatcctgtttttccctcactggctttttagaaaaatatggtgataatgggctttaatgggaggattctcaagagattctttgttttgtttttacttattcaacatacataaatgaacacctataaattgctatgaagaaaagaaaaacaattcaggctcaacctatatttcccctcttgtactatatcttaagttctttattataatgtccacatattatcttaagttctttatttgaattttttcagggtcacatgttagacatacaaaagacttttaattctctcttttcttctaagtatttctactccattattcattatctgactccgatccataccccaaacttccagtctttgaattatgactccccaaatggataacaaccttactgctgagtggtgtggtatggtgtggtgtggtgtgtgtgtataagtattagggactacacggccttgcttggtacagaatatgacagtatcattctcagggtagtggattatttatccttgacctcaaatccaaggtaacattttctgaagcacagcattcgtgtgtaaagtatctgactggaaaacctgtttattgttgcctggcacttgcagcaagttgtctagcttttttttttttttaaaccatctcttccagactggagccctttctcagtcatcagttttccttcaggaagtattgtgttggtgctggtctgataaatcctggctacttcctaaaacactgccttctaggatagaaaatgtatcagtgggaaccaccaccaatctatccatgcttacaatcaaaagcaatgtgcttttagttattgaatactttgggagaaagcttgtatttttcctctcccaatttggttttccattattgaaagacagatttcttattgccttagttgaggtttctatcattgtgacgaacaccatgactccaaaatatcatgttcacacaatctcaaatctggaaataatttgaattatcttatttacttcatctttcaactcttgggacattctgcagcactcagggacataaaggcaggaattggaaggtaggagctaatgccatcgaaaagagctgcctactggcttcccccatggcttacttggtcttacttggtctgttttcttttataacccaggaccacttgcccagggctgatactacccacaatgggctgacacctcccacatcaatcattaaccaaaaaaatgccccacagacttgcctgtgagccagtctagtggggacatttcattaaccacagttctttcttcccaaaaggctctgtaaagttgcccaaataatagctagaacactaattttaaccaatgtttatgaaatgtgtaattcatgtctaatacataagtaaaagagtaatcaaagccaaggtttacactctaatatcctttctatagaatgcagtttagactactttctcaaactgatccactgaatctgtgtttcattcaatttggttgtttcctagtaatactgaaaacatttgagagatgtctaattttgaatatatttgttgattgaagagaaatagtcaccctgtgccctaatctgagtattagaagacaccaacttagaagaaatttttacctttaaaatactcattgatgtgtttattaaaaaataaataaagaaagaagtataaggtatgnnnnnnnnnnnnnnnnnnnnccacacaaaaggtatagtatagaatagagtttattcagggcatggggaatgggtgttaagagggtagtagaggcagagaaaggcagagagcaggagagagtagagaagtagaggctggccattgccatgagcacatggaagatggagagaggggaaagggaagagcccaagaaggcaagagagaagaaagcaggatgcaagagtaggagaagaaggaggggagcagccccttttatagtaggtcaggcctaccttgctgttgctaggtaactgtggggaagagcatacctgactgttgccaggtaactgtggggtggagtttagacagaatgctaacactcatatagtagctggaagatgaacatatatatcaataagtaatcagtggaatgtaaaaatgccacagaagtatactgttcattgtcatgggaatcagtaaaaatcatgccatgtattaagagttcatgtacagaagagatgccattaaagtgggagtcttaaaagtgaataggcatttttctggcaaagaataagcagaaaaagcattttattgggccaagaaaagaataataaggtaacaaatcgtgaagtacttgtatatgagggagcacagtaaagaaactgctgatgagaccatgacatggtattattaagttttttattgtacatgggagagagaaaatatccagggacaccttgaagattccagagaagagagatagagaaacatggacatggctagagagaggggagaacagcaagaaatggagggagagagagagaaagagagagagagagagacagacagagagagacagagaatagcaggagctggaggggggaacctgctgttataaaaagtacaagaagggtatctgggaagagagatgttaggaactaaaaagggggactctggggaagaagggaaaggggaagacccacacacttccagagttccacctattctctgttcagtcaggcatgggagggctgctatctaccttccactcatacccgggtgggcatctaagcttctgtcccactggcaaggggcagccctacctgtgagccccaggctactttgctaaagccactggaggttatgggagagagggatgagggaagaggttcccaacaccggcgagagtgactgcagccttgatgagcagagactgtctatggttttagagctttattatagaaaggcaggggaaaagggagaaggtagaagaggggggggaggctagagagaaagagagagtaaaagggagagaggagaagagaggagaggagaggagaggagaggagaggagaggagaggagaggagaggagaggagaagacaaaaagagaggagagagaagaccaagagagaggagagagggggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctccctccctccctccctcccttctttctttctttctttctttctttctttctttctttctttctttctttctttccttctcttggctaaagaataaaggccagagtagaaatcatttgcctaaagttccacagcatgtgttgtgaagaaaccttaaatacatgaagttctgcctgtgctgttgaggttgtaggcaatgatgaaagattagaaaggtagaataaaagagagggggatgggggaaggaagggaggaaagaaaggaaagaacaaaggaaggagagagagggagtgggcagagagagagagagagagagagagagagagagagagagagttggtcaattggagctacactcttagttttcacaatcaagacttggtgctttagcccaccattagtaggagtcaccgccaagcagtgagaagattgctccgtgttacttttacttcggagaggtactttgcaggctacaggttgaagggtgagattatcgacaaaagggaaaggggaatgtgcatttaggagataatggattctgatgacattcattatggcctaaccaattactacttatggtaaactgaaggaaagcataggaactctgtatcacttgcatttatacggacaacagaatgttaggcagggcaccgactggcacacttcacaggcaagcatcaagtaatcccagctaaggtgcctgtgaggatggcctgtctggaaaaccccattagtactgtcctgatttactaggaggcctctttgtgctgtgttttaagtataaattcctgttttatcttttcagaaactgccctagtctagaacttgaatcaaatgcaagtggaaacttaaatcttcacatagcttgagtctcttatttaaccagagcaagcattttgtcagtaagtctatgaatggggtcttcctcctcttccactgtctccaagacttcagtatattagacttttaactacttgctgtaaaagagcttgtatagcagtgataaagtgctcttgctagaaagagacttgggaaatttggctgttgcctgcctgtacccatagttcttggggaaagcttggatagactaagtacggtttataagagctatgtctccttccaccactgactcaccttctatcctctaactggctgagccttccttgctcttgacaagtcaaacctgtctctgtttccgagtctctcagatttcttctgccttgaaggtgattgctgcagatgttgatgtggttcactcttttatctccacaatatctgggttccttacaaaaatcaacccagaaagtccttggcaccccacctgccttccaaaatagcacacttcccacttcccagctactcttcagccttatttcccttttcattcttttttcttttcttttgttctttgatttccttccttccttccttccttccttcctttcttccttccttctttccttccttccttcctcccttcttctctctccccctccctcctctgttccttcttttgttcatgagacagggtctcatgtagcccactttgaggtatctatatagcaagggttgaccttgactttctcctctacctccagcatgtacccccaaacccattttatgcaaccctgtggtccaacccagggtttcttgcacactagtcaagcgctctatagaccaagaaatgctaacttttcctaaaagattgcacaaatatgacttctgtttcctgctcttaataaatcatgtttcctttagcctggtatgaaggtggggtgaaggagacaggagtttagctgatgattatcctacaggcatgcttactctgttcacctctcaatagacatgggtccctgtactggctaattttgtgtcaacttgacacagctggagttaccacagagaaaggagcttcagttgaggaaatgcctccatgagatccagctgcaaggcatcttctcaattagtgatcaagggggaaaggccccttgtgggtgggaccatctctgggctggtagtcttgggttttataagagagcagtctgagcaagccagtaaagaacatccctccatggcctctgcatcagctcctgctctctgacctgcttgagttccagtcctgacttctttcagtgatgaacagcaatgtggaaatgtaagctgaataaaccctttcctccccaacttgcttcttggtcatgatgttttgaccaggaatagaaaccctgactaagacagtccctttcagccaatagtgcagctttattttgcttcctgctttgtactcagtgatatggaagctgcagttccattgtagcaccgcattgtaggataaatgctttacatatgaaccagttcattaagccactggacacaagtcatactacctagagtgtagtactataaagccatgcttctctgtagcgctgaacaactgatacttatttatgtagcgatttttcatgcaccagacaggacattttgtgcttgagcttaggaatcctagggatgtcaatgattcactgtccagaggtaggaatggagccgtcttttgtaatgttgtcattcatgtttatatcttctataatgagaactttaattaccaataaattgtacttaagtaacacatacagcattcaagcaatagctacagcagtttgagctctttataggacctcccaatagagagtgaagttagagtccatgacttgcagggtgaagaacatgccagcccttgtcctttggaataagctttaccaggagtggaaatttacacctcccccaccccacccctacccctctgttttcctgacttagggtttaggaacatctttcacttgtagtaatttgtttagcgcagacacatctgaatggcaccatatataaaattttaaagtcatttgttgaccctcccaggcagccttttgagcacatggatgtttttgctttgagaggtactgagaatgctggtcagacctctgagaaaagcaatgtctgtggtactggctcccttgcagagctggcgttgacctccttctccctacccagactcactcctttcagctcaaacttactacacattatacagattggaaacaaagtaggaaatgatgtggtttcttgcttactgtatttcttggaggtcagtgtgccaggagctatttgggggtttcttgaaatggagaatgagaggagtctggttctgccctggtgctgttctgagcaaacaacgtaataaacatgggtggaacaaccttcgggggattctcagtccgatgccatcccctccaagtacatcaacacaccccgacccagtttaataaatgtgaaaaaaaacaaaaaacagaaaacagagatttgtgtcactatgcttgataaaggtatagaaatgtccagataacttgtaatagcaggatcatgtgcatctactatgcgtagcaatgaagatagggaaaatgaagaagatggaaacagctttcgaagaagagagccctgagaagaaaaaggttaaatttcaataagttgaaacggtgcatgaagagctctctactggccattcacacattgtgccatattgctaacattctgagaaattaggctcgcaattcgtctctagttttgaaagctaaagtagtgaaacagctacaatagagggttaacggtatttgcactagtgtataaagttccctagagatgaagttttgtttggagtgtttgaaacagtttctatgaggatgtttacagtactaaaatgtctctcctccctgaagaaggtctgtgactttttgctaagactgttaagcttggaggattagcgttgccattctaatgatgtctcacactgtggggagctttatcactgctaaggtttggtcttattttttacaacaaatctttgctacatgctactacagctaaagtcaaagtagctagtttaactgttgttacttgctctgaaatttttggcttacagccttatagctcaggtaattaagttttaatttagttttaagaatgtattttactctctgacatggcaggcatctttctattgcattaaagtatgtggtagaggagtaattcgtgtatgatgtcacatagatgtgcttaaaatctttctctctaaacatacataaatgtgtacaatcagacttgattggtaaaagagaaaaaattttcttttcctttttaaattaaatctttaaaattaaagtataattacgtcacttagactcttccttgtcctcccatgagtccctcctatgtgtccctcactcgctctcaattcaaaagtctctttatacgcatcagtatatgaaaatacaacttgctgtatccatttagtatggcttatgcttgtttgattccagggctgtccactttgtagtggaaaacagattgagggctcacttttgggagtggtaaatttctctctttcatagcagtcgctcttgtctgtagttctttgtcaaggggtagggctcagtgaccagtctctgtctgctttagggtgtcaattgatattatcattattcagggcttggcatgtttaggatgccatagtctttcagagtcatgggtgtatctttcctgtcacctggaggagacacaatttcacaatacattttctggtccttcagttctggcaatcgttcctggccttcctctcggatgctccatgttctttaccttcaggagttgtgttgtagatgtaacggttagggctgggctccagccaatccactgatctcaaaagcttttctgagtaggtacatcacacatgcctgatatctcaaatcttgggtggaggcaggaggattgctgttagttccaggcctgcctgggctacataatgagttccagaccaacttaggctacagagtaagaccctctttcaacaaacaaaaacaaacaaataagcaaatagcattttcatgtatagaatgtgcccatttgaacgctaaaattcacagaggttttacaaagaaatacattatgatattcacactgtgaccattcaatatactaaaaagtaaataaaataaaataacattcatttattgtcatgtaatagtaaaatcctaatgaaccaaactaaattatattaaaatgaacaaattatctgaagacctagaatgaattgcttatagtcctgatataaaatttcattgcattgatttgcttcatcagtatgatttacaaagccatttgtatcatttgctgggagtcagggagaggaccactttaaagtcctcccatccactgggctccagtaagcttgaaagcaaacgggaaaacaagacacaggaagatgctttgtccatttcaggatcctgagtctaaaaaggcagtatagggttctgagcaaatggatgggaagagttgcagtgtcatcaaaatctcacttatttcaaaatgtttcctgcccaccctttctattttcccccaaaattaatacacttggggagtttgtcaaaatataaagcctctgagagtgctcctgtggcttatttgcgccacaaccacctcagtactttatccaggaatcacatcaccaaactattcttacctcctgaagagaggtcagaaaggagagccaaagaatccctgagacttgctcgcaactgtccaggacaccaccactggattttaaccattgaaacccataaatgcaggttaacttcatgtggataatgttggcctttgaccacagcctacagatcctagggtaggctcgtctacggcacagttgtttctctagcatgctcttgtttatcagaataacatggagaccagttggtgagcttcaaagagcatagcattcatgtttcaactccatctctaataggacatcgggtctggggcatcctatcctacctagcctctttcctctttccatatcggcaaaactggaagaattttttctttgtaccacattaggactctatgaaaattaaataagctcacatggataaagtcattagtgtgaccttgggctggagacaggaagcaagcagacgtcagtccacgcgcattgtctagagcctgtgtgatttgaggttcagctctatgtaacatttaccataatacaaattatttgaacatgctatgctgtatttcatagagtgagcttttattagcagcttatagtgcatcttaaacccacttttcctattccttagatattacttattttttatatggtgctgctttattggaagagcccatattaaatgtctttatcccaacaaaatggtttttttaaatataaaacatcactatgtgttctgaggtatagtcactctcactgttcacacagatgactacaaatagtctcccaatatgaaaattcttgtctttttttttaaaactgatacttatctccaccagggaaaacagatatcagcaaaacactattacttcaggctgataacagaaatttcttctaaattttgaaaaagctattatcaaggtacaaaaatgtctctgaaatggttttctctagtctttagactctaacctcctagcaacctgtttatacaagaccatttaccccaaaaggcagtgagaaagggctttgacttctgactcagagctctagacatgcatgctggcgcctccactcacaaactgtcctttatttatttatgtcttaagtggagagaaaatggtgaattaacctttaggagcctcaacttcctaatcaacaaattatagatgcagcataattattatgtttattcttaatgtgttatttacaatattaataagcattattgagtagaaggaggaatatacatttactggacagaagatagtgatgaacccacactaaagtttaccacaagcttgacttcagcattgtagttatatgtggggtgtactagagccttagacattgttccagacctctttttataaagacgggtggggttgcagctgtgtggatccgcctaaatgagagacagtgtagatacagggactggagtaaatggtatgtttgcatgtcatctacccaatggctctttatagtactttcatgcttcctgcagaaatataataacaagctcatgtgactaatagattctgcagtgaaagttgtatttaacctttatcccgatgactttacaacatttaaatcaaattgctctttatttcttggtcatttccaagaatacttaagaaagcagaaataaaggttactacttcactcttgacaaagacttccttttctcattatctttgatcaggtgggctctgtctcttaccaatttcaaggcaggtaaaggttagaacaaagggttccatttaaatgtactagcacaccattggaaagaggccacttggataaactgaaatcttaatggcggggggaaaaataaaatacaccgaaagaaaacagtttggggacttttcagaaatctgtcaagcttctgattctctataaattaataaaagtatgatttttaggagtctgtctggaaattacggattaaattaagcaaccattccaacttttgcagatcttgaaggtacatctttcatacgtatggtgtttacctgggatttaacagctttgagggtttttatatttcattttaaaaaattatttcctctatattttgagattataatgacattattttccccttttctttcctccctccaaaccctcccatatagctctccttgtcttctttcaaattcatggcctctatatgtatacaaaactaaatagtaaaagcaacctactcagcttgtataatgctacttatatgcaacttctcagggctgacagtttggtactggataacaaatctgtgtgctcttcaccaagatagaatgtttcttccaatctcagtgttgcttagctgcctgtagtgcttgtgagaggaggaggcctcagaggctttcctcaactatgttagcatgcctactgtctttttccttgtccagcttatgtttagacagtcatggttgtaagactgtatggttgttgcttctgagtatttttaggagacacaatctcatagcaagctcccccaccctctggcttttacaatctttccaccctgtcttctgccctgtttcttgagcctcgactgcaggagttgctttgcagaaaaccacaaccaatcaaaatgtagagtctgtggagcctagtcccaacaggtacacccagagaggctctcagttgtaaggtggctaagtcccaaatatccagctagcacatgtgtacatttgatgctggattcaatcataccaattgtggtctgctgcaaacctgttccaccacatttgccctaggtaggaagaaatgcatattaaatatctgtctgcccagtggcctggttttctgcaaaacatgacaggcattcaggaaaacataaaagtcttctaaaaagttttattctcagtgcatcttttaaaaaagttctcagctttaatatatattgctcaattacttaaaatatattagtcacttgtacattttatgacatattttaaaatatatatatatatattctatcttacatgtatgtggtctgtgtcccaatgtatgtatgtgtactgcctatgtgtatgtgcctacagagatgaaaagatggcattgggtctcctagaactagtgttacaggtagatgtgagaagcccagtgtggatgagggtgataggacttggtcctctgcagtgagtaatcccaactgctgagccatctctccaacccccactttatgcaatgtttgaaagagcttttgccaagcacttagtgctttgggcatctcccagcaccctctctcttcttctattttgtaaacataagtgtttttcttgtctttgtatctatataccgtgtgtgtgcccaacgcagatggagtcagaagaggccatcatttcccttggaactggagttagggatggttgtgagcagctttgtgggtactgagaattggatccaggttctttgtaagaataaccagtgctcttaaccactgaaacatctctctagccctgtttcaaaattctaatggtattgctaaatttgacctttttttattttaatttatttttttattaggtattttcctcgtttacatttccaatgctatcccaaaagtcccccatactcacccccccgatcccctaccctcccactccccctttttggccctggcgttcccctgtactggggcatataaagtttgcaagtccagtgggcctctctttgcagtgatggccgactaggccatcttttaatacatatgcagctagagacaagagctccgaggtactggttagttcatattgttgttccacctatagggttgcagatccctttagctccttgggtaatttctctagctcctcaactgggagccgtgtgacccatccaatagctgactgtgagcatccacttctgtgtttgctaggccccggcatagtctcacaagagacagctaatttcacctttttttaaagtgctgttttcactttcattcctttctttttagatttgaatctgctcctgttagggtaaacatctccctgggtaattaatcacgctgggatctggaacactagcaggaagccaggtagtttgttactgagagtaaagaggaaatctttcccaaagcagagaacaagaaaagcagtatgtagaatgttccacattgaaagggggggatgagtcggagaattacatcacatgcttctatcatttagctaggttcttcacttataactggtgatatgaggcttcctgcgattagggaactgagagttggcccaagtgttgagatttagtttgacatttctggcaatgacctcaacccagttcacctcctttgtaactaaactctagcccccaacttttgtggggaggcatccagtaaaatcacacatctcctcattaagagtcttcttagagtgagggcctggcaaatttatttcgagttaagcatcattggctcacggggctcagtgtataggtctgttgagggaataaacattatagaggaaacattagtctctacttacacaatcagcaaactcttcaatcattctttcaccctttcattcaagtgaaccacccacccccttcgcctcctgtatctgcagacctctcaccctctaccacagtccgcatcaccctctgaccacacactactgttttgtttccctgtgttggaaaacatctactatctgcttacagaacctgtctcttgctagcagtactccagactccagagtgattaattgctcaagaaaaaaggaagtcatctaagaaggttaacctttgtccctgatgtccccacatcatcagcgtcgcatcttgctattgatttgtctcagtccacagatctgctagccctgtgtttctgcacagcattctctgcggctccttgagatcctccatctcttaccttagttctgaaaccttgtaatttcccacgccactctccctaggtccctcccttgaagttagtccctttagaaagttctaaacagtttttttttttcctcctgttgctactgcaagcttggaggttttggtgtctgtgcaccggggcatcttggctagctttcttgctacacggaagttccacccacagctgaagatacaaggatcatccaccttgctgagcactaccctggcttgtttgccagggtatcagtgtcatactaaacaggctggctgctcttcctgtttttctcatcagatttgccctggcctcaaagctctatatgttgggatgccctgaaggatttagatcatgttttgatttattgttctctacactctctgcttagatcatgacttagacacatgatttaatcagcatccatatgctgttgatccccacatttctagctatggccacatcctatctgtacaggtagcattcagtacattctaaatccatatcatggattttgcccctcgctggtcccaggttcctcatcacagtgagatacaattccatttttctaattgctaagggtaggaattgtgaaatcttgcacaggactctgtgttctctgactgtttgggtagcttctgtttttaagacctaagttctcaagttgaatgagagaggaaaatgagactttaagatacactatgacagataaaatggtaattataacgacaccatccccaaagtggtaattctatgtgtaaaagtagtatatgtattctatatatgacacaaacagacatatatgtgacagcaaggcacagatagtgatcttataggaaggagactccagttcacattagtcatgagattacagacaaatgctaagtgtctttctccactccattcactatgcaaataaaagttaatatgtgcaagtgagagctagatcagataactgacatgcagaacaaacatgaaagcagatattattttgtttcctttacacatctgcgacttcacaagtcaacctctaagacctattactttttttttaaaaaaagaatatcttgacaacttcctagattctcgttcattatcagatatattttttatgcatgctccttatataaatctttggcatcatgttgtaaccatcctcactgtttcttatagatcagtcctgtccctcccattcattcagtactgtcatgtactgggagaaccacaaagtcctcaagtttatttctatgaatagaaagctgggtaagtcttttacactgcagggcagtagtgagggaatatttatactttaactagaactatgtctctttgattcacactggaacagaggctcttatgaagtcatcagcatggcaatgcagacaatctccactgagtaaatggtcagagaattgtccattggagagcataaatcaaaatcatgaatatctttttgcctgctccagccaggttattgacacaatagcagcagcatggatatatatatatatatatatatatatatatatatatatatatatatatatatatatatatttaccatagagaaatgtcatttgaaggtcattgtgtggtaataaatatcaggcattgttttattaagctaacctctttgaggcacaatagctatttatttgccatgtctcgtgacaactggcaagtagatgctgaactggggttcttaaatgcctcagtactgagatatctgccttttcattgcatctggaatagacttattttgttcctgattttgccatttggatattggcagtcagagagggatctaataatataacaacagaaattataggctgtgagggaacccacacacatactgtttgtcaaacaattagggtatttctgaagtgtgaacagatgtacaaaagaaattagcaaataaaaaacaacccaatttaaaaacattcctaatatgaacataattaatttatatgttttccagcttatactaattaaaacctctagtgttttggtcaagtttgagacttagagtttaccattgtttagtttcttatatcaaaacagtgataaatatcaagtattatgtcttatcaatttttgctcaggtcaaactactgttatcaaagcttcagtgccagagatttgtagccaaattgtcaccagttgggaactcttaaagcctgcttagttttcaatgataaacagtctcctggcgagtttatgtgctaaatatttccctgttttgcagtggcacacatcaggcatggttattgtgtgtggaggggggattttcatttttaacatgttctcgaattctctggacatttactgtttccatctggtcctcataaaaacatttcccatttgtaatgcagctcaggctcagagcattcgttgtgattctatgcatggctccagtttgacagagcagatattcttcaacttcggatgtgggtnnnnnnnnnnnnnnnnnnnnatgcggagaagaaacatgcaaacacaagccagcatgagaataattgccagttacgtgtaataggagtaatgaggcatagtacaaacttaataatgatgcttaggaaatgaagtcgtagcaatagtgcatcagtattggatggggttggttagacactgtgtggagttctgcctcctgatatgatttcctgtagtctgttcttttcttaaatttcaagaatacatttcgtctatgtttaactgaagacttgaactcagggggggaagaaatctcacaaagtacaaggaaaagtgctctgtccaggaagacaccagttatatatattttgatagttaattatagggattccttgagggtggatttatttatgtctcttgggctgcctacatactactgaccatgctcttgcctaacttgattgttgaatactgaatgaaagactctccaagtatctctcactaacacaaagtaggtataaagttgcttgcgctcaccaagaatcttcagcaatggaaaaatgaccatggttacaagtccagataagcattattttcgataatatttaattacatcttttgctaaagcagttgcaggatgcctctacaagttcacatctaccagagccatatcttggagttgaatagatttcagaggaaatcttatttacacttcatccaatcaagtcaccaccaagctgcattccaacctgtcacttggtcatcagtctccttgtgagcattttcaaggannnnnnnnnnnnnnnnnnnncctccctccctcccttccttccttccttccttccttccttccttccttccttccttccttccttccttccttccttccttctttccttctttccttccttcctatctctttctttctctaaattttgaaataaaatttgcttgaaatgctgcatttatctccaacaacaatcatagcacgcacaccatgacaacaggcacacttcccacttgcctctgtgcagtttaaagctgcaggagaagcaactgcattgagcccaggccaagggaactgagcagtcgtcatagtttctcgtcatttcacaatctgttctcagtcatcacacatggaggagtatttttcagggatttgaacactttcacaaagtagccaaacaagtaggatcctctttgctgagtttggtagtaccctacggagcagtgcaacccaaagtccctcattcctaggaagtccttttctgtgttattagatgacagcccacggatgtggttagcaagtatcaatgagctccttatttatggctggttgtgtgccaccagcttcataatctcaattcagtgactttcgataacatcagcagccccatttaaggatggagaaattgagacaagaaggtgaaaaggccacagctagcaaagagggaactcagaatttaaaccaaatatctcggcttagctttggaactgtttaaccctagaacaattttgaactttttagttctttggcacgacacattctagaacatggctctccctcccttaggtatcatgcttcgtttgtagctgcctctcctcgggtattttgcatattttagagtttaatcagggatgagtgcaataactatttgaaataggcagaagtaaggtttatgaactggaacaggcgacagtggagaggatgctcccctttcccaggtctagaatatcccaggacccaaggaaaaggtctagatactctcaagatgatggcgtggaattttcactctcaagcttaaaagaactgtctttatttaacttattgtcccttaatgatacaggtattgaaaggcatgacagaagtaaaatataaataatatgagttcactcccttaactgtctctaagtgtataatcttttcagtattgttgcatatattcatcttgttcagagaaccttgaatccagtcttttcatctttcagaaaaaaaattggtagcatttaaattaacttacactttctgctcttctctggcttccggtaacaagagcattttggtggtagtggtggtggtggtggtggtagtgatgattatgattgcctatagatattgggattactgtcatctttttgaggtttttttttttttgtgactgatactgttataaagatgaatgttcaactatctgggaccttactttcaattctttgggcatgcacctggaagtagaattgctggatcataacacaattcagcttttaattttgcgagaagctgacatactgttgttcataacagctgcaccaatggacaatggacaattgacaattgcaccagggatctgatttctccacatccttgccaatatgtgctattttctctcttttctctgaaatcattttaataaatatgtgaagaaatattgttgtggttttgatttgcattcccataaacattaatgacgttatatacatttccacaagcttcctgatctgcattctttgtattcatatgtgagagatctttgtgtattgtatatagtatattcatacacataagtggcaaatatttttctagtcaatagttatatttttgctctgttgattatgtttgcttgacacatagcagttttaaactttggaattgttttatttattggtgtatcactgtgaccaaatatctgataaaaatcttaggggatggattttattacatctcaaactttcagaaatattgttcatcatagctggaagtaccttacatagaagaacaggtcccatgatggtattcaggaagcatagaaacaggaatggaggaaagggctcaggcaggatagagctgtcaagaatacactcccagtgacccacctctaacctatcttctctgtcaataattccatcacagtatactttttaaggcacccattcactggttaagtcagatacctccaatctagctgtctgtggaagcaccttcacagacataccaggtgtattctcgactagtctaggtgtttctcagtccattgataattatgactaactatcaaggatgtattctaatttatttgtatttacttttgaagtcattatccataaatcactgtcaagtacaaaagtcatgaagctttcgccccccaagttttcttttaaagattttatagttttggctagatttttggcctgttttgaattgattcttttaaaggtttacattttacttatttttaattgattattttatttatttatatttcaaatgttatccccatccccatttcccctctgtaacctcccttatcccatccccctcctccggcttctatgagggagattccccagccacccacctactcctgcctcattgccctagcattcccctacattggcacattgagaattcacaggacctagggtctcccctcccattgatgccagataaggtcatcctttgctacataagcagctagagccattcgtccctccatgtgtactctttgattggtggtttagtccctgggagctctgggggatctggatggttgatattgttgttttcctatggggttgcaaaccccttcagctcctatggtcaggctctggcagagcctctcagggggcagccataccaggctcctgtcagcaagtgtttcttggcatcagcaatagtgtctgggtttggtgtctgcagataagagggatccctaggttgggcagtgttctggatggcctttctttcagtccttgttccattctttgtccctgcattttaaattaatttttaaaaaataataaaccatgaaaaattaacacaattcaattgtatctgtataattttaccaaacctttatactaaaatgaacatgcttttagttgtataaaaattacatttgggggatcatttgctatgacagtatatgcataaaatcttcaacatgtttcagagttgttcattgtttggattttacagtcatcaaagtctgaattctgttttacagaaatttgtaggctaaaattcccaaaagttttagggcagttcctgatatctagaagctgtgattctaatttcaacccaaagtgtatttagcaacattttataacactcaaggcaacaatacaaacagaaactttaaaaatcaaacatcatgacaaaatacagtccaaagctatgcacagactgtaaaagtcatcttcattttcttcacttggacatccagctttcccaacaccacttgttgaaaagacacaagcttaaatgaaattgaaactatatagctagaagcctccagtttctctttcactttggcacagactataatagatttacaggaatcatttttagagttctgaacttggaatcctttgtcccctacggacacttggcagcacgtggagtcagtcttgattgttctgttgtggttagggtggtcagaagtggtcctattagtagccagtgggctgaggatggggatgctgataaaaggtctacagtggatagggcagctcccatcgccaaaagagtttcctgtgcgactttggtgcagcagtgctaagggctaaggaactgcggccttaagtagtcagagccaggctgacaggactgaaattctgagaagcctgctctttttctttggttgtggctttagctctcctatctgaaggcttggcaatggtgactataaaggtgattgcccaagggcccaatcataggcccgatttcataacattcagataggttttaacaacagcatgtctcttggaattttatttttcctttcatgcacgtactttcacacacatacatacacacacacacacacacacacacacacacacacacacacacacacatacacacacatattgtgagcctagtctttaacggctgagccattttcccagtctgtactttcttagtctcttgccatgacttcccgtgtatactttcattttctgtttttattcaggaagcagataaataattgttgggctaatcatggcttatattttatatggccatagattacaagaatgcccacagtctacttggcccagctatgacttatagttttgagctactcaggatagaaatttccaaagaacaatataaacaggaagaacattatttgacaataataattgaatttatagtagccagatcttcattccccagctcctgagctgggtagaagcacagagtcattctatcttggctgattatactctaggaagctttattaagaatgttgtgactaagctaagacttgcctgggtaaaaaccataaactatgagatggtatttctgttttggtctggagagatggctcagccattgagaacacttacacatttttccagaggaccaaacactggcttccaatactcatatgtgtatccaatgcctttgtctggccactgaagcccccctaatacacacactatatatctatattatatattatattattataatatcttattatagtatatattatattactatatattataatatatattataatacattatatgttatattattttaaatatattgcataatatataacagtatataatgtattagaatatgttatatattatgatatattatatttctacatatattatatatgtgatatgtaatatatgtgtacatattatatatacatatctttatatatatatctttttaaatagactatttccctgtgaaaaaatagaaaattccaaactcaaaggctcttaaagtgagaaaaatcttggcagcagtgacagtccataaatggagataaagctaacaaggccaactctctgagttgaagagtatagtaacaaccaatgccacgtcactgagacaaagacaaaggcagagttttcagttttagagaagaagggaagagaactttctctgggatagggagaaccctcaagagctcacccagccttggagagctgtagttggcagcttcattcatctgaattctggtagtgaggcaaaggcttggccaatcttcttctaaggatataggctcatctgcactctcctttttggagactttggttcatgaccaaatgacttccttgctttggttttgtggcatccctgtgcattatggcaggaggttgtggcatgggaatctatcacttttatgagggaaagtaaaagagaacgagggaaggatagagctccctcaataacttcaaaggcatgtcccttttgacccaagacctccctgtagttgcctggatccaaaaactctaccacctcccaatactggggaacaagcagttaacctatagcctttgggttagaattcaagtgtgaaactatagcagcaggtgtgtaaagaactggcatttgtattcaagatttacccacattattaattattgttgatattttcatttatttatccctaattgccaagtcctttgaatactccatgcttcactgttagagtagagaagtcaaaataataagaactaaatgttcttgttaatgagctcatggtgtttatggaagggcagttgtctaataacctctagtcactgactgtgtgaccaccgatacgttacttaacctctttctgtctgggtgtctgggaatacttagctatgacatgaaggcttctttgcagcttccttgtgaactagtgatgattaaggaggggaagctcctggaaatagagtctgagtcatagtgaagtcacagtaacgattggccattaattaatttatatagggacaaaaatactacttcactcaggcacgagatttcagaaagggaaactagagcatattctttcatgtcagttgttaatgaactacatcagtggtcctaaacctgtaggtcacgacccctatgagggttgaacatttttacagggctcacctaaggccatcagaaagcacagatatttacattatgattcataacagtatcaaaattacagttatgaggtagcaaagaaataatcttatgattgttaccacaacacgaggaactatattaaggggtcacagtgttaagaaggttgagaaccactgatctatatacggagcacatacagtatcccaggtacttctctcccacatatttactacttgctacctgtattacatacaacaggcttaggcactgacacgtttttcttctcagtgtggctccttcagtacagaaaagaacacttaagtcagagatataaaactacataggtaatcatttagttataattgtgaacaatgataccaagcataatacaattagtggatggaatgatgcaaggaatgaaagaaaggggcatgaagtgttcgagctgagagctagggaagatagcaattacagcacttcatgcagagacatggaatagctgatactgctgcagactcgctactcttcccatgcttctgacaaagaattgtgccagatgggccttttgtgtcttcattaaacagataaggttcaggaaaacacatcctaccttcaacattctcagacttgactcaggaaataggtgcttggagaaatgatattccaaaggaaagagaaaaatgagggggagaaacctggtctttggtctatttctacagaaaacaagcaggtggaggcagacaggacttggggtggagcaagaaggttagaggagacttatctgatatggtagaatacatttggaattcacaaagcttacttaaatatctcatgcacatttctaaggccttttttttttaatggaaaatgagtttcaatagatcctgttctctccagagtctaggcagccagtatttcataagtttgcctttgcaacagggaaaacagtagtttgtacctgtaactatagtctttcttgtttagtcctttacacagtgctaaagatggaaacctgttgagattccgtttggggtggagtctaggtaaatagtctctgcccacagagaagtgaaggacttactgtatatttctgctgcatttccaggggctcacccagccttgtggttggattttcagtttaggccagctattcattaaatagctactcgtgaaaattttagcttaactgttaaagacaagcaaaatggtcaacagaaacaaatgtatattgatacacaaagatataatttctctgtgatattttcagtaagtattgaggatactagatacatacatttttaaatctcacttgaaaaaaattcttgttactagtcaacagtgaatcttggtctcttgcaagaacagtaggagtcagggtaaggcaggtatctgggaagcatcgtagcgagatatcaggaagataggatttcaaatgcatggtatcatttaaaaaacacttggaaacaagacatttagtactaactgggcagaccaagtagtggttcattgtagctcccaatgatgtcgtctaagtttgctattattaaagtcctgctggaaccttgtccacccagtctaggccttcatggtgacttctatcatcctgagtaccattaatgcagatgtactcgagtctgcgcccacctgattgtggtgctaaggacactatcctcatcctgcggcactcctttttgtctttatactggagcatgggtgatatttttgagtcctttacaggttttcatgcactgatgaagacccatagattcatgaagagttctcatactagcaatatctctctttctagagaaacaatttttggctgagccaggcacactgttgccaaggctaagttagaataagctcagtttctattggagcaattcataaaagttgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacattttcgtttgtggagattctggatagataaggtcatcatgattctcccatccatcattgttgcatggcttttcctgtggagatgtgacaaatatattcatcttagaggagatactaatgacagactaaagaaatcatcccattcaagcgcaccctggtgaacccatgagtacacagggttatttacaagagcattggtgtgaggactcatagtccacttgcctactaaagaagagtcccctacccagcaactgcaaccacttatatatcctcagtgtgctttgtgcatttcttgagctccttatgtactgcctcacttcatgagcccgtccctttttccatgagagggtgttaatgagccagttttgagaggttctcatgaatgtagtcacacctgcgctgatttcaaaatggcagctcttatgccttgcatggaagaagtattccacggcacctatgaataggtaaaaccttaatatatacaaaatgtgaaatggagcgtatttgtatcttactgctctcaatatcaatgtaagctttattagtgatactttatcattagaaaacactgaggcatatccattccttacatattttcaaagtgtaaaagtgaattactaaaattattgtatataaactagatctattttaacatattttatgcatatattgtaatagcttatgcttatatcatgtgtcttgaatacatattttgaaggttacataaaaggtgaaattcctatctttgttagcagtttaaacctatagcccctcttgagacccagcattttaattgtctgctgcaactttgttctttctagctggagtcaagttattgtaatatggtagcatttactatctggctcaagaacatttagaacttaccaaattgaaaaaagaaatgggctttgagacaatactgagaaacttggagtacttttaggaaggcaatgatgtcagccatgtttgaaacaaataatttaaacaaaggctgtgtccattccaaacagaagcaatgtatgagagaaggccaccagagtggtagaggggtacatgtgtaaaatagtgtcacataattttgatctttttagatgccaaatcagtaggtagtagtaccccttactgcagtttctaaagaacacagttatacagaagaaaattttaagcaactgaaaaataaggtttctttccctttcttccttcctgcatgctaggccagtcagtactatgctgtaaactgcatgggtctgaaggacttgttgcttctcaccctgcttctgtgaacgggtgtccttgctctgtctattatgtcactgtcctttaagtttccccaactttagcttttgactcaactacttatttcccagactctaatagattggttactttttttttttaatattccagacaaattatcctatctgttcaggcacaataccctcttgggtcttctgacagttctgggggtttatgcttctacaagcacttccaagctctgagttgtatagtgtaaatctcaaggttaggataagttcattagttcatctttaattttgttttgaagaatcttatcagatgttcatgtctcagaacatgcctttcactgcccttcttaggtttaacaactcttagaaagaattttaacgtgtagcattcagttattatcgttttttttataaacaaatacaaaacccaggtccagttctccacttttatgagagattgaagatgaccttgaaatatcaatatcagtgtttcctcaagagctaaatatcatattacagtattcataagcctgaccaaggtcagacctatgaatacactctctgcttctatgtaacctgtctttggattatgggtaaatgatagcctcattcagagtacagttcgcacctgataattattgtcagcaagctgttgttgagatcctacattatgagttgagtcctctgttttctcctgtagttctagttagctgagtctacagcctgcacacagagtcaaaattgagtgctcaaacttggagtcagatgacctgggcatacatcctgtgacaacagggaaaaagattcagtttctcctgtttcttggtctgtaaaatgatgtcgctgatagcacaaaggatgaatcttacccatcaatacatgaaaagaacttccgaacctcggtgaccatactagcattacacatttgctgttgtcgatgctcacgtatattcttagcatatgcctggcggataatacgtgctgattaagttttagctgttattctttctgacaggaactccattccatactgtgtaacccctgcaacaaacattggctccaaagcaaaacaaatatgtacacatccacttaccagaattcctctttattcattttcaacgaacaaaccaaccgaataggtttggcaaatggcttctgtgggaagggtgtgtgttagaccgtgggaagcccttggcattactgtacaatacacagcagatgaaacttaccttttccttttcacagctgcaaatcaaattagctttgaataatcctattactgtgtgctcaccgttactgagcactgggaatatgcagtcaagttcttggcccttactgtacatgttagttttgaatgcattttccatttaggatgagaactccccaagttaaaaaacaaaaagcaaaacatgtgatctggcagtgagccagcgctgaattggtcgaattgtgcaatttgatgccacagggtttgagttggcagcattttgagataagtatgatttatattataaaaatttatgatgaacatttttctaattatgcattatttcaaaaagtattttagtttaaagaggtaaagttcattgctttttctttctaaaaacatcaaagcccagtattgatctagatagactattcatgaatgctgcctttgctttataatgcaaaatacaaatcatatattactgtagtggtaagagtctgtcttaattgggtttgctacagcacaataaaataaattctcttcatctagccatggaatcatgaacaactttttaatttaggatacttttgactttatattaccttaaatctaaaatgacccctttatagttccacctccattgagcctgatgataaacatcagctcaacaagcaaaaacaccatcaggcagttttgtttttgttgcttatcgcaaaatattaaacccaattttaaaagattttgagacactgagtgacagagccaaacagtatcatataattggtgttcatttggaattttgatgctataagctacattgggaggtatgtaaataggctggcaaggaattgggaagttgtggcttaaattatagaattctttattcctggactagtggaaaggaattaatattcttttaaaaatgtttttattatttgcttttatttacttaatattttatattatttttatattttagagccagattatggagagggtcggagggaagggagacgtgattgaggaagaacaaaggttggttagtacagagtattggtgggagagtggttaatttccgttggtcagcattaagtgctgtacgtccaccacaaaatcaaattcatatttttataaaataaaaaatctgagtcaataaattagaaggaaaatgaaatattcaaatgacctgtgtatttattattatgtgtgtatttgtgctgtgtttttttttcttctactattacagagttgggctacagcttgcaagtaaattagaggacacttgttttcatttttaattattgatcagctgcctgtaaggttcattttctattaatgcggaggtagaattgtgttttatttcccttgctctttagctcttgatgaaccccatatggttctgctgctcaaagctcttcaataattcaaacctatcatggaaaacaatcatcaagtttggagaacctagatgagttgttctccaaggttccttttttcttcccttctaacagcagggacattttctcaaattataacctagactcaaactttaaaatatatacaagcaggttgcctggtttgcatataagaaagaatgtttctccatcactcagactttaataacccttgatgtgactccttaaattcctgtggctcatggttgcagagatggatcagcagtgatgagaacctgctgcacctgcagaggaccccagtgctgttcccagcagccacttacaactgctgtaaccccagaagacctgactccctctgctagactcccaggatactgttcactcacaccacacacacacacacacacacacacacacacacacacacacacacacgcacacacgaggatcacagacataaatgccagtaaaacacccatatacataaaatacaaataaataaatccgtaagaataatttttggctcccacaatagagtccagatataggtatgaaaatgaccttagatagaatacgaaatgggctcctgactgagtgatccctgatctgcatatcaactgtgccttctttgccattggctctgccacctctgggcagtagctaacctccctgatgttgtctccagtctgtaaacagtggttgagtagtgcctacctcagaaacctgacctgaggactgagataatccatgaacaatacttgactttattgttactgatattagtaatttaacaatccctttagctatgctcacactagccatagtgacacaggactggcagtgtgatggcagacttaacgtcatgcatgtcacgtgcaatgttcttgatggaaaatatgaatatttccaagtttagagcctgaagcactgttttgttttacttgcaggatttttttacagtagcatttttacagaggtaaattataaaggattcaataaggtgctacgctgataagactccttaggactttgtacagtggcctttggcaagcagctcaaaaaaattaaagtaattttataaattagtaaacctaatctctgcacttttgcaaaaaataaaataaaataaatcctattttgttgagcacagaatctctaaaaccgagctttcaatgccatggcactgtgtatttaattcctaatcaatttaggattaggaagccattttcggtctttttaccttttttttttttttaattctgcttcctttgcttttatttgttgttaaatgctatgccttattgaggatgtaaaaagcaaatggagtgttccagcctctaatgtgctaggtggcctctagcaacgcgtctttcaatcacttttatctctacactaaatgaccaagtttttggtaaacctgtcagtagacactgtaggggagggtggcagacagtatgagcggagggcacactctgttctctgtgcatctgtcaagacatcttgcttcctgtgtactcgtttccagccaggttctgttttttaccttgtcacagtgaggctctcttccttgagcacttctctaaactcagagagagagatggctttgccgcactaactctctagcctgttatgtaagatgcttcaattttattgaatgcattagaagacctcttctttaaaaaaaaaaaaaaggaagaagaagaaaataagaagtatgggaagtggtatacttgaaaatacactttagttctatttgggacttagcttgaatgtgttagcagccagctgaaagcaaaactaaatcaggaaggaagccagagaaagggcagaagtgtcagagagtagccaagagacctcagagaaacagaaaggctcttctctctctctgtccttccctctcttcccggccctccctctagcatccttccctaccctctgtcattttgtcttaaggtttccattcaaatcatctttttcatcttgtacttctgggattagtttttactgttctacttttggttaattagcatttcaaagaaattgagataatgggtggtgacatctgagtcacattccgatgaatggcagcttgattaacccagtgacacaggttccacccctactctaggttcttggtcttcctaggagtctctcaaccaggttctgaatctccttgccacccgccttctgcttcctaactctccctcctgtctctgtttttggatgttggcttttcctttgcatgtgtgtatgaaatagctttctgtcttagcatacttctaagccttacttacagaggtcatggattctgattagatgcttaaaatattagttgcagttatttaataaagatctattaaccttttttttctcttaacaagacagctgtaaatataaattcatatttcaaaagagaggtaaaaagggttttcttttgcggctgttctgtgtgtgcatgtgtgtacgagagtgtctatatgtgtgggcatgtgtgtatgtttgtgtgtgtgtgtgtgtgtgtgtgtgtgtgtgtgttggttaagaaaggtaatccagttccacccttctgattctaatttagagcattttagcagatgaagaatctaagattactttaatattattaagcaataaattgtacttatacatagtatcatggaatattgctgggtgccaccaagtttcatgagctgacttaactttacaaacatagcaaacactgtaagaaccaggaaagggaaaatccatctagacgttccctctaaagtcctggatgaccctctcctgtaatcctttcaacttactcataaccttgttccctttctctctatcttgctgctcaaacccatatcatggctagtatctttcactgtgttgctaaaccttgaaagagacaatattttctttctttctacctctgtgatctagactttcctgtctgttaaatcttccatgtgattttgtttttggccctttcccactgcagccctttaccagctcactgccaccaccctcagcatctttgccactcaccccctgctcaggaggctccatgtatcccctctggcaaacctacactggatcagctttcttttctgtataagaaagcacccatcctgtaccctgatatgattgggggagggggttattaaacaattctgctttcatgctctcatctcctctgcctcacatagtctcctgcctggtggaaagtagaacccagtggacttaggttcttttttaacatttgagttctagttaaaattggttttcattattgggtaaaatatggtgaataaagaaatcaaaacaaaacaaaacaaaaacattgctgaaaaggaagagtatcaaacatcttctgggtatctttattttatctaacttgtgtgataaattggaaagaagaaatcaacaaattcaaaggatttatagatattctctagaaaatttgaaaacataaaattttaataggaaataattgagaagtctactatgattctaaaatgagattagaaaggggcattggggcggaatataattggcatatgttgatatgaccacaacaagatgtgtgctgtaggtagaacatacttattcacccaatcatgagctattcacatatcagagctattcacatatcagagctattcacatatgagatatgacctttattctactttgttcctatcaatacactgagagctacagtggtaaataaaaccaaagaagtatgttcctaaaaggcattaattgaatattcacagaataaattaataataaactatacaatacatgttttacaggtaaaaaaaaaatcaagctacaaaactatattgctggagggaggaatcagaggtggcatccaggatgaaatgttatgatagttacatacaattcaaagcctgagtgaggagacataattctcttttgtgtgtacgaaagactgcccgccttgacgactttaaggagaagtgctcagcacctggtgaacacttgaaatagaggggagaggacgagccttggatgacacctgagatggtagaaagaagaaatgaagttgtaggatttgggtactgaatagttttggtgcatttaaggaaagatacagagacagtcaggctgttctgcagagagcttcctgagtggagagtgagtgcgtaaggtcttgagggtggtggctgtgggctggtaaggactgcagtgggcttaaatcaagatcacaaggaagactgttgcacataaccagccatgaaatgagaaggccacagatcaaggtagtttgatgtacacacacacacacacacacacacacacacacacacacacacacacacacaccctgcatgtggcattgttttactctttttttcttctagtatacatttagttgagttccatgtgtatccccaaagtaatatcttgctctgttctcttaggaggagttattgatattcctccagagtcccagagaattcaattcctactgctgttaatgcacactttataaaacaattaattatttatgtatgtcctcgtttgctggctaaaactgtcgactctccatgggctgtgagagttgtttattttccatagagcacctatggcagactttgggaaacagtggctgagtgtgaatattgctatccactagtcactacattaatagatagttgaatttaaagtgttttttctacatgctatctttcatggtgcttagtttcttcatatgcttttaggtaaagatttcataatttgtaaaaagccagtatgcattttgttgaaatcagttgtctgtctaaagcaaaaagattggtaactttacaggatctagacatatagactgaatgatagatttagttttcagtgtgaggcataccaagacatttgctgttatttcattcttagttttagaatttccccagtacagggatgctgggtggctatctatcaatctatctatctatctatctatctatctatctatctatctatctatctatctatctacacttatctatctctattctttatcaatcttcttaactacacatagaaaagatctgtttaactcttgtttgattcacttagctgtgaccagggagtgtcatacatcagtgtcaccaagccttcatttctgcatctgaaaatttgaaattagttttcttttattctggtttgctttctattgatgtgctaaaatattgaccaaaaaaacagcttgagaaagaaaggctttgtttcctggagcacagcacagttcatcatgaagagaagacggcaggcaggaactcaaagtagaaatgaggaggcaggaactgaatcagagaccacggaggacttctgcttactggcttcttctccacggcttgctcagtttgctgttttatattctgcagtactatcagcccattccaggtactgcccatggtgggctgcacactcccacttcaatctttaatcaagaagacgttctacaggcttgcctataggccaatctgatggatgcattttttttttctttaggttccttcctcccaaggtaacactagttacaaggtaacaaaatctaaccagaaaagtttatgaaaggaattgaaatcacatctgttaagcattaaacaatttatatccaactcaaagtgactattttgtgaattttatatctttgttagactgttgttaaataggtatgaatggagattgctttctaagcaatctggtgggcatttataaacaatgcctgatctctgactctgctcatttatgaatggggggggggggtggagggggcgggggtagattgtaaactcttcttcctcccaagcaactaaaccagtattttcaaagtaaagtgtggagtggatcctactgttagggaaagtattagtactatcttgcctcagactgttcctgggcctgtatgtccatctgtctgccttttcaattaggctgacgattgtacaggaagagtactcctgatatcagtctgtgtctaagcccagtggctaatatataaacctttattttagcagagggcacccaggatattcaagccctgactgttattgagtgaggaatcttaacacagttttactttttcagaggaacatcagggtcgctcacagtggtattcaattttctcccccttttcagctcacaggatgcaggagactggaggcacaaatgggtgtctcttcttccttcccactcccaaggagaagggcttggagggggagtaggctgactgttacaattcattgtcgcatcaagaagttaaaatgacagctgacacttctcttttataagccaggcatcaggacaaaagttgcttgctttgggtttctttttaataataagaagtgctgaggtatagagtgttgggaactaaagagtgggtaagagatctgacaagaagctgagaacaaaagaatgtgcatctttagtacgtcatagtgttctgttcgaaacacttttagattcagttttaaggaagcaactgtacttgggaaataatcattttgaccagggagagcccaagaaaaggagttttcaatgtggatccatttatagggaggactccaagtgatattctatagggtccatttgggaagttaattgtgaacccaaagtgttggggaaatggaggacgaagggcaacataaagaaaaatagcacaggaaaagtcaccccttcctcacctgaaaatactgtttattccttcttgcattaatgttcttctcttatttcaataatttcaactcatcttttctggaattggtgagactggaagtagatagaggccaagtatagcccatgttagagttttgtaaacaggaagaatccgtagtggtagcgaaaaacttcttgcctggacttggtgaccacagtagcttaaagataaatttgtgcctacctcctgcttctgggaaacattatttagcacgatgctatggtagtagctgatgctgcaccctgcagtccagtgttctcacacagtctctgcttgtctcatctgacacatctttttcttcagttatgtccctgccctgaccatgcagtgtactttatttgttattttgtctctcaaatccagtaagcaagtctctcattcgagaatttgcttcattaacacagaatcaactattgacaatctgcatgagttaatgagccagcatatcaatgtatgctaggcttcctcatttcctttttttagataggcaaacaaatgttttaatctattaatgttaaaaatatataaattaaatcataatattgtgactcttttattttaaaaaatgattaaagaaaacatgctacttggtcctaaaatgttgttatttaaacttaagcaatgaggagatgattcagttggcaaagtgattgccattcaagcatgaggacctatgttcaggtatctagacgtgtaaaattctgggaatggatatatatatgttcatgtaactctagtgctggctaggggaagtggataatgggggattgctgggccttgttgtcagtcaacctcatagaaaaacccaatgttgggctggtgagatggctcagcaggtaagagcacccgactgctcttccaaaggtcctgagttcaaatcccagcaaccacatggtggctcacaaccatccgtaacaagatctgactccctcttctggtgtgtctgaagacagctacagtgtacttacatataatcaataaataaatcttaaaaaaaaaaagaaagaaaaacgtgatgctccaggctcagtgggagagggagaccctgccttaaaacataaggtcgtgattgattgaagaagacacccaagattaaactctagcctccacaaagatacgcaagtgaagacataaacatgtgtacatgtacaggcatgcagaaataccttagcatagaggtttaagttttagttctctaatcattataacatgcatgcaaataactttagtatttgcttaaagtgaagatttggggaggaaggaatcagcagaagtgattaaaaaggaattactccatggttagtgatctgatctctacttgcaacagtttcttctaaatgtctagttaatgttgggcatggtggcacacaccttcaatctcagcacttgggagaccgaagcaattctctatgagtttcaggatagcctcatctatatagtgagttccaggcaggccaatgccacatagtgagcccatgtctcagaaaaaaacaacaaaaggaaagaaaacaacaaaatgcctaattaggtcaagtatctgatttaggtgattcaagtattttgcccaacacatacctaacacttaagtgttaaagactttcaatcttagtcacagaagttaaaatatctaattagacaatgaagcatcatttctttctcgggcatggttctgaaggcagtacctagcagggtatttgggtgagtctgggtttatttagcaagatatttcactgatgttagaaagtgtctgatgtgttgataagagtgttttttaattattaaaaattttttgactatctaatcaataatttttcaaatatgcaaaacaggatgggcccagagctagtgaagtaaatccagctgaacttgaacactaacttagttctgtgcagtctcttctgtactgactgtttcctttgggtgaaattcctctgtggatatgtaaaaagcctgatgccacttggtatgtaaggatctaaatccaactaaggaggttggatgaaggggaaaaaagggacccttcaatcagcatgcctactgtgttgctctagtgcctattggtgctctggaaacagatgaatgcattgtttttctttgaaccctcagaagaaggagagaaaaaaaaaccctgtgaatttttgatcagttatgaaatacaataaagtagagtgcaaggcagtgattggatttgtttcctagctccatcaatctctgtgaatctctgggcaaaactggtcaagcagcttacatgacagttattcaagcaaatggaaaatttcccaagttcctgctggctcagaaacagaagcctcttttaaagcagcccagagctcagcagtttgggtttcattgaactggtttagtggtttcaacttacataacttccatatggtaccttgaaggtgacacagaatctaagtctcttattgtcccacccaagagcagctgacatttcagggtcccttatgattacccacaatcctggagaaatcctacccctgaaaatttggacttctttctgaagaacaacaaaactatgaaattcagatttgagaaagctaattttcaatggatgagaaagcagaagagcaagtttaatttcctgcttcacatgaagtggtattcgccatacttcacctatagaccagtgctgaacctaggcagaacgcataccaagcaagcagtagaaccacatactgtagagaaccatggctggtgcaagaatcttgctttcttctgaaataaactcagagacaaataagacaattaggtgaacactgtaaactatggatagcgaggaacaatgattggtagtgactgaagagaaatttgtcattttatttttatcttatttcattttattaaaatataattccaccatttctcccatctctcttctccctctaagctctgccacacccctatctccacttcttcctctcaaattcataacctctattttttattatgtgagagagagagagagagatgtagatgtaacctgctgaatccattttgaagagagagaatgagcattaattgcctatgccttttcatctagggtaggacacttttgaaactaaactctaacagaaaccttgcctcagtcagttatgagaaggtgctgagcgtcactgaggatctatcaaatatctcactaagttactgatggtcagttttaaattttctttatgtccatgtgggtagtacttattctatcctcgcttgagttcctgaaggtcacatgactaggaagtggtggatccaaacgagctatgtctttatttaattttgaagataccacactacatttgtgtgctaatttatctttcagttgtgtggatttatgaatagtatgaataggttgaaccatcttcaaaatattggtagattgtttttcaaaacaaattactgcagaagtctttctatgtctaaacattttgattattcctttgagtaagttcctacacaagtggatatctgctttgtaataaaaatgttttaaaaagaaaaataataaaatctttgaagattttccagtgcttttatctgatgacttaggacctgaaaggcttgctatttgaatggctttaggggactcatgccaaactcctattatttcaatatggatgtgaaacattagctgtctttattacatgctatttaatagattcaaaattaggagagaaattttagaaatcagaattgtgaaaagttctatgttcaacaaagttccaattcatttctttttttattatttaaacaacttttattagatattttcttcatttacaattcaaatgctatcccgaaagtcccttatactctcctcccaccctgctccccaacccacccactcctacttcctggccctggtattcccctgtattggggcatataatctttgcaagaccaagggcctctcctcccagtgatggccggctaggccatcttctgctacatatgcagctagagacacgagctctgagggtactggttggttcatattgttgttcctcttatagggttgcagaccccttcagctccttgggtactttctctagctcctccactgggggccctgtgttccaaacaatagatgacgaagagcatccacttctgtatttgccaggcactggcatagcctcacacgagacagctatatcagggtactttcagcaaaatcttgctggcatatgcaatagtgtctgggtttggtggttgattatggtatggatccccggatggggcagtctctgcatggtccttccttccatctcagctccaaactttgtctctgtaactccttacatgggtattccaattcatttctttcataccttatgacatttaagtgagtaaaacatgtaactaaaacagaactttaacactgagcgaaacacttttgttttagaactttgaataaacacttctctaaagcattcaatgctggcgctggctcccagtcttccaggagggagaggcccctgaggcattctatattaccttaaggtataatattctaaggggaaattattttcatggaatacaagagcgtcatcacaaacaagttaagtgtcttggtcttgtagcagagcctgtcaggacacatcatcatttatttgcccctctggttccttctcttcattgtaaactgtcaaagcagtactagattgctatgtgtctgttgctaccatttgaagcctaatctaagccctctaaggacccagagataatgctcattttccaaaaggaatcattcctacatcaaatttagagatgtggtcaaagtgtgtaagacactctgaaatatctcctcctcgtatgcgttactgaaattattcttagcaccaattactcctgacaatacatttccctgacatcaacttcctatttttagtcaataatgtaacctgaagttcatgaagcattgatgaggtacctactctacagtatgtacttttattttagtgttcaacagacagagacagctacaacacctgctcaacctctagacactcatattatacagaggcatgaggatatcgcatgtgtgaacggttattggagatacatgtataaagttatggttaaagagatatttttaggaaatgagcctggaagagcaatatagagtctacatgagcatggccagcattagtgtaaaagaacagaatgggaatagatagcttgtttcatgaccatgcactttagatactgtggactgtaaaagtgaaggcgatgtccatgcctctgacgtatgcatatgtatcatctgtgtgtgttcacgtggagatgtgcaccttgttctctgccttattcccttgctacagggactctcactgaagctagaacacttgtggcttttgtagttgtttgcttgcttgcttacttgggggctgaaacccccaatgagtctatggccagtgtcttagtttcatttcctgttgctgtgagaaaacatcccaaacacaagcaactcaagggagacagggactatttagcttaaagttcctggttatagtccatttatcaggaaggtcacagtagcaggagtttgagggagcaggtgagattgcattggtcatcaagaagcagaaactatctgttcttgtttgtactgcatccaggctcagctcatgaaacagatccacttgtattccatgtgcatcttctcactccatgaacccaactaagataatccctcagaggcatacacactggtcaacctgttctaaacaaatttctcattaagattcccttgccaggtgctttcagatcctgtatagttgagaattgacattaaaactgagaactagccttgtttggatccatggtgggataatccaggattaggtcatagttaaattgttatctccacaggattacagagcaaacctttgaaaggatcactactgggagcaaagaaagcagctagcaagttactgtagatagttaggattggatatgctgaagacttagaataggacagtgggggtagagatgggttaggaaacagcagagaaatgagttccacgtggcatcaggatcctcaatggacactgaacagtagaaagaaatcaagattttacaaggctctgaacataatctgtttttttagaaaagattaaaatgattcgtctgaaattaggtatgggattcaatatttatttgaaatgagcaaagaaatcactgggctatagatttttgagaagacaacaaaagcttcaaatctcacacgcagagaaaaaaatcaagacaagcaatccatcttagtatacaagtagacatagaccatctcaattctgcctgccatgtctgagcaccttgagcatctattctagtgaattctaacttgaagaaatatggtatagatgagaaaaaatatctgagttcagagataagcttcgagcccagaggctgttgtgcttgatgatcaattgaggaattatgtcatctggatacctactgcaaatatagccttgtttgtatataatgaaatattgtcactaagaagatttaaaattatattatttctggaccaaataacaggataatgactatagctattaataatatgagtgaggaaagctattcaatgagggaatgtttggaacctttttttcatacaggaattcattcgagtgaaagtgtttattgctttttttaaaaacctgccgagtaaggcaccccaactccatgcggctgttcagtcagagtgatctctgagcaaacaaacaccaatcttgaaaccaataatgagtccatactcttctgaaatgtaattacgttttcatctaatttgaggtatctatgaggcaaaacaaagctagcaaaactaaaagagtagacaagccgtttccaattgatttaaagaataacagatattagcactgtggtcttaattcctgtgaccacccaccattccagaaagaaatggaacaagtatttttttttaaatgaaataagccatttatgcaacttctatccctgttttgagagactgaacaaatcaacctagctaagactggcccgtcctgcttctggtgggacaagttcagaacccttgaagaagtagatagagaacaacaggtaaacgcattccacctctgggtcagctgcccagtcctgccaaagaaaagtgttgtttgtctcctcagccattgtgatcttgttaacagtggtgatggcctcctgtgggtgggaacatggctaacgggcagctcagtggagtgcctgatgagtcattttcacaaagcacataaattctcttctgtggatcgtgtctggtgatggccttggcttcagacttgctcccactttcctcatttattagctaaatcccagcaacgtgtcccttcaggcagaaagctcagggttctctcagtgcgccttttataccaccctctgaacacaagatgtaggtgactgccaccatcacttccattggtgtttgatcactaaactttcattaggcaagcattgctttatttatgagtaaacttgtgcttcacagccacccccatactccaaggcttctctgcatgagctgtttcctgacagctaaggggcaatcagctccactctcctcctacatagcaatgaataatctttgcagtcaatagctcctaccactgtatcctctcatgacttgaggatgatggtaaagagtcttggtcagatgctgtttgatttgggagagtagagcaatgtgtgtataagaatctgtatgctttttaataatcatctgcatgatgtgaccatcatcttaattttatttatgtgacagaggaagaacttaaaagagggaagaacccatggtgtctgtggttgcttagtaataagaggaataaatgtggctcccgggttcatttacctcctatctggggcaggtgaaccagtgcttagacttggtcaaaggtggacttaaggaaatacacaatcttcttcgtcacacttgtggtttttgtttgtttgaaactataccagaattttttgattaagaactccttgagaccacttctttttcacctgatatgccagaggacataccagaagatcacgttagctcatcagtgatgagttaagtatggggtctgccttctctgggtcaccccagtagtagaaaagacagtagaccccaacacattaacagaaggccttttgttatctgggctcacccgtacaggagtcgattgcttccctgagctgtgagtgtttactagattctctaaagaagacatcttcattacctattcatggcaagagtatcaagctagaactgggggttaggctctctatctagttctactgtgaaccggaagtctggtcatataaaaataacttcacccttcttaatgatgttatctgaaatttattgctgtctatatgaataatttttaaaaggcaatggcttctgagcataatggccattggtttagttcattgatcttgtgcatgctctgaattcccaatgcttgaggtaagataagggtgagagttgtgaatctgtgttagtatggccagctcacggcttcagaattagggtagtacgacgttaacaacagaagagcacactctcacgtgtgctgcagtattgctcaaaataagaggagggtagaaaggattttttggaggggagttggccatgacatatttttggctatcttcaaacaaaaatcagtgtgttaacaggtgcttgtcctaaaatgatcatcaaagaatgcagtccctcagcaacccttcaggagcacatcccacttctcagatttatcggtgctcacggtaacgtggaatgagtcctttggtacaaagcaatctggaaggcagcagggtaggtttagacagtgctagtgccaagagagttttcccctgtggcattttatgggttcactgattgctatatacctccttcagatgcctttcttttcctttacttttatggaactaggggtcaaatcctgagttatttgttgctttagagatggaatatatatctaaattcccatactgatgcttactattagagaaaagtaatgcagccattctacattaaaaagtagaaatgactgactatggtgatggcatatgcctctaatcagagcacctggcatgcagaagccaggggtcatgagcttaaggccaatctgggcttcactgtgagaatgcctcaataactaaaaaaacattgaagtttggtgaggctctctgtacatttcatctctgagctgtaggatttggaacaagttgtttgacctaagtttaaaacaaaaaatggcagccatttcatagttgttgagctaacatataggagagccaaactaaaaatctgctttatgcagcagatccttctgtttgggggagaatgagaaatggattcttggatagaactcttcatcttcacgtttgatgaagaagaaagtaaaacaatcacctcttcctggcttcctctgaataagaaaatgactcattttgtttgaagtctggattgaggcaggaagacaagactaatcatatacatgtaatgtatataaatagataattccccaaatgagtaagtaaactattatcaaactattacagctggtttttaaaaagaccttaatagttttgatattatccagtcagtttccaataaggtcactgtcttagggtttccattgctcagaagagacaccatgaccaaagcaactcttataaaggccatttaattggggctgtcttattgtttctgagtttctgttcattatcatcatggcaggaagcatgatagcagccaggcaggcatggtgctagagaagttgagagttctatgtcttcatccaaaagaagccgggagcagactgtcttccagacagctaggaggagggtctcaaagtccacctcccacagtgctacactttcttcaataaggccacacctcctaatagtgcctctcactggggcaagcatattcaaaccaccacaatcattaatgtaacattttatttttatcacctctccaggccagacatagagtatgaaaggtaatatttttatagaatttgacattttgtagatccacttacccacaaacgtcttcattactctaatggagagaacacagctcttcaaggactcacttgctccagtgcctgactatgcaccctagagcacctgctttcctggctggtggagatgagctagaagatggaatgatgctgagatggcctgtggtcctggcctcctaggtgctgacagggcttccagtcactttcttgtaacatcaacctcacttcttccacaagggtagtgctactgattagagcacaagaaggcccaatatgccttgttgacttagatattgttttgactttttgtgaaagaactttggctatgtttcaaggacttgctttcccccctacttttcttctctcctccttcctcctctgttcctttaacctaattcacttcctcacatccctgagccatggctgcttcctagaactgtgaaatcctatcagggatgcagtaaggagtgtgatgtgtgtaaggtgacattaaacacatatgcacagttgcaattctgtttgtgtgtcactgtgattcagtgtatcaaattagaaggtgctttctggatccgtgacactaagtagttcttcgggatgaactgagtattagtcaggccttctttgagtgtccaggacgttctgggggacagcatcttcatatgagggggcacacattggtccatagaagcataagggatacactcagtaattcttaggcaagagactcaatggagcaccattcagatagtcaatctagaaaaaaatttctatcattttttgagcccattttagcctctgtttccctgccaaatgtgtcatgcaagtatatagtctgggtttttttttttttttcaattttcacctcatttcttaacagatatttaaatagttgaatccttttgtttctgtttctacagatatcttagtattcttataccgtgagcatctataaatgttcttatgtgaacatactaaatgtttgttgaataaatatcagtttctcttatcattaggaaagagaataatataagactctctaggccttgcaggaaccctgagacagactcatcacctccggtttcagatcaacaagtatcaggatctacagtattaaattttgatggctctgtttcctaagtcccagccatattccaggagctatatgtaccttaattatgtatgtctcagaatatcctagttgtagttggtatatttattattctagccatttagacatgaacaaattgagaaagccataaatagcctgaccaaggccacatgataggtgaatgttaaactggagattcaggtccaagatggccaatggttgaaagcactttccgctaagcctgacaacccttatcttatctccttctaaacagtggaagcagatttctgaaaatcactctctgacttctacacatgtaccatggcacacttacacatacacagacagacagacacacatataataaataaataaataaataaataaataaataaataaataaataagaatacataaatccacaaataagtattaaaaataaactgagattcaatctagatagagtacttgaccacatcagctgatcaagacacagggttctaagggatatgtaatagggatttcagagctaaagcaaatgaaacagttgctcatactagacccattttaaagactcaaggtctcccatgacagaaggttgtgttgggtttgagtttgactcttgtgaggagacttctaagcctacccctttctagtattattatgttcctggtcattgtatttttattttaaaagcacaaacttgatcatggttttccagcttagaatgataggtatttgcatgctaaaagacccaatgaattcacttcaacaggaacatgggttcatatatctactatgattatttaaacccagctctactgatggatagttggaatatcaaacgaaagagggtatttggtatattccctatgatatcacagatctggacacatgcagagaaccactgccattatcgcagtgatgaacatgtctctgaccttgagaagttctctgtaccctgtgacattttaaaataaggtttagagagctactgtccagcatatctttctgttaataccaccgcagcatgtacttcaggggttgtaagcgaagtactgagatccatgctatgatgttgcttagcttcacctggtttgtcaatccttggagtgtcatcctggacacttctttttttcttaaactttggtttctttcaaaaaccagttcctctttgtttataagtcaccgcaaacttgtagtgtagattggtacagtccagtcacctcctgaatgacagctttctcatgtgcaccctccctcaacttctccttccttccctatgtgttcagaacacataggactggaatgtgtgttgtcagcattcaatgtccacaggtgccctcagctgcctcctctgccaatattcttcccgggctggtgctttcagtgttgtttcctccatctcatcccctcaaatccccttagtcattctcatctctctacagcacagtgctggtaaaactgcctcgggatttgagacaatagaaattgatgtagactggtgttgtcatggctaccttcacagagatggtattaattgagctgagtgtttgaagactgtgaatgatttaggtgaatatcagggatgttggaggtttgactttgcttatttagactttgaaaagagattatagtctaggaactaagacatattaagctaagtttatttaattgaatgaccttaactgcaaacagttcagccactggcaggctttaccaatttttcaagtcgctatatttgaaggtagtttttcatagacacaaggtgactcaggtgtttaattgcagtgaaggtagactttgtgaagaacatatttgtataagatgtagaaggtgaattacttttggctagtacttgctcaatttctttgagtctcaaagaaacagtagaaatagctaacacgtgttatgaggataacaaaagtaaaggttgaattaattgccagctagcaaccttgtgcatgatagatattattagtcttacctaaagagatagtattctagtccctctaagaagcctctgcttctctacgtctgctgaaggatgtccctctaacaggatggacaaataagcgtcatactctggctggaagttgttatttttagactcttcccatcccttccctccgtagcagcacagtatttggctgaactggcatttgtgtaggtgcccttctgcatgcctcagcactttaactttttaaaagatacctttccacagagagtggaatgttagaaatctgaacattcacagtagatacagttttgagatgttacttcaaatgatttaactaagacaaaaatccctcactggtatccccagccaattgggttttagttaattccagacaaatgtcaagttgacaaacaagaatagccatcacagatcgatagacaaatacgtacatagagagataggcaggcagataggtaggtatgtagatacatagaaagaaagaaagaaagaaagaaagaaagaaagaaagaaagaaagaaagaaaggaaggaaggaagatagatacatagatacatagatacatagatacatagatagagatagatagacaggcagttttaaaattcatctttattattatactataggaagtaatgactaacccttgaagcctgtgaataggatagtgtacttattagatgggatttagcatgtggacctgaagatgggaggtttatcctggattatccaagtgcatatagtctaatcacataagtatttaaaagtgaagaactttacttaaatgtaatcagagagacatttcactatagaatgcacatattgctttgactgtaaagatagaagaaggcagccatgaatcaatgttttctttcatttgtagttcctagattttatgtagtcagatgaaatcatgaatgttatgcatatatatatacatatatatatacacatatataagtatatatatgtacacacatatatattgatatatattgatcagaattaggagttaaactgtctggggaaatcagagaaactaataagaggagggataagaagggaagagaaggggattggagggagggagaatatgaacctgttagaatacttaaatataagaaaatttgaaaatccagacagcatctacacaggatggggaaaaagtttttgccaagtgcacatccgacagggaatccactgttagactatacaaagactgtaaaatatatacactacttgccccaatcatctaatcactaaacagggaggctctagatgtgcagcaacagacagaagacaaatgaggaaaacacagagatggtcctgcctttgactccaggaagagcacagctgtgttgacactttcatttctgtccagtgaaacctgcatcagatttatgaccttccagatttgtaagaaaaaaaaaaaaactcggtgttgttttaacacacttgagttggtctgttagagtggcaatcaacacaaaatggaatcatgtttagtttcacgagacttgaagaatggataggtttttgctgttctgaagtcatgtgtgttcatcgtgagacattggtaatgaatatttgaattaccctcctccccccaaggcacgttcatgtagagccctcagcttgctgtgccatgggttgacctggaacttcgacccttattctctggataactgtctgctgggtgcttgggttttactgggaagttgttacatgctagagatgctgcaaagaacaggaaaatgttcccagacgttatcattgtgtcacggagcggtcctgatttactttgctgggtttactttttatatggcacattcggggtggacaagaatccctctcctcttccatcatttccacccaacgtcactccatcatgtttgcgacaaacaaattttcggaagcagaggcctttttttgaagctaatacatatatcctcaaatgttttagtgtttccacatataacatggagttgagagagctcttttttttggatttcttacattgcttttaagatactacttataatagaaccctggagaatttaatacatttttctagccaaaatggcagtgagcaaggaaaaaaaaaaaggattccaagtctagacacacacttgaatccaatcctgacttcagaaacagttttaagtaagttgttctgtgaaaattaaatcataaatgacagatctgccaagattgattctttcactactatagcatgcttcctgaatgtcaacactgcttatttgattcagaagggaccagagccagcaaattatatctgtggttttcagtctgccttcatttgtcacagagcttgggagctcctggattaaatattgcaggattaatgggcatattctttcccagtgttttgttttaactactgatcctgtatgcattatacaaaagtcatggaaaaaatagaacaggactcaaatttcaagtttcaccttccataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagaggcaggaaggcagggaggcaggggacaggagggcagagaggggcagaggagcagaggtaggtgggtctcttcgagtacaaggtcatcctggtctacatagtgaatcccaggcaagccaaaggaattaatgtgagaccttggccacagaaacaaagaaataaaaacatctgaaaatgtctcatgataaattttctatcgcatgtttatgaaaatgagactgtttaaatatatgtactacgtaaaatgattattaagataattcttttcatttctttttattattcaactaaggccactgggatgatttacaaatcatgcacttgttttgtctctgctgggcagggcagttctctaatgaggctggccattgtgtggtaggagaatatagaaaactgtacgtgggtacctaaaaaacaggtgcaagttaggtctttctgaagctactctgtcctggttcttgcatgtcttttaaatagagaatatcatgagtgacaaatagcaagagaaagaggagaatatcaccctacaccatcaaaggaagtgaacaaatctgacagagggatgggggatgggcaccacattctggcagcagtaaccaggttctttgtccttctttatcaggaaatatctagaaactgtcctttgaaaatgatacagcctttttaatccccagataaaggtgacatggatctctcaggaataaaacgaattctcaggaatatgagaatgacagaattcaaccttatctaaatgaagaagggaagcttgggcagggtggagcacaaatcccaacttcccttgtctttgaacttgacagtggccagagttactgggtattgtagaatttatcactgtgtggcagcactgttcacgaagcatggagaagtggttgtgtcagggccattttttagaaggtgagttctgcctcgattctcaataagaataaaggaagttctacttcctttctgttttgtttgctggtacatatgtgtgctatacacatgccttgctcccaaagagatcaaacagggcctcagatcctctagaaccggagttttgaatgtttgtgaaccactatgtggatactgggcactgaacccaagttctctgcaaaagtaaaaagtgttcttaaatacagagccatctctccagctctaaaataaatctttaaaaagagcatattaaaacgtactagtttggggctggagaggtggctcagcaattaagagcactggctgatcttccaaaagacccaggttcaaatctcagcacccatatagtttcctgttgaataggctgtagacagacagaaagacaaaccacatgaaagatagatataggtggagagagttgggtcatagttttctacctttttacccgatttaagttctttttttttttcttcttttcttacaaggcttagctgaaaagcactatgatattgtgtggaactggtgcaaactagtattacctcctatcatctgagtcttactattttccccaagctgatacatgaacagaaagcatgacctgggtcttagcaaaaagggagagtgtggcaatagcctttgctgcttatgagcctctgcctcagagagaagttcctaattagctccagtttgagacaggcacacaaggtgcattcatttccccaaatgggtctttatatgtacagaagctgaggcaggaggttgctttttttttttttttgtctagttttgcaaaatgttaaatatttgggcatttttatttggtaattgttaatattctatgccctgacccatagaagagggatcattttgtccaagttcacaaatctaaacactataaaattttcattaaaataaaaaggagataatcaagattttttttctaaaaaataaaatgcacttctctacaccacagatgaaattcattgagctaatcacagactctgtagaagctaatatgcttacctgagtgtcaggccatcccataaaatcttagagagctcactagtttgaaaaacactgagagagacagtttggcgttgtagagaattctctccaagcactgaaaatattctcagatgaccaaggaaattcaactcagcctgaatgacttgcgatgcattagaaaggagttatgttaaaggaaaagaagagttctttcagctttccaacagagcctcccaatgaacagagacaatagtgaaatccttggctcttgaggctgtatttgttgggctaagaagggttaagtagtgagtgacaatagtccataatgcacctttagaatatactgtaccttccagtcttatgtacataatagatagaatattagcaaaacccactttcagtgtttagattctatgtggtcaatgatgattaatcacattccttttctaaaacagggtgcttcagtacctatgcaattatccatcacaaagctaaatggtatctaattgagtatttatttaaagctgtttgtattataattatatactaccatttgcagctgtatagataattccttcctcagggcagtgaaggacatattcatcagtaggactctcatatcccagaagagctctttactgagaggtgaatatagagaaaaggctgtccccattgcatacaccagcaagattttgctgaaaggaccctgatatagctgtctcttgtgaggttatgccggggcctgggaaacacagaagtggatgctcacaatcagctattggatggaacacagggcctccaatggaggagctagagaaagcacccaaggagctaaaggggtctgcaaccctataggtggaacaacaatatgaactaaccagtacccctggagctcgtgtctctagctgcatatgtatcagaagatggcctagttggccatcattgggaagagaggccccttggtcttgcaaactttatatgcctcagtacaggggaacatcagggcgaagaagtgggagtaggtgggtagaggagtgtggggaggagggtctgggggacttttgggatagcatttgcaatgtaaatgaagaaaatacctaattaaaaaaataaattaaaaaaaaaaaggctgtccccatcccaggaattgatagccctgttggggcagcttgcctctatccagacattattaacacaatgatcagccagcatcatttagtgtttacttgtgcacagtgctccaagtagataccattcattttgtaccctaatggctttgtatgtttgacagatacaaattaaaaccttcacaaaattgtgaaaaatgtgtccagttccttagtgggaatgacaaaatgttagtccaagaaaagaaggtagacaacatttctttaggtagttttgtgctctgaccatcctctggaattacgtaatgtggcccttttgggactcaaatgatcctttcacaggggtcaaatatcagatatccagcatatcagatatttgcgttatgattcataaaagtagcaaaattacagttaatgaagtagtaacaaaacaattttatggttgggggtcaccacgacatgatgatctgtacttaagggttgcagcactaagaggtttgagaaccccaagcctatagattaaaaatcttactagcttctgtaacccatactggtacaagtattcaaaggtgatgagtgctgttgtatgtatgtatgtatgtatgtatgtatgtatgtatgtatgtatttatttggtaactctacatgaagccaggcaaacactagtttttctttaatttatttctcaggctggtacttaattctcaaaagctcttaagttcagtgtctgtaaagcaatccaaatactatactgttgtcctgatccttgtaaacaggttggccatgcttagctacagactcacaatctaaatgctgccaggttttacaaatcagtgctcttcctaatattacagtgagttgcaccttagaaaccaatgtcatgagctgcctactttaacaattcaatttaatattctacccattcattcatccgcttgtaccacagtcattgttatctaaatgatgacttaagaaacaatcattttgaaattgtagacttgtgatgacagtaaacacaaagctaagaataattgcagaactgggacctgactgaagcaatggagtctgagtgctgtattctttttggtggggagacacagagtaacatgtattcaccacacatagggctgacagactgaaaaacagattccatccaagtccaccttaatgaaccagtaaatctctaggggttgctaatagaagcctagatgaggggctaattgcaggatcatgggtgactcaaagatagctgcagcactgaagaatctcattcctgcctcgggctatgactaatgaaagtgtcacccaagaaatgtcccagtctctagacaaccctcttttcctatgttctctagaacccaccacatgcagctggacaggagggagtgacatctcagggaagggtagggtggccctctccccacttagactaagagagactctaaacagcatcattactattaccttagagctagctatcacgatcactctctgcttgttggcatgattgttgattagagtataccataggtcattgtggcaactctgctttgtgagagtagatggctgttctgcagccagcgaaagttaacttcactataccaatgggaacggcttcaagacaagggtgagcaggaggtacctgagtcaggagtgaaagggaaaactattctttacagaagatagaagagattcctttataataatgtttaactgacaccaggtaattaagcaactggttaaaatgttactgcatagccaagactgggccatgtgccaaaggaactcaatttggaatctggaaaatagaatgagttaaagtgacctcttacaaaccttggaaactagcacagagaaaatttggtatttgattttcattgaactcctaattggtcaggattgatatttttataaaagatgttgcaatcagaatgttatgaaaactttgatgtttatataaatggctttcagtgtttctgacagggacacttttcaagtcatctttaacagacactgagttataaaatccagtatttaggggtaattcaaataatagattgagtttgtttaattcagatcaaacccattgcatattctattactctgggatctttttcttcttgcaatggaagaaatatgtttttcttttgtgattccagaatggtttatgagactagagatttgatcaagaaatgtttattaaaagatcagttgtgtagatagatgagtgaatatcactaaatatataaaaactcttgctctcatggggaagttgctacacattaaacagatgttaaaattatgaattctgccttgactcgttgcatacacattctatatacaaaggctgtcagaagaaccttgtttccatatgaagtaaaaaccttctaagctcttaggccctggtaacgacagctgctccagagcaaggcgtttggagagaatatcttatttctcaaacaattcaaatggtatagctgagctctgaaagtctggagtgcagagcacctgcatggctgctttccacctgatgcttgcttgcttccattttacttgactgtttaagatagattatgccatgtaacttaggcatttgccagactcacgtgcttcctgtctccacctccccaaatgctgggactacaggcatgtgcttctgcctctcttctcaccccaccctcttttctgagagtccaggagtgtctggagtctgtttttgttaacacgactgtgactttgaacttcctgaggcactaagttgtctctgtactactttgtctcctggttcccttccaaacttggaaaatgttgagtacttggggaaattatttaagatcttgacccagtagacacacacactttgctaagcctgaggcaaaaggaaaataagggatcatgcaggtgttcattagcaactctgttcacctcgccagcatttctcatgggatctccttcagttctttccctgccttcagttttctttgccctgggtgtcgtagaattagctaggtattttgcccccaatgtcccataagccctccagctctagtggtactatctaaaatactactatggaaaaaatttcaagttctatagagacttaggaacaattatatatattggatatatataggaacaatgtatatatatatatacacacacacacatatatatatatatacatatatatacacatatacatatatatatgtgtgtatacacaaatatgtgtgtgtatgtataattgggcaaaacagtaaagtgcttaattttttcattttggaatgttcatttctcaaaatttaaaataggaaatttctaaatgtgttaaaataaatgaactataaatacccaaatcaaatgctttcatagaagatgttcttacataaagcatgctaatccatttcatatgagtttttctgaaatgggcagtcctttgctctttagttagaatagcgtttggaagcggacagaatggacaacaggctgttgctctactgaaagccgagacagtggttttctcctgagagttatgagcaatctgtgcaccaagcctgagctctgatccaatggaattagattttcaagtgcacatttacctgcatttctggtttcacttaaaatcacttctcagcttttgtcagtgagagacacagctaagactgaacacagcccacatggtgctagtgagttgaagctaatgaaggaactggcaatgaaggcatggttagtgtgccgaacaaagctctggttagtgaagagacaccaagaaaccaacaacagtggtaagaagtcagtttgcagagacacaaagtaaaacagcgtcgctgggaatactctgaagccaaggagatgggccgcccagcagagcgtgcatgttggccatgctcgttcaggaaatagtggagaaggattataggaaagcaagcctgagcgagcccagagcctaggactcaaacaccaagggctttgacatcctttacccttcggtttcctgcttggggcttaacgtaagtgaactctacagggaagccacatgccatccccttagtcgatcggcagtgtcctcactggtccatttcctccagctttactgttttcttgcattttgaaaattaccgtattcctgtacatagatgggaccataaaagccatatagttgcagcatgttattgatctactggactctgccgtctggtctcctatccatagtacaatgccacactgcatgtttaactaagtgccaactcatagctatgagttgaatttattaaaaaaatgtattctgggactagagagatggctcagcagatagaggcgaatgctgccaaagctaacagccttacttcgtccacatgacccacattggagaaagagaacggatttctgcaagcgtcttctgacttccacacaggagtgcatgcacacctacactaatgcctcatacactcatctatgtgcccccacacaaaaacaaataaatgtaacaagaaaaaaaatgttgttctctgaatacactgcatttcttcactgtttctggccaaagcagagactaaatatttttttcagagatttttgcagttttttctagaaacctaattttgttctttctattttacaactatgcaatgcaaattttgagaataaagtgaacattttgattattttttcctttttttaaaaatgtattctttgagaatttcaggcagtatatttatcatattctttcccatttccacaacccctcccagagcctccctgttcctgcccacttaactccctctttttttctcactctcaaaaacaaaaataaaataaaaacgccactaaaaaccacataatctattttagctacttctgagaataggaccacactaaaggatggttgatatatccagttattctagggaagaaaattgattttttttcctctttcagccactttggttattttaaataatgtgaaattagctggtcattttattattagcatgtaaaacattcttatgcactgctttagatttctggagagaactttaaaaaatacttccagctaaggtccagcattaaccagaaagaccatttacaagatgatatagtctttttagacagtaaggaaatcttggcgtctcaatgaagaaatgaaggcagagatttaaatctatttttaatttccatcaatatttctcatacttggaacaatagatttattagagcagcagttatcaatctgtgggtgaggacccctttaggggtcaaatatcagatatcctgcctgtcagatatttacattatgaaaataacagtagcaaaattacagttataaagtagcaacaaaataaatttatggttgggggccattacaacatgaggaactattataaagggtcccagcattgggaaggttgagagtcactatttagggaccaccatcatctctcactatatttaagttgccatttatcttaagtagcagcctgagtccaaaagtattaaagtgtgaaaaaaagacatgttttagaattgagaagctcatggaaatggtcatgtgggaattatccatgtatttaagaaaaacatatgatgggtaaatggcttatagtctaagagttgtaaccaaaaagaaggaaaaatcaaaccaggctgtctagtttataatttttgtagtctgttcttcttttttccaatagactctttgttccttgaagccaggacctgtacttttttgatactctctgtagtgtgcttgcagaattgtttagtgacctactctaacctcttttacaggaataagaaaagtgctaccctgtcctggttacctagttggtcacaagcagagtgatagttgaactcccgttcccaggttcttagccttgtatgttgttcgttactcaaacacttaagatttacatacattcacagtttattctcccaagtacccaccccacacttaagttttcttgtaattagtacaaaacaggcttcgtgatgtgtttctgtcacctataggtacctgcgtgtatcttcacctcctaggacctttatcaaaggaatgcttcactcccttcccgctatgttaaatgtttcatcctatattcttgtgggtatgcttcctcttccttctagcaactacagagatgtgtggatgacatagacatatgtatagatatagaggtatagataaaaagtagaagtaatttgcatatttgtttgcctaaacataaaatatgtgcaaaccatttgcttttatttgcatttatttgcaggttctgtgctgaatttcttcaggttccatgccgttcttgggtgtaatatgaattccactccttctccctcccttcattacccaaatatacatcaactaaacatgtagacacatgtgagaatcatgtagactcagtgagattcagacagggctgtgaattgaacacactgaattatctttccttttgtcctaatgatttcagtcctaatgtgcttttaatctactctgtttcactgtaattctgcaaattaacccttgtgtcattggttatttggaaagaaaaggcttgccctgaagtgttgtaaatatcttgagtagtagttattgtacaaaattcctaagtgttcaaagataaaaataatattcaacataagtaggaaataattgggcttctttttgttgaacaaacaaagctgattttgactttgcatttaactgctacactttgacactagctttgttgacatggcaatgtagatgcagtgcatctgcattcaggaaagtgtaaattaaaattcaaagccctgggtagatttttatattcctcaaaagctgcagaatataactattcgtggaagtaccatttggctttcttcatcttaaaaagtaactttttcatgccagccaacttttggtttacacacacacctacatgcacacacacacacgcatatatatatatatatatatatatatatatatatatatatatatttttttttttttcctgagatgggtttctatgtagctatttactacatagaccaagctagcctcgagttcaatgaattctacctccccctgctggaattacaggcataagccaccacacctggctaatgacttcatatttgtagctttattttcctattgtttgtatatgttttgcctgtatatgtgtatatgcaccatgtgcatgcctggtagccacagatgccagaagatggcatcagaaccccaagaactgtaagtatagatggttgtaaaccaccatgtaagggctaagaatcgacaccagatctagcaccaacttcatattttaaaattcaaatcatattcaactctcccctaaatagtctaaattttaatagtactgaatttgaaatggatcttataatcgagtttgacccactttaccttattaaattaaattagtttcatattttgtaaccaattcacatatttggattgagaaaatataatcatgatttcttatgttaatagctagttcactgtgaaaagaatttcagataaaaatatagaacttttatttaaatatagtatataatataaagtatactccccataaaactattttaatctatactaaatgggagcattggatgtaaggggagaaagaagataaatctatcatcatagagaatgaagagccaggtgagatcaggacacagatattctccactgttttggttcatcttcctttatcagaaaagtagataacttcagctttatagtagatataagagtatatcctgcggtttagttagctataagtaaattctgcttcaaagtgcagctaaatcttttgaattaaaaattgtgatgctcttgtaaggtcctaaatgaggcttttttttttttcaagtatatcagaaattcatacaattttgaattctacagacaggtgccaggagtctcagaaccctgctgagaagcacaggaagagtgcctgctgagccagtggtgtcctatctagaactaatttccagggacggcgatttctatttgatgatgctctattcttacttggtttctgctgaatcataaagttgtatcgggagtaaagttctggtggctagtttcgtcaacatcctgcacaattcctattgttgtgtgtttggtggccaattaaacgataattttctgtgggcatcttcctgttcacatgataccattcacaatgtttcctctattctgaagtcccagttgggacttatttccatgtgatgaaatcctagtcaaaccttaatgtacaactcaattgtcaccctctgattccattatttctatttaaaactctttttatttaattacaatataattatatcatccctccttctacttccaacctctcctttgtcatcccctcccctttaaattcatggtctcttattttacttatttatttattttgttacatattcatttgaataaatacaaatgctacctgctgagttcattcagtgtttctgtgcattttttttttaaggcacagcacttggaattagataaccatttagcaagtatatctccagggtcaataattttcttgattatttagtattaattcttggtaccattttgtcctattttcttttggtatttgtttaagttatttttgcatcataatgattcctaaatggttccaaggcatttataattctggtattttttttcagtaggattcatacattatacttgaacataaatggtatagagataaaatgggcttgtactctgtgctctccaaaatctcaagtctaggccggatatggtagtttatgtctataatctcagtatttgggatagaatccagcctaggctacacagtaagtttcagatttccaggacatcctgggctacttagtatggcatggtctctaaagaaaacaaacaaaaacataaaaagaacagagtagaagtctagggaggaaacacttcctccctctacacacacacaccctctgaaatttgtattcttttttttaatattattttcagtctctagctccttgcccgtgatgctgtgcttgatgtaaagccagcctagggcccacttctacatctccacacgagcgtttcctgactctcataccataaattgcctggctgttctggccggcagcagagagcaaataaagaacaatcggtctccacagtttaggctaaagctataactaaatccactttctgtacttcatgtcactctctcaatgtgggtaaggcagctggctccgggctccgatgatcaaagtactatctcgatacaaagcggagtttcgtggagtgtatgtagcacggcaacattgaagctcataactggaaaaaaaaaaaaaagtggaccgggaaaaacaaatttaggaggaaattaaatatagtgtttaattttcattgtcaagttgactaaattttgagttgaatcatgtaagagactgatgaagcccaccttggcaccttggggtgcatctgtgagggagttcccagggaagactaactgggggtggcaggtggaaccttgaacatggaggcagctcccctgggctgggaccggaagttaaaaatgcaagaaggaaagaataatgccacccaagctcagggaaatgacatttctgtcctggaggtttgacctgaagtaccctctgctgtcaagagggactgacccctgagaaaccatgagcccaaaataaccgtgcttcctttaaattgtttgggggcggggtgtggccatggtaatgagaaaagcagcaggtgcatttaaccttacaactctttctttgttctctcagctaaaccctttgagtgagcattttcctcccttgggatattatttcctagatgtgtgattattaagaaccaaacttaaatggccaacacaaaacatactcaatggtatttttgggagggttttgcttttttgtaacatagtactttgtctaggcattggtgttttaatcttatataggccttttgcttataatatcatagtttttgattttgtgtttttatgggatttctctgtgtgtgtctctacaaccgtacgtgtttcttatgtgttttttctttcaccttcttctgtttttgtttgttttatcttattctagttttattttatttagacaaagaaaatgaatttttatttagataaaataatttaaaaatagtctgttttctaatgcgagagagaaagaaagggtgtggatttgggtgattggcagggtgcagaggagctgggaagaactgggggaggggaagatctgaccagaatacattgtatgaaaaaaatctgtttcaaagagaagaggaagaatcacacttaggggcttgagagattgctcagagcttaggctcatatgtttcttttccagaggagccaagtttgttccctaacatctatctagggcaggttccagccacctggaactggaacttctggctccagaagatcccacatcttctaacctcatctggcaacagtgcttttgtatacatacacataattaaaaataaaatacttaaaaaaacagatttgctccccttataccctaaaactctccgatccttattctctgccatctaacctttacctgtgtctgtgtgtgtgtgtgtgtgtgtgtgtgtgtgtgtgtgtgtgtgtgtgtgtatgggtgttcttgtgtgtactgtgtgcttttatgttggcttacacagtgaaattgaaatctacatacttcacacctatattgtccttagtcccttttcatgtttctatacaggtttgactgacaaaacaaccagagaaaatgctaaacctacacatggagacacagagcgtctatatactcactcctttaaatgatctgtctcatgtgtgtacaacagaacgagattgccaatccctttggggtcagacacctccacctactcttaatcaagtccaggggtgtcacctgagtgctgggaaatgtggtgtggggttcatcctgtgaggattttcagttgggacagatgggtgtgctcttgccgttgttgttaaggtctaagtagacagagaaaacactctgagagtggaggtgacagatctccattgctggagagggcaaaatggctttatcagtgttcaaaagaatgtcagagaatcagtagagagagtgagaatctgagggtggtcggaagatataatgcaaaatcttccagtaaatcatttgaaaatagtctccatagtgctggctactctaagttcatattggccaagagaatgtcaaattttttcctacctgtggagatggtggatatttaggctagggaaaaggtaaacagattcacatttccatagaaacaattttcgcaaagtattgatcagcaaatgaattaggagatgagaaagaaaaagaccgttgtcacggtaacaaggacattcagagccatgcatctaaagagatgccttcttagaataaagaattcagagttgctgcaacttgatgcacaatagtttttaatattcttaaagagttaataaaatttttctgacaagagtaagctgtattcataaagttaggggactttttgctttatgattccataaatatgtctttttctaattataaaattcatttttaaaatctatgatacagtgtgaaagatcatgatgaagccattttgtatatttcatgtatgctatacttctttttcaaaagtagaattggaatataagaacccaaaatcctgtcacttattcaaagatatttgccaagtctgtggctgtgttgcttaggagatggcaatggaagccaggctgtgagccagcaggcccaaggttacatcgttgaagtcaccaaaaggcacatggaatctcagctccatcctggaagccctggaacttctatgtcaggtgtgaaagaatggacataaagccatctcaccgaggaagaagagtataaatggtgttgcttaaaagtttggaaactaggggcgaacagatatcctattccttggacagggttggtccttgcaaaattggcactttgtgggaatggaagggtgacaggtgtacatttggagcagtctggctgggatcagaggtcaggcatggaatttcaggactgtcagtgcatgatgaggtaaaacagtctgggtaatggggaatgatggatatcaacacctgccaatttggccttggggctggtgatgctttctagctccactgtcccttgggagacagaggaagaagaatcaagtagccattgtcaccagaggcaaggggtagtctcaaggaggcctttatggagggttgcttgagtgtgggattgaggtcaacctggacaacaatggatgagccctaggtaaaaccaaaagaaagcaaaacaacaacagaaaaaaaaatgaaagaaaaaagtaaaagatagaagaaaaaacacagaccagtcaagtggcaccctcgaaaaatttcagactatagcaggaagatcacaatttgaggtgaaaaattgtaacactattatctatctaaaagtaacttgattgaattttcaaggttttgtaaataagtaattttaatttaaaggtgtcagtgagatggaatatgcatatttcagaaggtggttagacttaaattcatgtcttgactctttacgaacagactcagctttcgagagtaagagttttgggttcacatctagatctgtagctaacttcttgggcaaaaatgttcagtttctacaacctcaactcagtcctccagggtaagacttagcagctagtacttaggtagggaagaaatggttcaatgtacagtttatcctcactttgggattttagtcaatgacatcaggctccattgcaagtcattcaatcaccctctgcattccaaaatcatagatgtaggagcataaaaggtatattagatgttgggttccacccctccaaggcctagcaaaccaaaggatgccaccagtgaccatcaagttcttaagggagctcagatgagagatcccattggtgatttgtcctgctatggagatcataagacagtcaaaagtgctcacaatctctctgagagtcaggtagcaacctcagttggtgatgaaaccctctatgttggagtcagacaacaacatccatttttgaacatccactttatgggaggaagatgcaccacccaattgcagaaaaaaaaaaaactgtttagtgtggtcaaatgacaaactctggaggcaggatatctatagaggtcagaggacagcacccagtattgaagaaagtctcaatgttttaatgatttcctttagtaactggacccaataggggagtggaatcctttattcttcaagttcttttttggccccaggacaaactccagaaagctttttagctttctttttactctagagacagcttctcatgacccagggtcttgtgttcctgaagaaaactccaagtttgaagctttacttctcaatataccaggattgtgagaaatcttacacagtctcattacctcagagcccatgtgaggaagcacactgaaaaaaactcctctaagtgcaacagagctgcgtgtatgtgtaagttcttccaatcaggtgagctcaccaggcacaggaagaagagcaacctggatggctcttcctgaatgcaagtgaaagaaaccctttgcaagatctcatgcaagaacaagtgtgagccagcgctggaacctgactgtccacaaggaatatctgccccactaaacttatttctgttacaccatgtctgttgtatgtcacgaggaaggagaaaggaaacaccagtgggctttgtgaaacaacagaatctttcattattcccaccacataagcagaagcactgattgactgaggccaccatgcaaggacgcaggaactttgtttcttctgacagcatcgagtgtggcctgaagcagggttcatagccataaaccccacaagcctctgagtcaagttacagtttaatttgtgccaatcagaatgcagggattaggactttcccaagtgttctatcagtgtcagtcgacattcagttaagtgatttgcccaactaatcaaagttgtttgttctttctgttgttaggaataggcattaattatgctttgggtaactatttttgcttagagagggattggtaacaggtaggttttggggaaattattgttgcttggagagggagttagtcagcttaggtaaaatggagtctaaagtcaaaatggcagtacttaagacaagttcctttaatctgtcctcaacaatttcattctaccaaggacattgtcaacacattgtaaatgcttaaagctatttgtgaatattaaaagctagaatagataaatatgcaacatctaccatataaaatggattatttggtattttgcaaaagtgaattaattttttgcccaaggatcttctaagaactcacagatatcctcctgtctctgactcctgagtgctaagattaaaaggtgtgttccataacagtaaggcgagtcctttaatcttccttttctttaagatggctagtgtaatgatgtttacattaattaaacttccatattggtttttaattgtactgaataactgcaacaatagaaatactaagaaatagtgaaagaatagcaatggaataatgtaggcccaatttatcttccctcttttggacttgaatagtgttatccattttaggtttttggtaatatatggctgctctggaagtcacctcctataatccaaagatgcagttctatttagtgcaatatgctcatagctgagaaaaagcagaaataactctgcttcccataagttgtatctggtgatttatggtcacatgaccagcaaaggaaaagtgcaactgagtccatcaacagcttttttctccacattctctcatgaagacagttgtaaggtcactttgttccttagtggcttattttccccattagtaaatattaaaagccacattttcatttttctcctcaaatcctcaactatgatattttttcatgtcttcttatttgtgtgtgtgtatgtgtgtgcgcttaggtgctctgtatgcttttgtacattttgttctatgaaatctacatgtttctcagctacacttattgatatatgaaagaaggggggggcagtccctgtgtgaaccagctcagttagtgtgtctacagacatttctctttccctttgggaggagagtttattttagattttcagctggcatgtgtgagtgttcttggtactgtgtatagctggaaactacccagagggaaggatttgatggtggaagagacaaatttgtaagctggaagggaaatagagttgttggtgtccaagggaatggagaagaaggggtagagagaatagggacctcggggtggttggaaggtgagaagagaggcaaaaggtgccaataaagcctgtgaaatatccccagagggctgactactctgagatcagcttggatgaggaagtctaaactcggcttcaacggtggctaaagtggatgaggagcttatgggaaaggtgatcagattctcctttacatagaaaaacttacatcaaatattgattaggaagttagcaaacaggaaggaaccaaagatggttgccatggaaacagacaaacaaagccctgcatctgagagactccttcacagaagtgaaggataaaaagtgataatcctgcttagaagggggaacaaaatacctatggaaggagttacagagacaaagttcagagtagagactgaaggaacgactatccatacagagactgccccacttggggatccatcccataaacaaccaccaaacccagacactatggcagatgccaacaagagcttgctgacaggaacctgatatagctgtctcctgagaggctctgccagggcctggcaaatacagaagtggatgatcacagtcatccattggacagagcacagggtccccaatgaaggagctagagaaagtacctaaggagctaaaggggtttgcagccccataggaagaacatcaatatgaactaaccagtacctccagagcttcttgggactaaaccaccaatcaaagaaaacacatggtaggacttgtggctctagctgcatatgtagcagaggatgtcctagactgtcatcaatgggaggagaggccctaggtcctgtgaaggttctatgccccagtataggggaatgccagggccaggaatgggagtgggtgggttggagagcagggggaggggggagggggttaggagattttcagaggggaaactaggaaaggggataacattttaaatgtaaatatagaaaatatctaattaaaaaaagtaaaaaaacaaaaaaaaacaaaaaacagacaaccaaacaaacaaaaaaccacagtgctacaccatgccatactaatttttactgttcctaagatttttttttaaaaagcagggtaagttgtatttagagaaattcaagggttattcttgctcttcactctactaatatatttaatgaccaaaaattcaatgtaaaatatggtataggtgtgaaaagtacaagatgaagtaattttgctgaaatcatatatgcaatttttttccaaaagaaagtagaatacaggaagccaaagcctgtaaatttctcataatcatactttgcctctgtgtgactggacagcttaaaggataagctatggagtgtgcctgcacatctcaggcacttagcttaacagcctgcttctgagaacctctgaactcccatggaggaaaaaggctgcatgatatcgggtcaccaaagagctaggacagggtcagttcaccagaggaaagagggagagtggtgttggagagagcatttaaggagccgtggacaaatgtgtcactggacagatattttataagaatgggctctgtggtgatgaggagcagagactgtgcacacctggcctaatttggaattggctgatatcacacctgtgattccaagagagtcagtccttggtgaggtcagcagtcttggaggatggagaggatgacatcaaaaactgctattatgggatagttgttaatggctgtaatactgtagccaataaaggggcaaagacagaactggaagttagtttgggttaaaaaaaaaaaaaaaagaaagacaccagccttcttacctctagtgatagcaattctaagggcaaagaaggctgaagaacaaggcttggcttgagctgaggtattgtggccaaaccttaaactcaatgagattccgtgtttaaaggaacatttaaaacccaaaatacaaaacaaacaagaataaatgaaaaaaaacaaacaaacaaaaaacccaccaggctcaaaaaggctcacctatcatctaggttaagtcaagaggtgccagaatgtgagttgagtctgacctgaagagagagaccatgtatcaaaaaaccagatcaaccaacaagaaacaactctattttcattgctaaagtgaccgtttgaatcttcagtttttccaactacaagtaatttggtgaaacttaaagatgtcaaggacatggtatctgcatatctcaattgttcagtagaactagagactcaggtgctctgtgttaacatcagtcctcagctagagagcaaagccccaaggaataacatctgcatctataactaactctgcaggggctgctgtcttcagtgtctccatcctcaactctcacatgcaggtcaagcactaggactgtggtagggatcacaagcccaatatagagtttcccctcagagtagcacatcaggaaacaacaacatgcaagtcctgtagccttggctaggggactcaaactccctttgttctccaagtgtctgttgggagagctaaagtcaataatgtaggtgctaggctctgccctaaaggctgattgaataaaagttgtcaaggaggtggaatctccatggtccagcagctgattagacaaaaaaaaaattcacatcctgagtctttacacacagactcagctccagagaggaaaaaaaaaatctgcctggatctgtagctaattctcttggccagctgtgatctgtgtctgtaccttcaactctctcaaggaagaccaaaggaaaactggcgacttactccagtgatacggatggcaagatccaaagttcagcttcctcctgttggacttcatgacttcaaggaattcctggctcctttgctgaattattcaatcaccttctgtattctgagctcatgagagtaagagctcaagcaagtgttctggatttgaactccaaggcaaagggcatggccctgcccacttcctactgaggtttctaaaagcagactccagacaccagagctgagttgagtgcctttctcccagcccactttcattatagttcctgaaggtctgaagccctggcctgcagctcacatgctggatctgcttgggtctaccactaacctctgtctctctctacatttgaccgactttaaagacttaaattctcagagctgagaatgtagttcagcaacatgatctccaatccctgaacagtagaagaaactgaggagcctctcccggtcttctctgaactgcttaaggagcaggtagaaagccgacatgaatttcagtcagagtcctgctatccacacactgcccctgtggaaaccagctggcttgtgacagctgagtcatgtgatacctacgaggactcaaccaatgatgtcatctggctattgtagcatgcctgggacagccttcacctagaactcaactgcataccctggagaagacatcaattttcaacttggaaaaccaaatgagaatttagccatgtaccagcaagccatgtctgctgaccagatgaaattcccagcaggctctcggctgcaggagctcaacctccaggagatttccctcactgatttccagaagagagcagtccctgacagacagtctacaatgaagtcatccaggtgacctccttgagcagtagtgaatgtgttgggctccacagtacagccgtatgtggtagtcagaggatcagctctggtgataatcaagatcttctccctggaggggaggagactcttgaagggagccctataatgttctccagtggttaccagactccagatgaataccatctagttacttctgtgtttgaccagactatccaggaggaggatcaaaagatgcctgccactgggaaccagatgtctgactgcagtcagatggcaaccagaatggatgagctttttctctacaggggtcatatgacagattccatttatagccaggctctccctcccagtcaggtgatgatttctgtttctgacaacagttattgtggctgtaggaggaagattccaattcaatgaccttctatggggatcacatgatagtgtgtgtgtgcatgtgtgcatgtattagttttttcagtgaatctacatatttcccagctcttaggacccttttacttttctatagtatgttgactgccaaaactgccagttaaaatgataaacttcaaagctgagacacttggccccttttgcctcataactttcaatggcttgtttcttgtgtgtacagctgctagcatttgacatctctgtccactcctaatccagtccaattcagttcccttcaggttcggggtgtgtgtgtgttaattactgaatcagactggttctctgtttctctctttgaaggaaacaactgttgggggagggtgtcagtgggtgcacttgaatgtcctgttactatataaagttagaaacagtatatagttctgtgggtactggatataggtctgaaaactacaggtaaagcaactgcattcttgattatggaagtggtggagggagaagtagggacagcctatgggaacgtagccccggtgactggctattctaaggccatcctgagcagaaaagttcacagttttgtctcacctgtgctcaacatgcatctgtagggtaggaaaaaggatggatacagatgagaagggtcaaccatagtgataaaaaatgggacaaggtttgtaagtctatagtctgcagcatgtttacttttcatgcaaaatcaggaacaagatgtatgttcttaggtcccctctcattttcttgagatttttgtctccttgtctctgcatctttggtttttcccttgatcttatcccaacctattaaagattttcttccaactgcagagtatagataggtaatacaactatttctgattaaatctgccatgaatatgctcaggaatcagtagacactagtctctagtgttctccacggtgacaaaacgaagtctcattggaccccagagaaaacaatgaaatctctatctttcctaggttggatgttggaaaataacaaaacaaaacaaaacgaaagacaaaaagacaaaacaaagcaaaacaatccaaaaaaacaaaacaaaacaaaacaaaacaaaaacccacctagcacacacgctgggtggaagggcaggcgtatgtgcttgcttagggaaaagaaagcgcgttgccaacgcttaaccacctgagagtgtaacttgcatgaggatgtagattctgagcaggcgtctcaggagataccatgaatctaagattgaccagcaggtacaggtaacagagctggaacctctgagacagtcaagagaacaaacaaacaaacaaacaaacaaacaaaaccaagagggttctcatgaaacacatccatactctagctcctggctgactaggttgaggcttacaagttttaagaccaagaaatcacactgcaaacacctggaggacctcctcctggccaagaagtaggagtacatccggactgccaaaggaagaagagaccaagagataaagtccatcttgtgtgtgcacataatggccaacgtgtggctttgcatgtatcagtgatttaagtaaaagaagccttaaaacaaaacaaaaacaaaaagaaaacaaaaaccccaaatgcttgctaattgactcatggtttatannnnnnnnnnnnnnnnnnnnnnnnnnnnnnnnnnnnnnnnnnnnnnatgcattgtgcacagttttgtagtatgcccataaagccacacggaatacagcttaacaatcgctagcaatgaaagaaacttcggaaaatatgccacaaactgattaaggaaatggagagagtaattcagagaaaagattaaaggagttaattatgcacagcttgactgagcagaaactaaaaggagagttaatgggctctttgatattatttgaagatactaaatgtcaaggagaaaaaaatgttttgtatgatacagtgaagtgctattagagggatgagactgaattgagaatgggaatatttaaatgaagtattagggatgcttttgaaatgaaattgtgtagtagtctttccaatatgaaatatgatctcttcttcacaggggaaaaaaaagcaaagaaaaatatcaaattttggttgtactacttgttggacattgtaaatgatgcatttctttagtgtttctgaacttccgatatgaactgccttcaatttcagcaagagcccactctgttcccaaatgtttctgaaatccatgtcctgagaaatcctgttatcttgtgcaatgtaggctgcagcatgacttgtttgcttgctttttgagacaggatttctctggatatccctggctgtccaggaacaccctctgtagatgagactggtcttgagcccagagatccacctgcccctgcctcctgagtactgggactaaaggtgtgtgctaccactgcccaccttttccttttaaactcattttcttatacattatattttgagcacagttttccctctctcatttcctcccagatattctctatgcttctacccattcaattctatgccctctttatctctctctttaggaaataacagggtagttttaaaaacagaacaaaacaaaaaaacaaacaaaataggaaaaaaaaaaacaaagcaaaaacacaagaaacacgcatacaaagacaaaacccataaaaaaacacaagattgggatccataatatacaaacaaagatcagtaagataaaaaagtccaaacaaaacaaaatgagtcaaaaaaaaagtcttcaaaaaaccactgagtttattttgtattggccacccactgctgggtatggggcctgccattgcatgtagtttgtgcactcagagagaaaatggatttttcccttgcaaacagctgtcaataagagagagagagagcttcttgattagggatgggagctcctgtccattctcaactctgctgccccttctagcttgaacctgtatagtccctattcatgctgctataatatctgtgacttcatatgtgcatcagtcctgctgtggggaagacaccgtttccttggtgttgtccattccctgtggctctaacaatctttctaagtcctcgtctgcatatttctttgagtcctgaaggatggagtttgataaagacatcccacttagaactgagtgttccaaagtctctcactccccttccatcgtcatgtgtgggtctccgtattagtgagaaagatttatgatgctggatgagttaaacactggtctatgagtatagcacaaagttgttaggagtcattttattgctatatttgcttagcagaacagttgtattggttttacccagacccacagtctatctagtctcaggttcttggccaccaaagcagtgtcaggcatttgttccatctgatgcagtgggccttaaatacagatagcatttggttactcctacaacttttatgtcactattgctccagtgtttcaggcatgcaagttactgctgtagatcacagggtatgtagctggttggtggttaccttactcctctggtaacatgcagagtaactggtagtaccatgaacactagccaataggggtggatactcaagttaggcaccagctagatttttctgtattcaatgaggtatttaagtattgtcttcatccatagggtattaccatcagtttgtggagagcaaccaatctatggggtccgtttggccaacaactcaattagatataaccaatttctagagctggaggttacatttggtggcaagtgatgttttatttgggaactatatcccttgttatttggtgattctacacacacacacacacacatacacggcttgtattaggtgtcctttaccatatttcaactctactgcctcttccctcaattcattcttttaatcctatcattccattctttcccctgtctctctataactatatattctatttccccttcctttggggatccccccctattcacttgtcccttattctatacctaaagtctgttgttataaagattgtagcatgcttactaaaagcttaaaagatatacagcatagttatcttctggggtctgtgttacctcactcaagatttttttctaactccatcaattttacccgtgaatctcacaatttatttttttttatagctgaataatatttcattgtgtcaatgcaccacatttttattatccatctgttgatggacatctaggctgtttccaatttctagttatcatgaattgaatatcaatgaatatgagcaagtgtctctgtagtaggatgtagagtactttgggtatatgctcaagaacgatatagcttgatcttgaggtggatctattttcagcttcctggggaattggcatactgatttccacagtggctgatgattttcactctaactagcaatggatgctgattctctccacacaacatcctcaccgctctgagctgccatttgttttatttcttttggtcatccagactggtgttagatgatatatatcaaagttgtttggattgcatgtccctgatgactaagggcactgagtatttctctcattgtctctcatccatttgtgctttatcttttgagaaatctgcttagttctgttccccattcttaattggtttatttgtttcttaatgttaattgttttcagttctttaaatattgtaggtattgacgctctactggaaataaaatgggtaaaaatcttctccccttttgtagcctgcttcttcatcagaatgatcagaatgatggtgtcctttgtcatacagaagcttttcagtttcatggggtcccatttattaattgttgttcttggtgcctgggctgttggtgtcccatttagaaagtcttttcctgtgacaataagtccacaactatttttcactctctcctctatcagattcagtacatctggttttatgttgaagtctttaatccatttaaagttgaagtttgtgcagagtgacaagtgtggatctatttgcactcgtctccattcagacatccaatttagctgtcaccatttgaagaagatgctgattttttttcccagcatgtatttctaacttctttgtaaataactaagtgtccagttgtgtgtgaacttatgcatgggtcttgaatttgattcctttgatcaatgtgtctttttatattccgatgttgtttttattacgatcactctgaagtacaacttaaaattggagtgagtgatacttccgataggtgttttgttattcttggagaatggcaagaatgtttcattggtgcagttctgagagtaacagaaactgtttgaagctgtttgatgcatgtgtgttcttaaataagatgagacattcactgacaagttataaatgattgcagagaaagtcagtatataataataaaatccgtatctcagtggtacattggctatcatatacatatgtatagctctcaatttgatcctttgcatcataaatatctctatttccattatgtacacatacacaaattagcacgaaaacataattataagtccatatgcaccagaatatcagaattcccaaatacataatgcaattactaatgcattgattgaaggagagacagactatgatactataatagaaaggaacctaacttaatgcccatgttcaacagtggaaagatgatctagacagaaaatcaacaaaaacacattgaatttgaaatgtcctttagactaaatgggtctaacaggcatattgttcaccaataacagcctaacgggcagtcttcttaactgcacaggaaacattctccaagatagagtctgtgttaggtcaaaaatacatactagaaaatttaggaggctcgaagtcatattgacacaatgccataaaatagtagacatttttagaagacaatagtaggagaaatttaaaataatttatcagaccacgtctgaagagaagagaggaggcatacacatacaaacttatacatacacaaacaaacatacacatacaaacatacacacacacgtacacctgcatacacatagttctgtgtttctacctagccaccaaggtgtcagaatgccactcagagaggtgaatgcagggacactagtctacattccattcttcctgttgggatgcctggctcatgtgacaccaacatgtcactcaaggaagacgaaactctggactctatgctgcatggccagttgtcatggtcctcttagtgaagtgtggtcgcatgctccaggacaagaatctggttgagaacagattcaaacgtgctattctgagaattgctggggttcctgaatctgcttgattttagcagttttctgtctagtgacacagttccacttgccccacaactcctttttccttttataaaggggagatgttatttgagtaactgtctcctatattgtttgtagttaaaaatgtgggtggggtggatataagcattaaaagaaagtacaacataagccagagggatagtgaggggtgggagtggggaagacaagggattattgaactaactcagttactcagtagatagatgttgagagtttgtacagagttttctgagggttttaacattggtcttaaactactttttttggtttttcaaggcagggtttctctctgtagccctggctgtcctggaactcactttgtagaccaggctggcctcgaactcagaaatccgcctgcctctacctcccaagtgctgggattaaaggcatgcaccaccacgcccggcttcttaaacaacttttgatttatctacataggcataatatttccttactactatgtaagtttccccaagcgtagtagccattgggctctggcaagagagttcatctgttgctggaaggacccatcttatctgccgttttcagcatctgcttgtctggagagtgtctattcaatcgatgtgtctggagaaaggaagcttcatggccccagccaggtccaaggagatggcagaccagtctctccctctggcctgcagtggtaacattactctgataccaacatagacatccaggccaatcaagctacacagtgagactcccctgcccactcccactatacatacttatagatacacttacacatttagtggtgtgtgagaataaacaaaatgccactcaaaaatcaataaataaggaatacaaatatcttgtaataagatagaaacataacatacaagaatttatacacactgtaaaatcagtcctaagaggaaaatttataattaaaaaatgcagatttctataaaatttaaaacattagcaatatacttcaaagaacttaggaaaaaacaaagcaagtttaaaatcaatagaaggaaaagacagagaaagactggagcagaaacaattgtgacaaaatcagaagattcggtaatactaagctcttttaataaatgataaagttgattaatgacaatagagaaacacctctgcacataaaggaggcaagaaagttgaagaaaaggcatcctgactgacacggctccaattcacaggctcctgtggaacgctcgctcaccagcaaacgggctagccagacaaaatggaaaaactcaaacacacaaggcgccaacactaaatcatgaggaaatgtaaaatcggagcggattcataacaaagaaagagactaagtcagtaatacaaatccttgcctctaagaaaagcgtggagctgcccagctttactgctgaacttggctaagtatttaggaaagagctacgcaaattcttctgaacgcttctaaattcagtgactctgaggctagcatcactctgataacaaagacacacaaaagcagtataagaaaaaaaaagatggacaaattgttttgaagaatatagattcaaaaatctacaacaaaataccagcagactgcatccacaaacatttaaagagttattcctcatgtcaagttacatattctagggctgtaaagatggctcaacacatgtgaatcagtaaatgtgactcttgactctagctgcatatgtatcaaaagatggcctagtcggccatcactggaaagagagacccattggacactcaaactgtatatgccccagtacagggggacgccagagccaaaaaaatgggaaagggtgggtagggaagtgggggggagggtatgggggacttttgggatagcattggaaatgtaattgaggaaaatacataataaaaaatattaaaaaaaaaagaaggttagccaagtgacagatgggaatataggtgacagttctccaatattgttagtgaaatcctatttgtatatatttacatatgtagtaccagatatagtctttaaaatgtagaaaacattttatgaatgaaaaaatttgacatgtcagcatggttgctctgaaatttttaacattattagagacactggctgttccttaaattgatagtagataaatcacaaataggtgagatacaaacaatacatggatatatctttaaaatattactgcaggtttatatttaaatgtatcatttgtatattaaaatactttttctttaaaaaaaaaagctagagattaaggaagtcatgttcccacgtcagtagatgcataaacaaacatttgtcagaatacgacctttgtttcaggatcaagtcctgcacagactaagtgcagcaggatttacttcaatacaaagaagtgttctcatgacaactgcctaggtgacatctgaggcaaaatctgatatctttttctatgattaaagataagacgaagatacccatgctcctcgtttcctttcagcacagccctggaagtgcaagcccgagaaggcaagagagaaaatcagaaggcagccaacaaaaatagttcaactgtctgtatttgtaggtgacatgattgtttacacacagttaactctaaggtgccaccaagatcttgtaaaaccaataaattcagtaagcttcaggatactccattaacattcataaacacaccccccccctctccaaagcattcctgttttaaaaagccacagcaatactcaagtaaattacctatatactgaaaactagacacgtgtgaaagaaaatctgaacaaagggaattgggctcatggtcagtgattgagaagaataaatgttaaaatgtccgtgccacagcaccaggggagctacaaagttagtacagtgtgtatcaacatgctaatgccacgttctcacagaaatgaagaagtctttagtgtcatgcagaaacacaagcgatcttgaatcaatgaaagagccacgagcaaaagaatggatcagaaggcaccatgctcctttataacaaaatatatgcggccagtgcaaaggtatagaacccagaaataaacccacctatttacagccagctggtatttcctggcaagtgtgctaagaacacacacatgataaggacagtataatctggttttgtagtattgcctagaaaactggaaggccacaagtggatgagtggagtaaggccttcatcttgcactgtatacaaaactcaacccaaagcatactgtaggtttctatataagaatgagaactgtgggctggagagatggctttatgctctttattttacatatcctttcctctactcaactattgtaagcctgacagaaggatgagtttaatacccaagtcagtgcctacctgcgcaactcacatggtggtttaatgtttgtggggtgcaatgtgggtgtaaattaagtggtttccactctttcttttgtttgataggactcataccaatgaagcacctgcccacaccagccctatattcagaatgtagttctgaattctgcatttgtcattttctggtgaattgacctttgaaggactacaggaaacttgctatacctgttttatgagattaacgtgaaagatgatctattgcacaaagttagggttggagtaaataattcatgagcagtgccttaaccatcttcaatcaacaggactgttatttttaacactcaatattatattgaaaagatattttgtatcctttcaatgttttttttctatgaacaaaattacttgaaatactatgctagacactggtgaataagagactcactgtctctctatgcagctcagaatctattaagtgataaagaaagggctgttattgattagttactatgattacatttgacttttgactcatttgtccccatgtacagcagtcacaagttcctccctaagaacaccgtgactacctttaaagtatttcagggtctctgcatggcaaatcttctgccacatccttcatccggctttagtcactttgtacctacgaaacacacagctttctagtccgtgcctgtggtattttctcctttgctctcttcctgcacggccacattaatcttctttaaacactgctttcatcttgtcactgccctgttcaggaactctaaatagctcctgcaatcctcctctgtcaagtccaaagtcatctgctaacttacaagactacccaccatttgtccccagcttccggagccttctgcaattccagcagctgagtgtgtaagaaagagcgaggcatcacactaatatttcgtataactaatcttgattaggtcaaggctcttcttagaaatatccccatttacaaatgagaagggagattgtgactggttacagactcatacatctaaactctacttccagttccttttcgacgagctttcagcctgtgctagctgtggagtcatttgatctccagtgtcttcctcagtctatccaagttggcattttgactctccccacaatcccaatcttcaagtcctaccttgtggaactagcacttctgtctttgctgatttcctttacctttgagctgacttgtcagtcaccaataccaccctcacatttgaattacatgctgtgcatgccagtcttttcgcagtcacttcctaggtccctcataatattacttcatatttcctcagatgaatttcatcatttactgagcactaggtgatcctgtagtcaatacttgttgataggataaattgccatccttagcatttgagttattgatgaacatatccaggaaggaatcaagaagccttaactacaagataattgtttacaagagatttaggaataaggcaatatatatagtcgtgaaggaaggaaaataatagtgggcatatagttgcctggaatgtgacatacgagccatagtgtaatcctgggtaagctttgtttcctaatagaggtagaaatggaagccttttgtcataaaatttagtgtgtgagattaaagagaaaaagaatcaattgctcatgaacagtaaattaatttttagtcttaagtccagacagaaactttggtggattctcattaaggggacatcagctaaaagagtgagcactatatttatcagtgtcattacagaggttactttgaagagtttcggaaggatcctccctaaaatgatgtgcagtctagccagtgacatcattgcaacaaagtaaaatccagaaagagcaattcttcacgtggggagcagggccagcatgatgaatttgaccctaggaaacttagtcgaagggttgggggactagcacttagaaaaggttctgttccgaatcactcatgcaggatcttggaacagatgctgaagtgtggagctaccctaaagccagggggccagaagtgggaggtcttaaaagttttatagtctttttttttaggtatgtggtagtctattctattcaacagtctggaatttaaaagtttgtagtatgtctaggctacaatgaaaatgtttttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcattggaaatgtaattgaggaaaatatgtaataaaaatattaatttaaaaaaaagaaaaaatatccatctctggatctagaaaaaaaattaagtaagtaagtgaataaataaataaataaataaataaataaataaataaataaataaataaataaaacaaggctgatgtcaggtgataaggccaatgacagacatggttaaaaagacatgtaactggggagtataatatttgatttgggttcatcagatcaccaaggaagagagccataagcacaagattatgaagtctgggaagagtagagctgtcagtgatattttggagacagcctggtagttcagtgaccacaaagtaggttgagggtcagaagatgcagccaaaagtgtggtgcttctattttaaaagccctccgtgtacactggtgggcttgggtctggcctactgacgttggttggcagggatgaagcatttacaaggcctcttagaaagattgctctatttctcattggtggccaggagatcagttaagagtttgccttaggagtctccagcttgcctgagaggaactattggcttgaataggtactgctatgataattggacagttgaggcagaagggcagggaaggatgcaatgaatctgaggtttctaacttaggggtcagctggcacatgtcaatgctgataaagtatatggaggataaggtcatattttaaggacaaggagtgagttatggaatggttcatacctctggatgtctaaagtatatccctttagatattactatttagttagtaagaaagcctttctcttaggaggaaggtttagacaggagatagggatttgaaagtattggggcttaatattggctagtctgtatcatgacatacgatgctattaatatccactgcacatggtacatcaacacagaggtggcttatttagagtgttctctaaaagtccttaggtgtttctccatctgctgcatgtgtggcagacctactctgtagtatatttgcattgctgtactttttcagcctaaatgaaacagaagcccactgcttcatctttgctcagcatcatcacatggagcattcaatgggaagaggtgaacaaaatgaggccataccactcaccagggctatcctctttcctctcaggaacagtgtaatcgcttccctggcttccttatcccttagacttacccatgtgactagctttcagttctcaaaataaggagagagaagctatgccattatgaggccgaaggtttaaaagttacgtccaccatggaaatgtcagcggagattgaccaggtttctgcaggatggtaatgagcagagttcccatgtaacccattttagacctagagttgagtgagaaatgaaatttactctgttgagccaccgtcctggttagtttgtcaacttgacacaagctagagttattgaggaaatctcaattgagaaagtgcctcctacagattaacctggagtctagccttggggaattctttggatttattattgacaagaaagaactaggcctactttgggaggtgcatgctctggccaggccattcctgtaggtatagaaatggtgaacctggggtccaggcaataagcattcctcagtggcctctgctttagttcctgcctttaagttcctgccccccacatcccttcatagtgaactactacaactataagttgaaatagaccctttgctcctcaggctgcctttggttgtgctcttgagtcacagcaaactaaggcagccagtagggctgtgatttttgttctcaaagaacaaacctttcaatctactgggtaacaagctaaccatacacaagtcctaccaccagactctcactagttaactagttgcaagcaagtcacacagcttctttgagtcccagtttcttccttttgaggatgttattatatatgtcagaacttggtgggcattcttagagaatgaactgaaaatactttatgagtaacaggcagtattatagcctccggctgtcctttcagacacttgttcagttttaatgtattgattttgtgatgctgatttgtctcctatttgtattgtgcttaatcttcttggactcattgtctaaatactcacctgagcccccactaataaagaaaaccaagcaagtacaaaggacggggctgggcactgtgtcagtaggggtttcctcactgatgctccccttcccagtacagcattatagggagtgcacagataatttttgtaataagcctaactctcatgctggcactgacaatatagggtttttttatatgaggttttatataaaaggattacttagcccaccacttgctaagactacatttgagagaatcacatggcttttcacatatttgtaacctaatggattagtgttgttgcttttgctccatcaagaaatgttttgaggtacatagtttctcaaccatttctctttgcttccagtatgatcctgtgacatcctatggtatctaccactccgccacagcccccatctcattttctaattgagctcttgaatcatatcatttaaaattccagtggtgtctggagaaatggctcagcaggtaatagcactggttgctcttccagaaaacctgggctcaatccccagccactaactataactccagttctaggggatctgatgccctctctggcttcactgggcaccaggtatagatataaatgcaagttaaaacacctatcacataaaataacaatcaaaaaataaaataagaaaatacaactttccatcagttttttatgatataaaatacatgaaaaatttcatcccttttaatagaacctgaaaatctaaatttacacaagaaatgaactcttgatagatatggaaggaaaaatacaactcttaggaaatagaaaaacagatggctggagtttgtcccagtaagttcattttgagaaacaaaattggtggatatttggaagtgatcattacttgagaataatgacactggctaatatagaaaagggaattagactgagtggtagcacattcttttaatctgaggaatttaggaagcagagacaggaggattgatgcatatttgaaatcatccacggtacacagagagttccaagccattcagaggtacacagtaagatcctttctcaaatatgtggatacaaatagaagaaggaagagtattaatgaagcaaaggcatatataaaatggaaagcactggctttagaattaggacataattaggaaataaaaggggggaaaggaagtttacttctcataaatgtctgattgggctagaaaatctatttttcacagtatggtacacatctgaaataaattcaggttctgagcagatttaaatagatttatgaatacacccacaatctgagcacagagcaggtcacaggaatatacatgtcttttatggggagctttatgggaccctgtactctgagagagagcatacttcaagtggttcaagtttagacagtcctttgttcttgttctcatggtgtagtttctcagagaatgaatacccatggggttgctggaatcacaaactccaagatcaactttatgtgtgcatatatgtgtgcatgcaaacatcataaaacactgatgaaaaaatcagtgaggtttttagggaattagcccacacttttttttttaaccataaaggaaaccagaaaatgttggaacgcatagacctaataacatgcagagtcctgccccaccccccagttgaagtgatatatcaccatgtcttttccactagttagccagattaattggagaaaagaagaatatgtgtgctgtggctaatctgctactgtggggctctttcccatcagtccctgctagcaccctgttgtgggcccccatacaacctgtgtgatggcctttaaaaatgacaaagtgtacttcttaggtgaggagatgtagctggcaattaaagaggcatcctaggattttttttttaaagtaacagcaacttcatgattttattttcctaacatctgttctattcaagccaagcctactgtggtgatcctcatggagacaattcagcagtttcctagcaaccaagtttcctgtggtttccttggttatgagcaatgacataactcttgtgggtaacttcaaaagcacagaagaaagctctcctgaagaatgagattccaaaaatttcaggttgctgcttgctgggtgtctataaaggataaaatatctccttatggcattagtaatactaatgagtgatagggatattttggcataaaagccatatgttcaattttatacacttttttaggtctttgtcatatacttgctctccacatcccccccccctctgaaatggcatcatcttcctctatcttctaatgaacttctatctttagtcatagccagcaggtaaaacatagactcttaaaaattgcagacagattatttgggaagacaggagaggtccagttgctcaaggacttcataaaaatgtgacttctttgctaatcaagcatattttagagactttgatggaattggggactgttgcttgagctcattaaggaattgttaactccttataatagctatggagacatttgaggactaatttaatctaaaaaggcaaaagctacaaagctggaattcaggaagtgagagtgggcatagaaagagaacatatttcaggcaattagggatgattccccccccccaccccacctccggagccttagaggccatattgaatgcttagcagagtcacctggaaaccaatcaaaacatcagtatagttgtgccttagcccatggcacaagtgcatcccttaactgaaatgttgagcaccaaaaggattttgaatttgggattatctggatttggaaatatttgcacacacatggtaaggcatctatgggatgcctgaggctaacagacaaattcactcatgtttcttttatactttgtatgcatgaactgcaggcaatctgatacactatttttagcgcacctgcatttttcagacgcctattccatgagatcaaatgtggaattttctatttgttcctcatcccaaaactcaaaatgttttagatattggagcatttttggcattccaattttctgattaaatatcttcaatccatatgaaatgttaaaattatctaagaacttggtttgagatggcacagctcacagtgtgaatgggttatttggacaaatcatactagtgaatggtctagttgacttcttggctgctgtgttgatgcactaactgaaaaacaactgggtttatttcaccttacaaatggtttacttcagcttacagctcgcaggcaatcatccagggaagatagggtaggagctcaaggagggagccgggaggcaggccctgaagagaaacattgcttactggcttcctttccccaaattgttcagtttgctttcttatataatccagactcatctacacaggagtagtacctcccacagggggctggaccctcctacatcaatcattactcaagacaatgccccacaggcattcccacacagcaattttttagaggcacctactcaattgaaatcctctcttcccaggtgactctagtccatgccaagttgacaaatactgcacatcagagtgggcaaatgtccaacacagggaatgctgaaggccaaatggcagcatcggtaatctaggcagggatactggaaatctatggccgagagccaggccagagcttcaggatagagaaaggagaagaaaacagcatttattgaagatgatttgacagcagatactttatagacagccaacctttcaggaaggtaggtattatcttctccctttttataatactaagcggctgaggaaaagatactacatatttaaagatactataaataaaaaactctggataacattataccagagaggcagattgagatctaggaactttctgtagctctaaaactggctattttttcccctgtgtgacacatcatgtttttactattctgtaaggcagttggagccaggatcttgctatcaagatggcctcagctatgaaggtggctgccccttggcaagtaggaaggcagaagtttaccctcatttgtgcatcttaggtctccaggaaatgggcaacactaagttcagattggctgaagtaaatggctccccccccaccatttgtaatggaaacccctattcacacatttgttcacctaacttttgtcttatcttcaaaactactttcctaacaaccactgtgaaatggatagacttgaattttgacacatacatttatgcaaccagatgggcagaaacaaagtagttcacactcctaatatgtgaaataataagaacaggagcccagaaaccattttatacctctgatgcctacttgtttattcaataagttttcctttattctcggtacagttctaaatagcatagagatttcactgaacaacacccttgacattgtaggaaacacagaatgtaacctataatgacttataatgctcccacattctgggagtcagagatgatatgaagttaaacagatgaagaagagaataagagtgatctaggaaaagctttctagggagtaagataagatggaagagtaaggaatggctaagagatgcttggatcagaaagacagctcaaaacagaagacacaggaagctgaaagtctctgaagcttgggaggttagaagaacaatgcacctaagatttaataaaaaccatgattaatggcttttcacatcaataactgagcttcctgtcattgttaaaagaagagatgttcaaacaagtccctgaagttgaatacataggattccaaatctgacctcgtttaatcggacagctggatgggagggaacttcagcagcagtgtttggttggtaagtcactgtcatgattcacagactttgaggattatgttagagttgcataaggatgtctgggtgaaggtcttctgttggttgcacactatctcataactctgcaagaactgaagtttgggatttgaagacatctctgaacttttgtgcagttccgtgaaaatgatgaactcctatagacctggctatcacccggtatgtttaagacacagcatcatcacttgtcctcatagtctgtgcaaaggtgtaagtcggaaactgaggatcacaaagggcaggatttcctaagttccagaagatcacaggctattggagaatgaatcaatatggtatgattccatgactgttgtatttagtcagaatgggaaactgaggctaaatggcaaagcagaatttccaaagtccagacttaaatagcagcggtggctgaagctttgtccagtatcactccagaatcagaggtcttaattactactctgtgctctatggcatcattaacttcccaggataactagtttaagctccacagtaagaggtaatgctgttcaacagaaagttcctttggaacgaatggaatctcccgtggcttctatattgcaatcttgagcaagcaagctgtttaacttctctaagacttagtttccttacctgcaaaatttgggtactgatcgttgcctaactgtaaagaaaagggccagtgtagagtgtctaatgcatatcatacaagcaatcacttcagtgttagagaggagaccaagttaagaggaattatatcacatgtctaatagttcagtgtccagcacacaaaccaggcatcgtggtgaatctttcttgcatcgaaatgcagaaaagacttttaaagtgaaaactcatagaaactagtcaattattcttatgaatctgtgatattatttatatatataatttttaaattttgagattgggttatatacataaacacacacacacatatatatgcagcacacacacacatacacacaccaaggattgcttatctccttgtttttttattacttctatatccttggtctttgcctccaagtacatggagacaggccttttacaatagcgggcatgcaaatcaaactgctacaactgattaaactctgataacattcaccgtataatcctccaatgttttgcaaatatgcacagttacctaactattgccattaactttaccatagttctgttcaaaatgacatgagtctcctcaactttggcatgtggccagctctagttaagttgtagtataagggtaaaaatatattcaatctatgcatattcaataataattttttgctttatagtaaccatattttgatattaaataaaatgattgttagttacctcatttgtctgtttttgagtgtggatagtagaataatatatatggatatatatatacctggcattacatttctattggataactgttatgtagaatactgtcctcatatccaaaattccctcttctgccatgttttaatcttcttccactacctcatcacttagcagcgtcagatgttctttttttctaggacatcaaatagtgcatagccttctgtttcttgcttgttgtttttcagttgtcatcatttttttgagattcattcaaacatttatacacatatatgtgtgtgtgtatgtgtattatatacatattatatatatatatatatgtatatacatatataatatacatatacatataatccccccttcatgccttccatgaggagctcagaggataatttgtagtaattgtctcttttgttccatcacatgagttctgggaatgaaactcaggtcatcagaaattcacgtcttattcatcggtagtttgttcctttattggtgtgtagtatgcctgggtaaacattccacagtttattcatctgccttgaaggtattggtcacttaggttgtctcaaggttttgttcttaactataccaggctggtatgaacctgtgggggcaggcatctatctgtattggataaatacttgagaatggaattactggttggcatgggaaatgcatattctacttcagatgaaactgccaaatttggaaaatgtttgaataaccttataccttactcatgaattagaattcagtaactccatttttttttttatcagtttgggatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctttctgtttacatttttttatttcattgtcctatatttctttattaacttatggacattttatgtttcaaattgtttgtgtcttcatttggctgtatttttcctggcacagctagtccacttagaatccatttgagtctttcggagcttgtgttttgagacattagagcaggtccgtagccatcattagtcagaggctcgttaagctttaccattgcagtggtaactaagagatgattcctgatgatgctcccagtaatgacagcagctggtgaaaacaatttaggattaactgaacgagagttcgcagagttattcggacggagattcagtcacactggtttcccctcactgtactcgtgtcacattcaaggggatcccaaggccctatctctgtaccttgctcacctctggcaaggtcttggagtatctgcttctgtggtcttcccttaactcatcagtgtctctagaccatgtcttggtccttaggcagtaccctgatatttatggaattcactgttttttacttttgctaaggaaaccgtcaactgtttcattgatttggtcaagattttattatttgaggtgggagagctgatctactccactatttgttcacagttggaaaccttcactatgaaaataattatcattaaaacgcacacatttcacatgcagcctgactttttcttctcatcagcattcttggtagctcttccagaggttaatactgaaattttgctctctaggttccaagaataagaatattaacttcagcattcaagaaactgctttcatttatactctagtgagagtgcccatttctaaacatttatctaaagctttgattatgcttaaaaatgacaacattaaaaaacattctgactgaagcattatcttctagctttcccaactgcgttagctaggggtttgatcactgtgagaaaacactgcaactgaaagcacattggggaggaaagcatctatttcatcttacagctcttaagtcacactctcacggagggaagtcagggctagaactcaaggtaggaacctaggggcaagacctgaagcggaggccatggaggaatagtgcctgtgggcttgttcatcatggtttgctcggcctgcttactttaccgactcaggaccatctttgcaagtgtgggattgcctaccccccatggtatgggcccacccatatcaatcattcaatgccccaaggcttgcccacagaccagtaatatactgtgggcattctagaaactgagattctgtctctctagatgccttcagcttgtgtcaagttgacaaaaccaaatcaaaccaatccataagcctagccagccctcagctatattttcatagtatgctcttagctttattatgccatacaagaaacatatctcctgctaaaacagtcgcgcatgcatacatacccctggacacaagaaactgaatcgtcaaagttcatttcctctcagttcccaaaattagatctatatgttagattggtctttgtcctctggcttgctgaaagtcttaaaaatatgtagtcatatgccattcaacacatttctgttcatttggaaatatatatatatatatatatatatatatatatatatatatacacacacacactcgtgtgtgtgtgtatttaccttgttgttctgatatatttttctttatgttatcacagtttcagaaagtcaatctcatggacaacagaaaattgaaggatggtttctagaggctggagatgagagggtcaaaagggcacaaggaacagggaactgtagttcaaagggttcaaattccagttagacctctggaatacactttcatacgattttaatagcaaatgtattttttaagcctatatctgaatacaatttgtttgtctaatttgacaatattacataaaaagttagtattcaacatattgataatataataatttcctggttggttattttttcacctttttcagtacttatgttagcaggaggcagatttaagccataattctactcttcactgatacacacatctttctttctcagctgtgatggtcccttacagtgtaccttattcaaataatctttcgtttcactccttactttgtcacaccctttataaatgtcactgcaccatggactctttgttagccaccatcttcatttagaacctcctctttctacttctctattttagtttttaaaaatagacctatttattttattttatgtgcattgttgttttgtctgcatgtatgtctgtgtacatcactagaaacccctggaactggaattgcagtaaaatgtaggtgctgaaagtcaaacctgaatcatcttggaagagcacccagtgctcttaacctctgaagcagcccctctactttattctgtgttcatatttgcatttctcctccttcccttacctcagagtgagttgtcgtctatgacttggacttgagcctgtgaattcatcagtgtgtacagtatctgtgcagagctcagcactggtaatggctcaaccagtgaatgaatgagtgaatgaatgaatgaatgagtgagtgaatgaatgaattggtatggggccaatttgaatgttaaagttcagcttaaatagctagtgtatggctaagactgccttccatgatccatctgtgttaggatttgtcaagttctaactctactatacttgtgaccagagagtaactgctgtatagagtttaattttccccaaagcactagagctgagtcaagatgccgagccaacattgatttacccaaatgttaaagtttccacccagggtcttaataatgaatttactagacatcattttgtttaaatacttatatcattatcatttagggattgttttaaagaaaatgtgtctgtcttgaagtagcactctgacttagctgtggaatttccgttctaatattttcagagaagtactcactttgaagtgttatgaaaacacagatagtcccaaacagatttgaatttgtaaataagaaactgccatttacgctgcacatgggaaacactgagactgactttgcatgaggtgagatgagttagtgatccctggctttgtagtactgaattcattgttgtttgggggaattaccactaaagccttttaatcacatatgttggacttaggtgaaaaaaaaattcactggagatactgtaaaatcccgatgggcagcttccgttaacatgtctacaaaacatgtctcttttcatgtacttggaattgacatctatatttatttcataaagcaatacatgtcttttgttactagaataaaactgatacagaaggagcctgcagggtcactcagaaatgatgcttcagtttgcatgtgagtttctggtgtctaagcatgtctttttcatgatcacttaattactgataaatctagacgtcagaaactttctatcaaatttactagggatcataaagaaaatataatttctaaatagtaaattctatctctttgggaattgattatatgaatggaactatgccatggttctttatgaaaatgatatgttctacagctggtcagcctgttgtttgtgatagagtaaaatcactaaccccacagaagaaggatttagctcagttgggggactgaagagtatacatgttcataaacttgactttcttaaacactgttctctgccatgaaagagctaccaaggctcctcacctaaagactaacatcatggacatagttgagcataataagtgcacaaaagacatcctgtcctatacaagtgtcacctggctacatctctgtatgcttacctattgagagctcaaggacctgaagcaggactaggaaatgggtgttgccactgctgttgttctccttgcatgaagtaaagaagaaagactacaagttcaaactcacccccaagtcacatagcaaaactcctgcttccaaaaaagcataacagagacaaatgttggcctggagtgacgttctcagagtgaaatggaatgttttcctggtggctggcactgttacagtaggtactgattcagcctggtgaagttggagaggagtcctggttgttcagtgaaaaccatggcaatttgcatcctgtatccagtgtttactatgtgccccataagaaaacaagccaatcaatgtaagtaatatagtacaataaaaagatctagcctaattttctctctctctctctctctctctctctctctctctctctctctctctgtccatctttctctgtccatctctttctgtctctctccccctccctttccccctctgtttctctctctctctcttgccttgctagccctttggttatatatgaagtccttattcctgtactactgacaacattccattgtgctcttctgtctcaatggtggacatggaacaaaatttgaattactttaaataagatatttcaatatccattgctaatcactgttcctgatcattaaaagatgagataattaatgcactgttgttagaacagagtgtctgaaaaagtatttagggtgtcctggtggagatacatctgaaatggaccacagatgtcctgagaacattttagaatgatttttcatttcagaaatttattaaattctatatgagaatataaaatgttgttgaaatgatagttctgtaggtgaagttaaaggctgctctaatactgtaaggtttttttttttccttttggttagtctctcaggggcaaagctaaatttatgactttttaagatgggttggttgcgaaaggaacaagtcatttcctgacaacatttttcagttgaagtattaggcttaatgtaaactcccagcagtattgcagggcccgatatcataaaatctgatggttctagcgaaaacattgtaaatcttcataaatgcatagcattctcaaggaatcctgacttttaaatcattacctgagcattggttttcttaaagggtacaaactggtaagagcttgaaggaaaaaaatgcttggtcttctgagtaaggaagaatgagtaagaactgaacgatttttactgctccattatctataaccaaggtagctttaactacctggaagaatgctgttatatatttctcactacaaatgtctactcttgggacaaagtagaagtaggcagataagagacaggctccacagacacacatctgttcactcctaaacaagccattaatgtgactgctatccgatccacaacacaccagtgtggtgcctgcagtgaatgggtgaggatgcttggtggctgaggcacagatgcagaaatcaattctctgtattctcattctgcttacacagtagcatttagacaaacccgagaactttgacttctctgaggctttcacgtgtctaccttatagtcttgtcagaaaagcacttgaatgagatgtacagagggtgaagggacgtaatatgtgggaaacactcagtgcaatcctctcccgtttctattaaacagcaactaggaggaggggagttaccattggcctcacactgcttcagctgtgtgtgtgtgtggtgggggtgcgtgcgcatgtgtgttaagcttatgtgtcacagagcatcaatgcagctgtgtgcacaactgctgtgcttctcacctctctcatgggaactgatggagactgaagagcagcagtgttcaagcttgggtcacgactcctctggagaccgaacagccgtttcacagccttatcacatagcagagtccctgcatagcagatatttacatttcaattcgtaacattagcaaagttacaattatgaagtagcaacgaaaatgatttcatggttggggtcatacaacatgaagaactgtattagaggtcacagcattaggaaggttgagaaccaccgctagagaggtttctgaaccatggatgagagaggtcaagagctaactatggcagccaacgtcaacagagctgaaagtgactttgaagcaaatgaaaagccatgaaagtcaccatgagtactaagccatctgataaaacacctttaaattaattatagacacatgatgaagcaatactgccttcatcacacattcaagacagacagattcttgccattgtggaaagacatgatgcccaagattaataaaagcctttttatggggctagtgagatggctcagcagattaggggacccagtgctcaatctaacaacctgagtttgaatcccagaactcatgtggtggaaagaaagagctgacttctccaagttgttctctgtctcggttgtacccatgctctgtggcacacaagcataacacacacccatacacacacacacatacacacatacacacacacacacaaacacacacccatataccacacatacacccccatacacatacacacccatacatatacatacacacacacacatttacacacacacattattaagtgatataagttttgaagtagctttagaaatagttgtcctttatattttaaagtaatcgatatctatttctcttttttgtggcaaaatatgcaaacatcacatggttttggttttttaccattttaagaattttaaggaatatcattgagtagcacaagtacttttgaagtatggtataactgtcatcaccatccatttccagaatattttatctcctgaccaaaattatttatgcttcatggtactttctctctcaaatggtaacccatgcctcaaatggtaaccaccgcacgtctacatgttctgtttctattccatttgactcccctaaatacttcatagctatgaagtcaattcagtattttcttttgacgttttggtcaataccatgttctcaagattcagctatatgggggcatcagttgcaaagctattccttttcaaagctgaataattctcatgattttctcacacattcagcgattgataaatactgccttgttctactttctgactttggcaaatgtcttagtagggtttccattgctgtaaagagccagcatgaccaaggcaattcttaggaaggacaatatttcactgtacctgccttaccagttctgaggttcaatccgttgtcatcatagcaggaagcatggcagcatccaggcaggcatggtgctagaggagctgagagttccacatcttgttctgaaggcaaacaggagaagattgacttccaggaagagaggatgaaggtctcaaagtccacccccacagtgacacacttcctccaacaagtcacacttattccaacaaggccatacctcctaaattgccatgccctgggccaagcatattcaaaccactacagcaaataatgcttctataaacataagtacctgtaactacagagttttatttacactacattatagttcaagtttacatcatagttcaagctttgcatcatagtattcaactttgcttcattcaaacacgtgcaataatcatctttcaaaggggaaaagtgtggcacaaagttttttaacttttagcttacaagcaattctgtttctttggggcttatataaaagaacagcattattatgagtgtgtgggtcagaggaaaaggctcagttcacggcagtcatgaagccaaaggagagagaagagctagacacactcccccagggctgtgggttatgggtgcttcctttgcaatcttgaggactggaacttggatcccagcaccccccgaccctcccatacacacccagaacctgagttctaaagtgggccaaggcaagaggatttctagacttcatagctttcagtctagccaagaaaactcaagttcaataagggagcctacctcaaaggaataggtaagagtgatagaggatacttgatgtccttgtctagcttctgcgtgtgctcttaggcatgcacactcccatccctaacacacaaacaaaagcatttttacaaaaaagaaaaaagaaacccacttccttcacagggcctcacctcctaaaggttctaccacctcccagtggtgtcccaggttaaggtctaaccctctaacacatagttctattggagtcacttaccaaaactgtagccatgagctagtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagaatgcttgtcaaagagattgccagaccctcctccagggctgcagagtaaatctcagataggcctgagaactcgaattttaatcattcatgtgtcctccagatgctgtccctattgggcttgggacctcattttaaccaacaatgttttagaacagtgtctttcccatataagcaacatctggtacggctggatttcagtagcgcggtctctgagtaagcactcctctcttcaccaagaaattgtggtatatacacaaatattcataaaacataatgcagaaattctctgcgtatatatggatagacatcaggatcctagcaataacctgagccctctcaaacaaacatttgaggagattcatcgtgcataaaggaaaccatgggaggtacttaaggtgtgaagctgtaaatggtgaggcctctgtcattccgcaagtctcatgaactgaggcaagggatgaatcgggtgcataagtgagaccaatgtcatacagtacatgaggcttttcctttgtccagagtgactcctggaggcctagaaatggctctctggttctgcctctactcctcatgggctaaagttgtacaaggaaggagaagtacagttactcagggaggtgaggcttttccagctcaaagaagtttgtttgtgtgggaggatcaaacagaggctatctggcacactaaggacagtaaataaactcccctagcttctggatctatttattatagtgattactttttaacctagttaagtttcttattctgtcacaagtatgtctcagagtatgaacgcaaatcgtgttatgttgcctttccagccttgagtgagtgatgtctaacaacaacaacaacaacaaatgttgattggtcgcattcagtatagtgaaggcttttgcttatgtaacaaaatattggcaggtatgagtccatgtagaggggagctttgagaacaagagccccaatcctgctaggctccagctttctagttggccatgaatctttaagaccctacacatgtgacttcattgtcaggagattaaaatggctcatagattttcttgtcaggtatttttgtgtgtgttgccaggtgtggcttcttagcaaacaatgcctaattgcagagtctgccaaatcaccatttcccaacagcttttataataccaagtctcttatattagaagtccactatttgtgtggccaaaaatcaaaccaaactgaaaaccaagactgcagctgttttagaaccactacttttaacctacaatttaaaaaaaaaaaaattaaccagtgtatacaaattgatcaactcataaacattggatgattggaagccaagactcaaatgagatgcttggaatattataaaacctctgggtctgagtgaagcaggtgagctgaccttggcctggaaataacagtactggtaacagcttagaaactgtcccaacctctcagtcaacacttcttggttcatttttgttgtagtctttacatttcaagcgtttattcacaataatgaattggaagaaattaatcagtgaacatctgctttggcaggctgtagtgaggacagaaatgggtcattattttccaccagtgtgacagggagcattggagaatgcctaatgcaatagtcaaagagccacataagcacagtcataaaaacataccaatgggggagcagttgaaagtggatcatcaaatttactgttggtctactgatgccccatgcaggttttcatttcaattgcatagtcaagatgacacatgagtatatgggatttgcttccatggaggctgcgtgatgctcataaggcagtttccctttgtctcttcagcctctgtgttgctctcctgtcctgcagcaccagcatacagccttactgtgtgttggagccttttgaagtgttgtagagttacatagtttttaaggaccgacctccataataaccctgtggaggaggtagtgtcctccccactttacctacaaaaacaaactcagagaaacgtgatgatacctaagacaccggcaggaggaaatagccaaacaggactgcaagccaggtctcccacttcagaatctagcgaggactgcactttgctctatagactggcagcttcggaaatggccaaggcactttaccgtacttttctcaatcaatgtggagtttttgagacacgaactttgcatttagaattctccagccctgaaaggtgcttttccctacgggtttggatccgatgtgcgaatagtgaatagcgaatagcagcgtctgaaaaggttaatctgtttacccaaccacaacagtttgctctgtggaacaaaccaggagttgccttgctagcctgctccagatgtcctatgcttgaagcggctttatttgcatttggtatttcaaagctggtgattgatttacaattataattgccaacaggattctactttaactagctctttgtgaaggaaaacatcaatttacattatcccacagaattggaaaatatctaatgatttataaaacaaaaatgggtttcaccaggacaagtgagtacaaaattgctgcggctaccctatgttttaatcactttctgatccaagatcctgtgatttttatgcagcagtattcactgtggtagtccctaataagctaattctaggcactggattatctagcttctcagggggaaggaagagcgcagacatcagttaaaaatgaaactgctgattatgaaatatccactttagaggcatttgtaactggattaacagagagccccattccataagacagctcttatttttcatatcttctttaatacataaaaatgagttagtttccatccgctgttaatagagctctactttaggttctagaggttcttaaaagatattagtttctttaaaatataagagaaagacaagaggggtcataaatatacactgattatattgattactcataggtaataattagcattgattaagcactgtcttggagctagattctgtgctgaatctattatgtatataattccatgtaatatctgcaatgaccattggaaagcaagcacttcagttattatgaactgctgtggtctgaaggttcctgcccttccaatatcacataacctaatcaccaagaccatagcattaggaggtgggacctttctggggtgattaaatcaagaggtcaggacacataaatttgatgggcatccttttaaaggagactccagagagttgccctttatcttctaccacagaaaaaacacaaaagaagttactgtttctggttagaaaacaggtccttaaactccatcttccaaacctttaggctacagatacagccacttctgttgtttgtgagcgactctgtgtagagcattttgtcatagctgcctgaaaagactcagctcctgttctcttcctcagagatgaaggaactgaccttcccctagctactctgcctaaggttctatagcaagagatagacaacgcttcgggtaatgaagtagatttctcagataagatgaagtccaagaaaaggaagagtagagtgctatcaggttctgaactgtataaatctgatcaaaataaaacaattgatgtaaaaattatgtaagcttaaaatgaaattttaaaaaaatcttagattgaaaatgaagatcatgtcttatccagttttggatctccttgtagagagtatcccacagacgacagtgtgttgaattttatctggcctcagtgtcttcccgaattagacactgttaatttaatttattgttgagaagtttctgtctaaaaagattctttaatctgttacataaccagctttctctctataatttccctccattgagtttgtctgatcatggagaatgaatgcactaagtattaatagcatggcattaatgttcaacctacgatgattttgccatagagaagtgttctcaagtgttgcttaattttagatcaactatgtttaaagcactgctcaggttctacaacaaatcaaattgacctacatgtctgaagttattctaaacataaaagttttaacagctctctaagaaatgcaagtgtgaattcaatgttgaaaatcaccattgtcaagaaataaacattaaatataaaagtgttaggctttgtagctaccttgccacacagctaaggtgacacacagtgacaatattcttatgaattcctccaatactgaactccagagtttgattattttttaaccctgcatacaagctaagcagactacaaaaaaatcaataacatgttcaaattgatgatcaagtatgacctcagatatatcaggatggcaagcatttggagacttcccatcaggcatagccacctcttgtctggctttggcaagtcaaacagacaaatgtttagaatctgaatagaataggaagaatatgccgtgtttttttgtttttttgtttttgttttttttttgttttttttgtttttttttgttttttgtttcttaatgctgataaaataacctcacctcagaaactgaccatgatgtccacctgaaggaattctgaggttctgctgattcaaaaattctctggacattctaaagtcatgttgacaaggtgacttggactcttgtttttccatgattctaacataactttccaacttccaccttacagtttctaggagtagcagcattttatttctgaactttcactgccactttttacttccttaacataagtctgggttctgggtttgatcatgaaaactacttctctggtccccacacaatagaagttggaccttgggtagatatattggtcataattatttctctactatgtcctctggaagcacaaaatttatcttgtcttgtcttttatgtgttgtttgttatatgaacctatattatgtccttaaatatataatataatataataatatataaatatataatgattagaaaggtctctgtactatgcattaagcagattatatatctatgtaaagtctcccagtccactataggaaaccagacttaagtatcatgaggtctatacagacatattgaggagtggttccggcttggggacagagaccccaagagaaactaagattctgagtgatgtaggtgatgggctcaagatgaaagtagtcagtctgaagacagatatacccaaggtaataggagaattcataggaagggagtggacatctgactgggtccattggagagagtttgacctgatgaggggtcattttacctcagactttgaaaatgaaatgatagggtttgagcaagcatgaagaaaatgagcaggtggtgggcacgtgtgggataactttgagaacgagcgaatactgttcggctgaattgagggcggtgtgggggcgacggcggttaagaattagacaagaagaccctgcagaacttctctttctggaaaagattgacgctcttttctagatcattcgcgtttgatttaagagtttcaaggttggaaatctctttctaatttttgtcattctcccatcggtagcttgtggggctttggtctgacatagctctcggaggcaggtctaattctcccaggtaacacttttcactcttctaccgctttccctggcccgtgttagcattcttatgttgttaaaagtgtccagggaacttattagctgagtgttctgactgcttatggagagaattgctatttctgcgcttgagtcaggcgattttctcattttcacgccccctttcaacccttcaatttgtcccgcaacttcctgtgcttctcgctgtctccctccctctctgactatcttttcatgtcttttttcttccttcctctttgtatcacctcttcctcctgtttccctccctgcttgcttcctacctctaaaggtatcctgacaggagaaatgcctttggagtctcatggcctcaagtttgatcccagctctgtgattatattatatattagatatataatatattaaatatataatatattgtactggctggttttgtgtgtcaactcgatacaggctggagttatcacagggaaaggagcttcagttgggaaaatgcctccatgagatccaggtgtaaggcattttctcaaatagtgaccaaatgggggagggcccattgtgggtggtgccatccctgggctggtagtcatgggttctataagaaaacaagctgagcaagccaggggaagcaagccagtaagaaacatccctccatggcctctgtatcagctcctgcttcctgacctgcttgagttccagtcctgacttccttggtgatgagcagtagtatggaagtataagctgaataaaccctttcctccccaacttgcttctttgttatgatgttttgtccaggaataaaaaccctgactaagacatatatgtgtgtgtgtgtgtgtgtgtgtgtgtgtgtatgtgtgtgtgtgtgtgtgtgtgtgtgtgtatacatataatatacaataatatataatttatacataaaatacacacatgtacaataatatgtaatataatgtagactacatattaataatatataatgaataatataaacattaacatatgtaaatattagtatagtaattgcattaattaatatatcaatatttatatgattcaccctgtggctgagaaagagcagaggcttgtagctttacctttctcatcttcaaattgctatgatgatgatgatgtcgcactcagactaagagagtatatatatatctatcaagtgcacacaaaacacttagaaccgagcttcgcacgtgttgcattcttagtgttattagctatttttgttgtcatagttgctacttgtgtttctcacattcaatatcatgagaaatagagtcttttaaaaatatggagaatagacacttgatccaataaattttagacataaatgatatgttttcatatcataaacaaatttttgttttgaaataacatcaaatatacaactgtgacacgtatacttaacagaatatattatcaaatgctggcggatgggttagctttacactgagatcacctttacagggggacgctggcctgaagatgccttgacccctgatatggaggaagttgaacatggtgaaaactttatgtggatggtgcaaggaattcttgagtttggggagatattatcagatctttttctttgtgcgatgcatttgtttctcattcttttccttcattgggaatatccagcgtatcatgccttggcatttgaaaaggtcagtggtttcctaacactagtaagcaggctttacttgaaattgtcaaagctgaaatcctgattcctctccatgggctgaacagaagcacggaacaacttagacctgtacaggacagctcagtgtaggcctgctcatgtaagtggcgaatcaacaggtctgacagctgaaatcatcagaggtctggaagggagagtgtgtaaatatcacatttctgaaaatcgagatgaagggcatccctccccagcacctctgtctgtgcatcatgcttcctatgtaggtaatttcatctcacagatatttgaactaatttttcaaaatgagtaatacaacataggtagactggccctttctctctctctagatttcattctttcctcctttcttgactctctctcttttttaattgattaattaactttacatccttattgcatcccattcctcctatcctcctattcccagccttaaaaaatcttccttccagtacaccctccccttctctccagagaaggggaaaacccccctaaggtaccaaccaccctgggacatccagtcacagtaggactaagcaatcacctcccactgaggcacacacaggcagtaggggaaggggatccaacagcagatccaatagagtcagagacaggctctgttccaattgttaggggacccacatgaagaccaagttgcacatctgctacaaatgtgtagggtgcataggtccacctcctacatgctctttggttggtggttcattctctgtgagcacctgaagcccaggatagttgattctgtacgtcttctagtagtgcccttgaccccctccagttcactcaatcatatcccctcactcagactctgccggcaccacctgatgtttggctgtgggtgtctgcttctgtttctatctgctactagaggaagcctcttaggagtcagttatactaggttcctgtctgcaagcatagcagagtatcattaattatatcagggattggctcttttacatgggatatgtctcaagtgcaatcattggttggctgttccctccatctctgctccatctttattcctgtgcgtcttagaggcagggcaaactatgggttgaccattttgtgggtggggtgatgtctccctccctccactagaagtcctgcctgactataggaggtggccacttcagtccccatatcccctgctggtagtagttagggtcaccccataggctctctggaacctcccttcatcctaagtctccagctactcccagggatccccaccccccattgattgcagttaaaatatttttaaattcttcttaaaatgtgatgttaatgtcactctactcctgctaatttctttttaaatgacactagttcctcattacagacatcatttcccttcttaaccccaacccaccagtctgtcaaatcccgattctgttgtgcttatttgatatctattaaactgtgaacacttttgaacaaagagcaaaattcctttcatgatatacagaaggacttataatacaaatagtcatgagaaatggcccacagactctcctggctctgggcactgacttgcaccgaaggggaaagactggttctccctggttctcttcctaagctgtttatagcaagaataataatggtaatacgaaacttccgtgaagctcatgaaagggcatcagatgtctccacatatacagtcatgattgtgaaatctcctcggaaatgtagaaggcaaaacaaatgtaagaagtgattttcagttgcaaattaaaaacagcaacaaaacagaaacaaaagacaactgtcctgcaccaaaggaagtctgtgtaatagatataccattaagctttgaattttacctctccaactatggatttgtgtcatgaaaggtggtgtgcttcacatgcatgaaacaggactagcagaaaatgtaaatgttgttcaggggaccaacaaaccatgcttgcttatgtcacagcttgaaatggaaaatgaccattctgggagaactaacagattaacttactgtcaatatgagaccggatctaaatttgttctaatgcaactcagataaaatataaatgttctagtgcatgaaagagtatgtgtacttattaatttttattcccttggacaccttgagaggagtatacatacatcatcattctgtcacatgcaatagatatgagcatgatgggacatgcttttggaagtaaggagaacccaaaacttggaaagactaaatgattttggtatgatcagatggtttttggaatggccgatcagactctcttaatatattcttcctcatatttcatctgtaacacttgacttctcatgagactgaactcttgaagttcataagtcttggagcaatacttttactcattgctggctttatctatccatacactcaagttttagtaaatattaatttttactaagccccatgttttagtctactctctgttgctataagaaaacacctgatgttgaataattgttaagaaatataggtctgtctgattcactgcttggagcctctcagtattgggggaagacaatgttatatcatatgatggcagaggataatatataacaaaagatagcaagcacttagcttgtgtcagacttctttttacacatcaactgatgggagccaaacatgatggcttatgcctgtgatcttagtactaagggaactgaggcaggagcattgtcttgagtttgaggttagcttgggcagcctagtgagttccaggccaggctactgagcaagaccctgtctttaaataaacaagtaagccattaatgacatcatagggtcttgctctcttgacctcatatagttttaattatctccctcaaagtcttatcataaaaatatgtgaatttaaggcttgaccatccaacacgtgaattttgaaaggacatggttgagccttgtgacaccctgtgtgtattgcactgtgttgacagacaatggagatgcaggatgaagtaaacaaggagcttattgcaccagcaatgaaaatccagtgtgaagagtataacaaagaccaggaatgcccaatgaggcacagcaaaagagagagttgactctacagacaaagccaggaaagtgtcctgagaaaacgttagttgaaatatgaaggtggtcagttcattctctagaaaaaggcccaagatctaaaaaaattttaatactattaatatcaaatacaggtgaaaatttaggatcataaacctctagcattgtatttactgtatgtgttctcacaataaattagctgtgattttactggcccacaatgctattaatttcttccattcgaccttattaagatacaggctttgatcttttaaaacttacatatatatttcataaagcctaagataaatcagtaaaaactgataactaaaaaatagttcaaagttcttctcaacagactttcagttgataaacagtatgagagcaaccagactctgcccctaggaaaccatagcaattgcagctccaagcaagccccactgtggagtgacacacttgctgaatgaaggttcaagaaggccaggtatttgcataaactcaaagggtctactcgcaaatacatccacactgtaaaagctaaatgctaacacaggagtggcgaagcccagcaggtttcattgtaagtgaccaagctcattgccaactccaaaaggatgttctgaaaacatctatctcctaaagcgtagttgcaatgggcttattatttctgagcacactttttttaagggctgtgtagttatctaaagggtcaaagccacaaaagataaaggaagggaagagaatcatcctggtctactgatgaagggatttacaatcccaagttcagtctgaatcagagaatggacaatgtggagttgaaaggggacacaaaaagaaacaaaatgatttataagctacagatagtttgcaatactgaaccctgctgattcctttgtttggattattgtaccatgagtatacaagatattaacacaataggaatttgctgaaaggctgagtacaagctaaatctctattattttacagattttctacgtttaaaattatttcaaaatgtagtatcttataacaaatatatttctgcattaggaccatctcttcatgagttttacattgaagacaaggtatactgtttaaactaatctaaattatcctactatagaatatggagagagagagagggagagaggcgcagaggcagggagagacagagagaaaatggatatatttcggtagtgcctttattctagaattccaataaattatagtaacctagcaaagtatggaatttattcatatgattacttttgtcacttagtcattttgagcctaagattagccttaattgatttcaaaattagtcttaaatggtctagcgtttaaatttacatatttaaataaaaatattacacagaaaaagagcatcctccagtagatctaggaggttaatttaggggagaaaagaaaaaagggtggggtcttaaatccctccccggaaagaaaacagacccttctttatctccaggggactttattggcttgaggtgactggtgtctcaaagttgagctttcattctgaaacttgctaataacttttgttttcattactcacctgatacctctcttggcttttcctttatgacagatgattatcatagtcagcaagggactgtaactgagggatttttctaaactattcaagtgtaaggattttcaggtaagctgtctgtgttccagcattcaggcttgacagctttgctttgaaaccttgtaacagtttgtttgacctcaactgaacttcatgggcttggttgcaaacttgttccaaaggatatcttgcatttaaaacaggttgattccaggcctaattccctttgcttaaaattttgtgcgatcaaggtgaaaggtttgtttccaaggaaacaaatgcacaggatttttatcacataaaatgttttctacaaaaaaatcccataaccagtctccagggagacggtaagttataagatagcactcactggagaatttttttcagaagaatattctatttttgttattccgaaagcattctatatttgtgtagtcattatgattttgtattaaaaaaattaacaccaccacgatggccatcacctgactggagagccataagatgtacaatgtgagaccaggtggctttgctgaccattagtttatttttacattggagtctaaatagcattaatttgggaagtttcctgagggaagacaacctattnnnnnnnnnnnnnnnnnnnntctgtcttattaaattcttgaccttgccacagggatgcttgaattctgaaacactgtatccttcatcttgcagccttgacctagattataggtgatacacaaatgtttgattctgtgaggaaagagttaagtagttatacattgcaaaggcacatttttacaagtggaaagcaaagcaagtatgaaatgacaggttgaaggaaatgacctagcagtcaaaattaaaagtcacggctctgtcccttacctaatctgtgacagcaaaacactagaatctctctgtaaaagtgagatgtgtctacctcattaggtagttaataaatataatgtgtgttagaggtttatgtattgggagccaatgacatggcttagtgggtaagagtgcttggcactaagcatgatgatttgtgttcaaccacagagtccatgagaaggagaaactgactcaacaggttttctgatcttcacatacctgcaagagcacacttgaaggagtacacatatacacacacacacacacacatatctaatgaagtaacaaaattcattttacgaagagattttagtgttttgcggttacagaatcagtaagagccatgactttaattttgactgttttacacacacacacacaaacacacacacacacacacgtgtgtgtgtgtgtgtaaaacagtgtgtgtgtgtgtgtgtatatatgtatatatatatctgtgtgtgtgtgtgtgtgtaatgttcacatgtatttacacatatatacacataaatgtatagatgttaatatttttgtatatacatatttgtattcacatacccatatatgcacatgaatatataaatgcaacttggttagtccatttagtgttgtatatgtgtacatatgattccagggataaatacagtactagataatcatttacagggatcatgcccagggaaaactatttctccctctcttggcagtcgttagttgcttgtagtttttttttccacctagggatgagaccctgtgacaatttttttccatgcgagcaagtctattggtggtgtatatgttcttgcttaggatgctatagtgttgaggtaggagactgccattcttttattattattattattattattattattattattattattatatattttctttatttgcatttcaaatgttattcccttttctagtttcccctctgaaaacctcctattccatcccccctccccctgctcaccaacccacccactcctgattccctgtcctggcattcccctatactgggggcctctcctcccattgataaccaacaaggccatcttctgctggctatgcggctggagccttgaatccttccatgtgtactctttggtagtttagtccctgggagctctgggagttctgattggtttatattgttgttcctcctatggggctacaagctccttgagctccctcagtcttttctctacctcctccactagggaccttgtgctcaatccaatggatggctgagagcatccacctctgtatttttcaggcactggcagagcctctcaggaaacagctatatcaggttcctctcagcaagcacttattggcctccacaatagtgtctgggtttggtgactgtatagggatggatccccaggtggggcagtctctggatggtctttccatcagtctatgctccatactttatctcagtatctcctcccattggtattttgttcccccttctaaaaggaccaaagtacccatactttggtcttccttcttcttgagcttcatgtggtctgtaaattatatcttgggtattctgagtttctgggctaatatccacttatcagtgagtatatactgtgtatgttctttttgtgattgggttacctcactcaagaagaatttcatgaattcattgtttttaatctgagtagtattccattgtgtaaatgtaccacattttctgtatccattcctgttctggtagtactatgtccaattttctgaggaaccgccagactggtttccagagtggttgtacaagcttgcaatcccaccaacaatggaggagtgttcctctttctccacatcctcgccagcatctgctgtcacctgaattttttttattaggtatttatttcatttacatttccaatgctatcccaaaagtcccccacccactcccacttcttggccctgatgttcccctgtactgaggcatataaagtttgcacaaccaatgggcctctcttcccaatgatggccgagtaggccatcttctgatacatatgcagctagagacacgagctccagggggtactgattagttcatattgttgttccacctatagggttgcagatccctttagatccttgggtactttctctagctcctccattggtcgccctatccaatagctgactgtgagcatccacttctgtgtttgctaggccccggcatagtctcacaagagacagctatatctgggtcctttcagcaaaatcttgctagtgtatgcaatggtgtcagcctttggaggctgattatgggatggatccccaaatatggcagtctctagatggtccatcctttcttctcagctccaaactttgtctctgtaactccttccatggctgttttgttcccaattctaagaaggggcaaagtgtccacactttggtcttcgttcttcttgagtttcatgtgtttagcagattgtatcttatatcttgggtattctaagtttctaggctaatatccacttatcagtgagtacatatcatgtgagttcttttgtgattgggttacctcactcaagatgatgccccccaggtccatccatttgcctaggaannnnnnnnnnnnnnnnnnnntggcagacctctcagaaacagctatatcaggttcctctcagcaagcacttattggcctccacaatagtgtctgggtttggtgactgtatagggatggatccccaggtgggacagtctctggatggtctttccatcagtctatgctccatactttatctcagtatctcctcccattggtattttgtttccccttctaaaaggaccaaagtacccatactttggtcttccttcttcttgagcttcatgtggtctgtaaattatatcttgggtattctgagtttctgggctaatatccacttatcagtgagtgtatactgtgtatgttcttttgtgattggattacctcactcaagaagaatttcatgaattcattgtttttaatagctgagtagtattccattgtgtaaatgtaccacattttctgtatccattcctttgttgaggggcatctgggttctttccagctcatggctattataaataaggctgctatgaagatagtggagcatgtgtccttattaccagttggaacatcttctgagtatatgcccaggagaggtattgatggatcctccggtagtactatgtccaattttctgaggaaccaccagactgatttcaagagtggttgtacaagcttgcaatcccacctgcaatggaggaatgttcctctttctccacatccttgccagcatctgctgtcacctgaatttttaattaggtatttatttcatttacatttccattgctatcccaaaagtaccccacatgctcccccacccactcccacttcttgctgaagggatcctgatatagctgtctcatgtgaggttatgccagtgtctggcaaatacagaagtggatgctcacagtcatctatacgttggaacacagggtacccaatggaggagctaaagaaagtacccaaggagctgaaggggtctgcaaccctataggtggaacaacaatatgaactaaccagtacccccagagctcgtgtctctagctgcatatgtagcagaagatggcccagtcagccatcattgggaagagaggctcctaggtcttgcaaacttatatgccccagtacaggggaacaccagggccaagacgtgggagtgtgtaggtaagggaacagggcagggcgagggtatagggaactttcgggatagcatttgaaatgtaaataaagaaaatatctaattaaaaaaatacactgagactgtctttcctaagagtcaatttcacagcagaatttcttgtcctctggttcttaaaatctttctacccatcctttcacaatgttccctgagccttaggtatataggttgagttgcagatgttttaagtaaaactggccaccccacaaatcagctattctctattcttggatcagttgtggctttttgcaatggtctctgtatgctgcaaatagaagcttctttgatgagggatgagagattcacttagttctgggtatgggtataattatttattgtgttcttaggaattatgctagtttagtaacatggcagcaacatgttcaattatactactttagtaatgtgaaagcagtacattctctcttatgatacatgacctcactagccccaactagttcactaggcttatagtaccaatcaccaattcccttctgttaagtgggccttaggtccagatagaaagctaccaccaagatataagtattgcacatacagtgatatattgccatgctagtaatttttatggtgcacaggcatcaaagcttggtaggattattggttgacttagaagtataggctgacagccaaagttgagggaacggattgacttgtgaaatagaaagaagccttgtacaggagatctggaagatctttttaaagacctgacaataggaacataggaaattgtaagtactgacaagatatgatgtcagatatcagaaaaaccttcaacagtgattcattggttcattcattcatgcatatgataactactcattgagtgctaagtgctaaggactaggctagataatgtctacatgcatgatctcttttgaaaattagctaaagcccatgaacgccatgtgtcatatgcggaagcccactattcagacctctgtaaggtctgacctgctcttactctaccagctgctttctgacaatagacattttttgctactgtccagggctgtgctccctcctgggagaagctgacatctgatcattagtggatgcgtcttatgtttagtctcagtttagaacatcattgaaagaccatgatatccccatagtaccagcagactcagtggaagatttccaggctgcaaaaccaccattcactttgctttctgattctgtttctctttaccttaggtatgatttccctcccaaacatcagacactaaacctcttacttacaaattttaatggcctattacatttttctggaaatgattttattttctgcatattcctctgtgtgtacatctatgcatatgtgattgtgaccatgaaggccaggggacaaccttaagtgttataaactaagtagcatcctttatatgaggttctgtctctcacttgactgacactcaataagcaggctatgccagctactcaggcagcaccaattgtcctatttctatctccccagcactgaggctcaagtacaggctactatgccctgcctttttacataggttctaatgactgagttcatggccccctgcttgcagagcaggcagtgtactgattgagccatctctccaggtcctgacaatctgtttttataatgaaggttctaatgctacaaaagttttattgcatccaagcccaacacaggcaattcctagtggcatccagactttgtttctaaatgccatgcatattataacagttcagcaatgcaaagtgaagtacaaatttagaactgtccctacaaggtcatgtgatcaactcagtcccaggaaatggttacgtaaaactaagtctagagatagggtcatgggctgaactgttatcattaccacaaaggggaggggacctggtgaggggatggagattgtcactgtcaccagttagaaatagacatttgcaccatttatcttaagagaaccttgctaatgagtcactccaccaagcagatacttgctcaaccttattattctctacatgtaacaaaaattagatgagcaaaataaggcattatcaaaaaacaaaacaaaacaaacaaaaaacacaaacaacccccccccaaacacacatttcttatggaaaatatgtatttaaaaacacagtaacataaaaaccagatactaaatcaagaattgtgcaaggcttaggtgataactnnnnnnnnnnnnnnnnnnnncactgatacccaagcttgtaactactaatatgatgctatagaaggcaaagtagaggggaactactacccagtgaggctagttgaaataaagagcctgagttcagttagtgatgttgtcttgaggggttaatgcaatgttgagcaggacaccaaagtcttcctctagcttctacaagaacacccatatacatatatgacacacatgtgtgtgcatgtacaacacacacacacacacacacacacacacaacacacattcacaaacacacacaccacaacacttatacatatacacacaaaccacaacatacacacacacacacacacaaacacacaacacacaacaacacatacacacacatgaccgccctgcacatgcacacatacatcccacaaacacagacacacgatgttccaacacacacacaaaacacctgcgcatacacatacatgaaatgagaagctatgcatacaagataaaattagcatttgtgataaaaatatgtcaaataacataaatgggaaattcagacaatgcccacattaaccttcagtattttgcaaatgccaaatattttactaactagtgaagaaatgatggacaggtattttaaatttcttctaatagaagttgtatatcatttatctgaaatgcttgggaaaagaaatatcttggatttcagaatcttacttgcatatgcatactgagatatttacctcatttcggaatggatcacaatcatcaacacaaaatttgtcatagaccccttatttgcaactttttacattttaagtgattttgtatctgaaaaaaaaaatcatggtgtggaattttccacttgtgttatcaagttgccactttaaaagtcttcaattctggagcagtttggccagattctcatattagggttatacaaactgtagttaacgattcacttctaacaatagtattgaggacctcctctgtagtatacattattgtaatcagtagagataggacagccaaggagaggaatggtctcggcttactggtacctctcattgtaccaggagtaccaaaagggtcaataaatgaacacagggtggcaacatctgtgtcagctgacatctgagtagccttgaacaaaaggccgatttagaggcctgtggggggatgaggtgaacctggaaaagcagagaggaggaaggatcgctgcgcagagcaaactggaatgcatagatgagctgcatacatggggcctttgaagtagactttggattttattttgtgtaaataggaatagtttggccttttctttccctaatggcatccctttatcatctttcccttactaacagctccagctcgtacttgaagcactctactgtaaaggagtgtggatagtgttcatgcctgccttggtcctgacttcagtgggactgcttcaagtttttctctacttagatggtgttaactgtgggtttctcgcatcatttttattgtgttgggcgtgtttccaatagccttaaattttctaggactcttatcaccaaagcacattggattttgtcaacaggcttttttctgcacctaacgagatgatcatatgatttttgcctttaagtccctttcttattacatttactagcttgggtatgttgaaccatccctgtagtttagaagcaaagccaccttggtcataatagataatcttttcgatgtatgtccatattctgtttgcaagtatcttattgagaatatttgaatctacgttttattagggatattggcctatagttttattttttgttgttgttgtctttattgttgtgtttttctctagttttgacattagagtttcattggctttgtagaaggagatagagaatgcctcttctgtttttatttttaaaaatattttaagaaggttgtatttatatatttagaactagtagtggtacatgagagtgttttaggtgaggaaagaaagaaggatatgatgcaattatattataatctcaaaactaaaagaactaataataagaaaactaaaagtaaaaaaaaaacataaatctatagactgtgcaatgctgagtaggcctaatataaatatagatttgagaagatgatgagttcagatataatcactaagtacatcatgtagcactggggatgatgataatgagaggccatgcccttctgggacaggaatatttgggaactctgtaccttatgctcaatgactcaatttgaacttaaaactgttctaagaaatacaatcttgaaaaaaagttaaaaagaaagtaccagcaaacttagaagagttccccaaaatgatacagtacaaaaatatggaaaaacaagaacacaccaaatcaaacccagtgaatggcctgacacaataaaaatcatagcataaatcagtgagttaaaacaaataaaaaaaattacaaaaaattagtgatttgaagatctggttcttcaagaaaataaaagtgattgagcaactcttggctcaactaatctaaagaaagaaagagggaatccaaattaacagaataaaaaatgaacagaaaaacactatcacagacaccaaagaaattcaaagtactatgtgagtgaaaactttaaaaacccgtactccattaatttggaaaacttaaaagaaatgagtgaatttctatattcagctagatcatcaaaattaaaccaattgatagtcaacaacctaaacagacccataacaaacgaggaaatcaaaatattaataaaagaccttccaactgagaaaagtccagggccagatggatacggggcggaattctcccagactctgaaagacatctacagccttctcattctgtatagtgttacatgtatgtacgtaagtatgtacgtaagtatgtatgtatgtatgtatgtatgtatgtatgtatgtatgtacataagtatgtatgtatgtatggactagccatttggtatcagagaaccagttagtgtgctctccctgggaaaggctacttctcctctgaaggatgcctggagatgtttctgtagggtatgggaggattcaggagctttcccctgtctactttaaaatgtctattattgttgttctgtttcagctaatgctttgttagtcatgttggtgagactttatgggtgtagcttctatcattttagaagacacagtgtcatgaaaaactcctttatgccctgtctcttaggatttctttctaccccctcttctgcaatgttctctgagcctgaggtctgtgaggtgatttgcagattactgaatggagtccacaaatctatattttgattagttgtgattttatgtaattatcttcagctgtcacaaagacatgtttctttagtgagttgtaaggaatacatttatgtgaagatataacgataaatatttattacactgttagtgattattctggcttattaaagtggtagttataggtattcctctaagatacatgacctcacgagtgctgggtagttggctaggtttccagtacaggcattgtattcctcttgtgtatgtgtgggctttcgcaggtctttaagtccaatgagagaactcttggttgctgccaagtgccactattgaaccctgagggttatcattccatccttgacatgattcatagccattataaggagctagggcttttggttgcttccctcatttggaagttgcatgatgccttttgataccattatagatagtcctcaagatcttcaaatcagttttagttgaggggtctctgggcactgtgtctggagttcatggcatctttagcaatagaagcttacattcctcctttgcagaggggaccaagagtagtaacaatagcctgtaatgttttgggagggagataaatacagaaggagaataaaataacagtgtggatgtttgaaaaagccataaaaactcatactattaactatctacctaaaatacccataatacatgttacttggttatataaatatacatacttagtttaataaaactttctcatttgagctgacaatgctctttccaagagccaaaggcaacttaagaaaaaactccaagaccaagcctgaaaagcccatttctacattgttgtccactgttgtccaagagatgctttctgattttttaagtgtaggatttaaagctataaatgttcattgtaggactatcttcaatgcttctgagaggttttgctgtgttacgtttacgtggtgaaaatcctattggatttgtgattggtttttcttaagtaatcaagtgatttggtcttatatatagtttagtaagattacaatgaccctcaagaagccctgaaaatcatgagggcattcagcagactttcgtattagttattgtcctgtgctgaagtggaacctcttagggaacagtacatgagagtgggtggaacagagacactttggacttagagagatctaagttcatacccagctctttctagtaggacattgtcctctaatgaagttctccagttgataaataggaatggtaggagatatattgcagggcagtttttatatttagatgatacatgttggcacttacatgacagaaactggtgtgtcatgtggcagatgagagtagaataaaggactatgatatacctgtgctggatctctgtccttatttggtgttggtattgatagaaatcttagaaaggcctagaaatcaacttttcttcagagagaaggaattgttttaggagccccttggcttcaaatgggcttttaagtgaaaggctagtaaagacatggactgacatgtttaattcttatttcttccattaatcaatttatttattcaatttataccccaatcacagcctccccactgtcccttccccattcctccttccctttcatctctgagaaggatgaggtctcccctgggtactatcccaccatcccactgagacagctcaattaggggggcaggatccacaggcaggcgacagagttagcataaacccctgttccagttgttgggggatccacatgaagatcaagcttgtgcatatctgctgtatatgtgtggtagggaggggcaggcagtaggtccagcacttgtgtgttctttggttggttgttcactctctgggagcccgcactggtccaggttagttgactctgttggtcttcttgtagagttcctatctcctctgggttctcagtccttcctggaacgcttccataagacttccctagctcagtctatctctgcatctgtttctgtcaggtgctgcatgtagcctctcatataccagatacactaggctcctgtctgcaagcataaaagagtatcattaatagtgtcagggattggcttttgcccatgggatagatctcaggttgggccagttgttggtttgccattccctcagtctctacgacatctttgtccctgtacttccgtaggcaggacaaattttgagtgtaaggttttgtagctaggttgatgttcttaatcctctactaggagttctgcatgcctacaggaggtgaaaacttcaggcctcatataccccactgctagaagcctcagctagagacaccctcaaagactctttggagcctccctcatcccaggtctctggcatgtcctagagatgtcccccacccctggttttcattcacgcccccctacatctgatccccacttctactttccattccctccctccaactctaatgacaatttttattttcccttctgagtgagattctcactgatttaaaattgcgtactttgagccttcaggcatattgtttgctgtctgcagtgcacacaggcctgagcaactcaagtaaccacttgggcaaactgggctacatttgtagtgggtatgtgtgcatggaatggcagctccttttaaccttagcaattattcagtacaaggcacatggaaggccagcatggtccattgatggacttttttttagcacaaggagatttagctgcttcaggaagcacagaaagtcaattctgaaatggctaaatatttgaaatgtatacaaagaaaatatctaataaaaagaggcataaaatcagggatttttgcttggaagacatgcaacaggtcagagacccagaaatctctttctatagtgaatttttgtgaatttttaaaacatggaaggcaaaatgaagcaacatggaagggcacacagaaaaaaatagttgtggatatagaagtgggcaggttgtgtctgtttcctgtcagcaattaagcctctgtccagcactatctgtatttgccttacactatgttccacagagttctaaagttcagatgaaactccctccttctaacacgccatgggcatttttgaatattactatcaatcaggtatttgatgaaatcccactgtaatagtaatattaattactattgcttaggctagaataaataccgcagtcttcaacttcactaacatatcatctgtaagtcctgcctctctgtcctttaccaagtggaaaactcatccttaggttttgttgatgttttttaacccttagagtgatgcacagttcttggattttgttaccaagtgtgaacacaggccagacccgtaagtttggctgttggccctacaggatggcctgaccataagaagaagtctctagttctgattctcctgtgtctttaggacctctctggaaggttgcaaatgcattcttgctgtgactggtacctagggagcttaagccagcttcctctgacctaatctgttcagaagccacaaaaccctctccattgtagaactgaataggaaacaactcccaggagctttctgttcccaggacccagctaggggatgagaagctggaagctgggttaccttcccattctctttatggctctttttatcactgttctaaaatctttcttcctccccaccattacctggacaaagagctcagatcctgcccctcacttcaatgggaaaaaaaagaaaagggaaatgatacacagagaaaagtatagattgctttctcaagtgtcatacagacaaaagtagggaaaaggattgctgagatttctgttaaaaggtggcgatgtctctagaatgagatagggctacagatgagcaagtaaaagacccaaagaaccagttactctcatgctggaaccatgctggcttcctagggaagacagactgatttagcctgagaaacaattgtgtgttggacagggaattacagaggtggcattgcagaattgctttggataatccaatgcaatcacgggtagcttatcagcctcttaacttcataacaggatgcaccaaaatagacatggcacttaaaacatctgagctctcaaaggtaccatggcccattctctcttctcagaaacatcacagccctcttttatttctcctgcatttgatttttctctctttcatgtttcagagcctaaaaatctcctactaatatcagatactacattcttatttcacagatatctttagactcagcatccaaaaaatgtcaatgtggtttggtgggggtgaggatgaatcctgttcctagaatatataataaatattcccgactcacttaagttatttggtggttttatgatatgtaaggctaattccacatttataaaaaacatacatagaaaatatctacttataactttgcccttatggtcaaatgagtgaaaaggtggtttataaaatatttgattctctatatttccttccttcttttttttttttctaaaaatcttattgtctgtccatcacaaggcaaatattttgttttgatctaggctttgaagctatatagatacataaagcacacttacttcctttaatcaatactgtttaacaaaagacagactgtcgtcataccctgcacgagaaggctaactatactgtatgaatgaaagaggacacgagttggcctcggcaaaggattactaacctgggctccacagtaagaacagcttggggtgcactgtagagagatgagaacacaacaaaccacaaaacatctcagtgtcaagtatgtgtgtgagaacaatggtctattaggcataaaactatagcgaggtcatgcaacttgaaataataaacacatagaaataaaattatcattataaaatccccacgtgctgatgaaaaaatcaacaaaggatctagtagactcaggctttttgttgtagtccatagtctaaccaaatgggcccttgggtcagtagatttgatatttcaggccaaaggcagagaaacacgctaatctaattcatgggagctatgatgaggattgcagtgggcacactgacagtaaagatggaggacagaggctagagtaataccttgtgcttgagttggctcttgggagtactggcatcaatatggaaattaatgatggttgatatagataattgaggaaaacagaggcaagaacaagtttatgtgagaaggaattgaatatggagcatgtgtaattggagggatgtgtgaaactcccacgtgcagatgtatcgacagacactgtggtgaggagcctgtagctcaaaggagagtggccagggatataggagcctccattgcttattacatacaacttgagagacttcctcccaaatgatctcttggttgttttcagttctcccaataacctcatttttataactaaaatatctgataatatatagtatttgaaatttcaaatgggcattcaagtcaaaaattccctctgacatttgatgcatgtaaaagataggataagggagaaaaattcaaggagagaagagagtacctttggccctcttggttggcatcagtctactctgatattgatatacttggttgtttcaaatgtctcaaagtgaccttggcctctgtggaccctttatgggcagacactatggagagccatctatgagctaagctgacttcagttaagtctctgtctataggttgttatgatttcttcccatcccacccttctgttattccacttggtacatttttgtcttatctacttcaagttgtgctctggactagcactttagactaaagtgtagttgttctctgtgaacttggggcttcaaatgtaattaatgtagaatgaattctgttttcatgtcctatactaaaattaaagatccagaagccactttgagttgataattgaaatcatgaactaatgccctccccatattcctctctgccagaagaatacttacaatgggagataagtcaaatggggacagcttactgaagaaagctatcatctggaaagtgagaaagggcaaaaaagaaacaactatagagatgcaggagaaccatggtggtaaacatcacagaattagacaaggtggtattataaagaggacatactcagcatataaaacactatgaggagttacaggcagaagagacctaacatttaggaaagacatttatgttcagtgataagggttatcactttactctttgatagaaaaatctgtttaaatgtggggaagaagtggcaaagggtttgggggaagtattgaagaagacaacagatactcgatactagactagggaggtgcaagatcaaagtcaagtgaatagaaggaaaccagatgttaatgagagttggtccaaagggtcaggaattgaggggatgactgaaggcgaatagtgaaagccaagtgtcggccctttggggacttttatagcctcatagcacttaggaaggaagggaatcaagagcatagtgatgagatagagactgattagaaggacagtctcatcctccaaaggagtgacacagaagcatgcatttcaatgcctttgttcatggcccagaagttgaaggtggcagaaagttgagagagatcacagtagattgcttgagttttctcactgaagttgaggacagagctccagagtgtggtgagtcactggctgagtcacttattctaatccactcatttagaaactagaaaggccgagttgcatagtgtggtattattatgccttacacagaggggcagaaatagtgattcagaaccatcaagtgacttgcttgaggtcgcccaggtggctaaagctgcagtctgtactatatcaagagtctccagatttgtcggaaattggcatttagtagtcttaagagatgtttatgtatgaaatttagcaggccatcaaaaaaaaaaaaaaaaacccaaggtgtaaaaatagaaaataacagaaatagttcaaagtagatgtagctttcatcacctttcccctctccatataatgaatgaccaagctttagcaaatacttaccaaacatctaaaatctagtcactcttagaggctctgcactaagatgccaaatatataacaatacttagtgagcactgaccctgtaccaggaacatctcaaagagtttgcatatataaatgactgtaatcttcaaaacaacccaagaaggaaggcaaactccaatatctccatagtacaaagagagcagccaccatccagagaagctaactgactcaaacgcagccgccatgtaatgagctagccttgctcagcctcagggcttatggttttgacacggtgatacagtttctgctcccgagaagcctcttttcttcaaggaaaacaatgagactgaagggttggttttcccaaatgaagcattctgtagcaggatgatgaagcagttcacagtgagaaatactagtgtgtatgatggcgttaaactagcaagttccctcaaatcagaagtctatgaaggagaagccactgtggactggattgtctggcaggtaggtttgactctccctaatctgacaatggtaaggagcttgacagtggacaggaattgtcccatcattcatcaaaattgtacccatccttcatttttcatgaggaaatgagcaaagcaagagttggggtccaggaaaattcatattcactacttcctgcttcatccatccagtagagagtcattgattgttctgctcagtgttgtgctgtgtgtgagaacttcaccgggtcaagattcttgggttagagatcacattttcttatcactgtatcacacatttcacagatggttaaggacagaaatgtttgtttaatttaattgatgtaattaacatagttcaggtagttttttgtgtatgtgtatttgtataaacgctgtaggctctgatattaaacccaaatcaccaagctagacttttgctcctctcaggccagtaagtacctctcttggacttttgttttcagtgaacctaagttagaacacctcctgccatgcaataggctctagtcccatgtaactaacagacaaacaaatgatcaggtatcttgaccctttgctgtccatggaggatttttggattgccttaaaaagctactggctgtgtttctagtttatgtacctatggatagtatattgtaggaagaagtttatattgagacccaaagcatctggttgtagcctttggactaatattctatcatattgccaaaaagcaaatgacttaaaacagcccttatttattgttgcattttctaaagatcagaagtccaaatagatcatagatcaattgtttacattcccaagctaagatcgatttttgaggttttctttctggggacttaagatagtgctgtctttgttttctgttccttgtggccaaagtctctctttctcacccaaaacaactagaaggattacttggctcattggtgttggccctttcttgtcatttgctccccatatactcaaacttgtgaaagtctattcttctatgacattggctgtgcctgtctttctcttctgattaatttccctttttcttaagtaaaattttctttcttgtaacaactcttggaatcatatcggacctatcaggaaaattcaagttaaaatttctatcttaaggtttgaaacctcagtaatgtctgcaaaatccttttgttatttagtattatatcttcaagcattcagagtcactaagacctggacagttttggaaatccttctgtcaaaaggtatcctatagggaatgtgtgttcgttactcagaacaaaccctgaagttattttttctgaaaaacacacatctgctccagggctggatgtctgctatctcccagaagaagtggaaattatttgaaagaaaatacatttcaacatagttcccgttgtgtcatacattacattcttaactcattcaaggaacttagaaaagactaatagttgtggtggcaatgaaagtggtggtagtattagatttgacatgagagaatatgtcaattaccaaggcaaattcaagccagtcaaatttaggctctaccttatagacgtgacaaatatacagataaaatgaataacaagtgtattggctatttttcttttgctgtgatagaccacgctgaccaagaacaatgcagaatgagaaaagggttatgctgggcatggtgacgcacacctttaatcccagcactcgggaggcagaggcagacagatttctgagttcgaggccagcttggtctacaaaatgagttccaggacagccagagctatacagagaaaccttgtctcgaaaaaacaaaaaacaatgagagagagagagagagagagagagagagagagagagagagagagagagagagagagagagaagggttattttagcctacagttctagaagggatagtaatccactatgttagggaagacatgaaagaaaaagtataagatgatgctggcagtagggaaatagtttacatttccttcctgtaggggaggtcagagagaagagacagtggaataggatgaaatagcttaaagcctggcaccagttacattcttccccggaacaactgcacctactatacatttcataacattctcaaacagcaccacctactggggatcaagtgttcatactcatgagcctatggggaacatgtctcattcaaaccaccaggacaagtagacagaaacacagaaaattctctggaattaagtaccttttatcatcttagtagcttttcttgatgctcatcttaatctattcttactggatacagattacacaaagggtgggagctcagtttgttacctgatagtttacatcaatcaccccttgatgcaatgccaatcttccaaatccagccaaaccaaccatttgaagaaactgcctcagagaaggccaggcactaagaaaggtcagaaaagcaccccagagttaaaaatagagaaccaggaaacaaaggacacagtgcaacttttacaaccacgaattaaatgcaaagaatgacacaccattacataagctgcagaaaatatcatttaaatgtcaaaagagctgaagatggctctaatcatggaagaaaatcccacaaaatatgttcaatgccttaatttttattgtacaaaatgtaaaaaaaatggtattgtttgatgacataaaatatagaaatcacttgtatatttctgactgctcataggaatctctatgtctattttatgcaactttagcttttttaaatttctaagactttcagagactgtgactatatttgaatcaaagaagattaatttgcctatcctgtggaagtataatctgagtgctattagttacagtccagtcacttgtataagctagctacatcttcactgggaggaacgggggcaggataaattcctctaattgtatgactaggattgcacatacatttttatcctcttgaacactagcttcgtggaaatcggttctggtacttctgccgcctacttgcattttagagctctgttttgaagcttgagagatatatttaaaaacatcatattaacatttttagccttgtctggatacagtagtttcacatatgttgttttttggcagatgcagaattttactaggttttggttgtcaaagatatcaatccaagaaaagctaaatataaatgtacatatgtgtacatgcatgtgcatttatatatgtatgtatacagaattagtttttgtctgtttattaaacatctattgagcttctactttgttctctgcaatgacctgagcactgagaaaagattattaaaacacaggtctcaggctccatagagctattaaaatacttttgagggaaaaattaaaactgtatattgtggttattgctgcaataacagccagaagtacagacaacaaagtttgcaaatgtagaaaaacaaaacattaaatgaggcccaaaaaagaaaataaaataaaaaagtatttagcaagacttcctgaaatgagtttattttagtacaaaggtcttttaaaatgcattgtttattagatctattggtgatggagctttgggtataattctgcaagaatatgggctatggagaattagaggtagagtggaagagagagaaattagtcctgttaaaggatgcctataactatttagggccgtggtttccataagcccaaatctattaggagcaaagagtggggtccatcttcccacactaaagaaaaccaagccaagtagcttatctgttctggaactgtgagcatcaggatttgaggggcaactacagcatccacttttagaataaccttcttccggccagtcttggattgtgctacatgttaggatatgggctcctcttctctatcagatactactccaattaaaactgaagcacaatacacccgcacacttgagggggttttgaaaacagctagagagtaggggtagcttgatataagctcaagaaacaggacaaaaggtagcaaggaaaccatcaacaagtccccagcttgctcacagattgctttgctcactcaaagcactccaaaattagaaaagctacagtcctttgccaagaattcagtatgcaaatatttcctaataaagaagccataggagaaacttgaaatttttgttgcagtgttccaacacactgacagtgttttttgttgacagcgcaagattagaaagcaagcacaatgaagttcatttgcaagaacacctgctttaaaaataaccctgctgtcacaggaaacaatttctggattggcttgtgtgtgtgtgtgtgtgtgtgtgtgtgtgtgtgtgtgtgtgttggaaaaatctagtgaatatgaaatactgaaacatagctgttatttacatatctaacactagcattgagaacatttctttttatttcaagtaccacagttgtgttttgattcaatgatacagttttgctcttttatataaaaaataaattaatacgttattgtaaagtactttcaaattttctttaaaaaaaaggttattttgtgatattagtcagactcaaagtctatgcatctcaatgaacatccatgctgttagaacagccattgtgaagccctggagctttgccctgtgtcttactctttcactagaaattgcactttaatgcatttatccacgacaaaaataaaaataagaaaaaaaaacctgacagctaaaactacatggatatatggtataacatattctgtgagaacaagagcaagaagaataaatattaggaaatggggggggggtagctgcaagtaaaggacgtgtgtaagaggatatagaggtgatgttacaactagcaattgttggtatgtttatagccttcagttcagaaaggcgttagaagtaaacagtagtagagggttagcttcaatactcacttcagctaccagccaaatctctagacagaatttttctcccaacatcaagcaaaagcaagaaaaaacataagcaaaaagaagagacacataaaacaagctgtggatatgatgtgaagacctccacacagaagccaggtactaaattagaacaggaagctggcgaaatgctagaagaatcagaagagtataacgttagtccaaaaatacttacataaggctgccctttcccaagacacctggtgagagagagagagagagagagagagagagagagagagaggagacagaagaaagaaagcaaagaagacagaacaaagctactgtcttaaagatctgccttctaatgagggaaacagatccatgcacagctctgaactctttacatggcagaaagttgacgtaagaggagatggtggctagctactatttgaatggaaccttcacaagtagggttgatgtcaacaaaaagagaaaaagaaagtcataactggtcaaggacaggtaccacataagtttttcaaggcaaacatttgaccatgggagaagataagaaagacaagaggacacagccaacagggctcctgagcacacgagggaagcacagtactatcagaaggtctttgatactatgcctactatagggattcttttaggtggagaggtgatgttaggtggtatgtggcagacagttctagacattcttctttgggaacaatgcattcattctagtttgagaggcaaagcatacatggaaagtatcacttactgtctcagaatagccttgtgccctcagttggctatggaattcaatccaggccactgaccataaacaagtttttagaaggtattctggaaggttttttttttttttaatggaggaaagacatgcctgtcttctcctatttcattttttttccatttattcttctttctagtcagtcttcaaagatagccatctcttaactaggatggcttacgctaagaatcctagaggaagaaagaaagaaagatagctactctggtttgacaaacttccataaagttccaccttcacttttacaagccagtgcatccatgaaatatttaacttcctcaggttgcagagcggatagatgtgtggagtatctcctctctatgctctggtagctagcgatccataagctctactgcctgcacctgaatatttaatgtgaacattaatttctttctttccagacatttgtcaaacactcttgattgcctactgtgtgccagaccccatggcaggtgctgacgtattaagatggaatagcaaggtgcttgctctcaagctcctgggaacctgatcatctaaaaggaaaactgcaggaaacaagtaggcacataaagagagctgaagaaagaatgtatattgttaatcataggaagccaagctggtctgatgctgttagatttcaaaagaatcttgtctatagcataacttagacagcatggaaaggctttctgcaacaatgtattaggctactaactgtcctgatatatagcccttacttcaagttaggtggatagggtctccctcagtatccaactatatcgtcaggtattgtgaacccttctgtaccacaaaagttaaaatgggattttagtggggacaagggaatggtgatatctatctttatatgacacacacagtgtgctgtcagtccgagtctcacaaacatttagaaggcatgttcatgtatttcacaaatactgtggttttcagagtatggtaggtgatttccacaagcacatatgtgtttctattacttgttcttaaagattattgagtgagaggctggagagatggccctgtggttaagagaattggctgttcttccaaaggacctaggttcaattcccagcacctactaacggtatataactccaataccaggggacctaacaccctcacacagatatacagacatgcatgtaaaacaccaatgcacataaaaataaattaaaaattatgaaatgagataaaataatacgggtatttttctgcttgattctctacttctttgcctctgcagtggttggttgagcttttctggacattgggtattgtatttccttattgtcatagtatccttcactggtggtgagcaatgattcctgcttttattaagaattttcagggttctgaagaggtcccagtaagtaagaggacttgctttataagtgtgaagacctcaatctggatcccaagagctcacataaaaagctgagtagagttagctaagttgtacagcattggggaacagaatcaattggatcccaagagcttgctggccaaaagtgttagctttttattcagtaatagacattgtcttgggacaataagttctacagcaatataggaagacactcaatgccttgtttggtcctctgcatgcatattttcacactcatgtacatgtgccatacacaaatactcaaccccaaaacacacaaatttcatgtatgctttgaaaaattatgcagcttctgtatgatgagagtatttatttagctttacaaaagtcagttaggttggaaaagcatttgacagatcaattgctgcattcacagaggtgacaactgccccctcttcttcctctctcttctctcctccctccttcttcctcttcttccctcttcctccttcctccttgctttcctccatcctattcttcttcctcttcccctttcctctttctccctcttcctccgcttccaccccttctatgttcttctcctcattctaatagtatctctctatgcagctcaattgtccttaactcaaactatcccaagctagcattggattcctgatcctcctgcctcagccttctgattgtggaattacaggtgtgtttcactgcaccctatattcctataacatcaggttaatctgtcaaagaccatcatgatgaacaagaaatagggagggttatgcatgggcagcacagtttgtgtggacttatttagcctagacctttgcattcatgagcaggttgggacagttgacactgtaaaacagttcctaggatcaatgcttacaccagtccctatgagtgctaacacccaagctgtgtggtaaacacccacagtcagctcacacagctctgagctgagatatgtaaatatgcctacttaaacctcacatactaagtctgtggattacctgaaaactcaaggttatgcatgtatatttttcttatattctaaaacatatctctctatggtattatggtggtttgaataaacttggcccatgggaggtagcactattaggaagtatagccttattggaggagatgtagtcttgttagaggaagtatgtcattgtaagggtgggatttgagttctcttatgctcaagctccatacagtgtgaaagagagtttcctcctggctgccagcagaagacagtcttttcctggctgtctttggatcaagacatagaactcccttccagtcccacatctgcctgtacactactatgcttcctcccatgatgataatggactaaatctctgaaacgtaagctagctttagttaaagagttgccttggtcatggtgtctcttcacagcaatgaaatcctaagacagatgtgaattatattttaagctggctttccaggaaattaaccatgttccgcatactgtacctgtacactctgcccataaaggtgacatgtgattccccaaatcgaagattttctgacacagagctctgtgcaactgtagcgtctgggcatacagctttgtttccatttatgctttcaaggattttatagatgactacacttacagatcatgaagagataggtgaggtgcttgtgatgctcagctgagcgggccatcgcaatgtggaacagttcagatggagggaaaacaaatcaggtcttagaactcatcagcacagtttgtcttagagagtgctccacactgagctaatagcttttcaaaggatcactttttaaagacatggagagtgtttgcttgttttttaaattgcatatatgtgtgtttcttgagtttgggtttgcgcaatgcttgcagaggtcaaaggatggtgaaacatcccctaactcagtagttctcaacctgtgggctgtgaccactttggaggttaaatgacctttttacaggggtctcctagaaagcacatattttcattatgattcataaaagtattaaattaaagttatgaagtgccaatgaaataattttatggtcggttggcagtcaccacaacatgaggaactatattaaagattcatagcattaggaatgttgagaaccactgtcctaactaaagttacagttatatgcctcctaatgtgggtgctgggagttgaattgaagacttttataaaggcagtatgtgctcttaactgcttagccacttcttcagcccctcaaaagccacttttgaattagtaagtaaattagcatttattgtatttgactcacttagtagccaataagttgagatatactgccattttgcatggcagttcaaaattgacttttcaaatatcaccgtgttagttcatgggagaactaagtcagggtccttgagctcctgcccactggtgcatgttaccagatactttccacatgcccatattcacagcctccccccaacttccccaccccaccccatgaccacacaattttaggaaaggacattcatacacacagatcatattgccttttctggttcaaatgcctggtgcagggtaaaagctattttctaaatccagtaaatcttgtcaggctagattcagtgcaactctgtgatggcgtgaacaaattacagatggcagcaatcgtttgtttccgggttcagggagcggttcttagccactttattctgtcctttaaagtttcctcttggaaattgtctcaaatcactcagcaagagaagctagaatgaagaggcctgccctgaaatgggacaggtgtctttaatgatatattgacatctgaggctctattggtcatgccccaaactaaatcgttggtagtcttgcacaagtcaacagaaataaaataaacatactttttcttgttaaaaaccacacttcattggtatcattaatatgataatttgctaacttcctgtgaaattttatgtaaaatggtcttttgttaaccaaatcttagctgttcttcaggaaaagatcacagggtactttttgttttttcctgcaaatctcttctttctacaattctatttcccttcacttccatgcctaactttcttccccctagcaaatgtgtattcttgacataattggttacaacttccctactatgagatatatccttatgaagtatccacatcaactgtttttagtttattcacagaattgtgcaggcaatacaagattctgaacttcaattatttctaccttctgcagggaaacaatatgtctgcattcactctgtacagccagaagccccaggcacaagtgatctgcattttgtttctataaacttgcctgctctagacgtgtcacaggaataaaatcagacaatatgtgatctcttgggataggcttcttcaaccattatctccaaggcccactcctcttaaatgtttaatagtattctatcatatggatgtactgcattcgccccatccacttgtcagctggcaggtgtctgggttgcttttgcattatggttatcaggaatacatcatatggtaaccctctttaaacttttcaggaattgacaagatttgccaaagtggttgaacgattaatgtcacagaaaactaatgactgtttggtacttccaaccctcagcagcaagtccttttgctcctttactctttcacttacctttgccatctcaccgagggtaagtgacttgtcactgtcgtctttaagcacgtctttcttgaacgatggtatctttttctaggcttaagaccagttacaatatacttttttttaaaggaaaagctattaatcctcacttttaaatggctttacttgtcttctaattatcaaatttgctatacagtttggacacagttgtatctgatgatcagttatataactcacgtgtatttttctatcctctaggttattgctgttgtttagcttcttgtttagtattatttatgacacagtaactttttttttgccacttatgtttttggtgtttgtaagaaacaattgtataacacaatgctttgaaattttactactatgttttatttaaagagtttaatacttatggcttaggttttgacatattacacattttgagagactttttcatgtgctatgtggtagtcaagatacattttctatgcataggtttgcagtagtcgcaacaccatttattgaaacaactattatttactccattggattgtcttgacacctttgtagaagatcagttgttcatagatacacaagttgattcctggactttcagttctatcatttatatctatgtctatagctatacccatacccatacctatacctattcctacacctacacccatacgtatacctagataagccagtgttgtattctaattcattataagttgttttgagattcttcttagtgctccctactctctcttcttggagctgaacctatggccttacatatgctaggcgagagcctacctctaactctaacctaaatccctagagctagggaagttgtactatattcctagctggctagctattcttataatgaaaggatgtgaaacttgccacatgctttttctttctgtatccacagagataactgctctttttaaatattaattaatatggcatattactttgttgacttttaaatattaaaccaacttcctactatttatcatggtgtctcatgcttttctacatcaaggatttaatatactggcatttgtatctatgttcatagtaactactggcctatatttttctgagattcagatggtgctggctttcttaaatgagttggaaaggctttcatttttcatttactttttcagaaggctttcatacagatttgtgttcactttttttttttttaaaagagttcggtaaaattcaacagtgaaaccatctagtcctgagattttctttgctgagtgttttgaggatcgagagtgtacaaggaagagaacaaaagagtgaaatgaaacacaagtgttgggctttaagaagcagtttaggaagcctgggtagcaggagctgaagcgaccccctgctgcctgcctgttagagtcccctttggcagattcaggtctctttctaatgtgggacttgcttaatctctcggatttgtttctgactgtttctttcatagtccaggcaccatgcatgacaaactggtcttagaaatcagtgctcttctgcaggcacagcgttaaggttgacaatgaacctgtaaccaattttccagaagataagatctctatcattccataactttgtgcatgaaactcctgttctatgatttctggtgatttcatgtgtggttgacctaaggttgaaggttcacttctggtatcacctttcacaatacagactttgttcatgctacaaatgtctgtagtagggaaaaatatataacatcttggagagcttttgtttatcttcctattccttgcctatcacaaatactcatggcaggaaccgtgcttaattcatgtctttatcgcaaagctgccagagtgcatgacacacagtacacatgtaataaatatttgctgaattaatggagaggcaggatttctagaatgggattttccccttcatttcgaatagctgagatattatcatgattctccgtatttctcaaaacacctggtgcaacactgataaatgctcattgtaggtaatgctgctgaatgacaaattaatattataatgtcagcaacacattttgaactctcataaaaaggcaccataaaaacatcaaagtagctataaaaatgaaacgataaaaatctatttggatgacatctctttttgaaaacacaaagctaattctgttgtgttttgatacgtaattacacttgaaggttttagatgcgacagagctgtgtttgggaattctggtgatcacagcatcgccacttgataccaagaagggaaaatccattttgtaagctttccagcgacaagctggggaaaaaaagcttcgttttcagtgtctggaagccatccccagggttgtttactgaaatgtcatagactttaggaaactcaagggcgatttacgacaggaccagatcttctgcttctcatcttctctcttgtcacaagacaaaaatggacaagcagagtggctgcattgtccatggaatgaacatcgtgccatgctacccaagcaagattaggtcttttagaaatgatgttaaggccttcatcacccagggttttccagagaaacagatataggttactctctgttgctttgcctttctgtctctctctgtctctgactctctcctgtttccctctccctttctatgaggtgtgtgtgtgtgtgtgtgtgtgtaaaattgtgtgtgttaaaacattgttttaaggaattgtctcatagagtcatggagtatagcaaaaccaaaccttgctagtctagctggtagactggaaacttgggctggacttaagtttctaggtgaggtcatcattttggaactgtggaagctattggtgctaccattttgaggaaggacctcttgttctttggaaacctgtctttgctcttcagatgactggaagagacgctgcacactattcagggtaatgttcctcccttaaataaagcagatggaagatgtcaatgacatctgcagctgtttcacaacaagccagatgactggctgtgtgaatactctagacgaatggatatgtaacaattataacaaggttctttgacacttaactccagcttcttttgcccacaccatgcatctcctcttccaggctttcatgcctgcacttagttgcagcttctgatcaaagtcctgctttttcctgtctttcaatggatctgctggacccttcatccctatcctggactttcccttccatcccaggtatcctatttttacctcctgtcttcctgtacaagagtccttcctaaacctggatgctccccgattcagatatcatctcttgaacctctgacacagttgttggctatgaggtctcctggccctgcttcatgttattcttaaatatatttgtggcagctgttcccatccccgtgtcctgaattgctccagaacctcatgatttttttttgtttggtttggttttaatatctttgttccccacaggtgatagattatcatttgtgtacccatctttatcctcagttggccagctaccgtgcgagcctcccaggatacaaagatcaattagacaagcctctctgtttctctgaaacagcacaggcttgtggggaaggcaaataagcaagctgtaggtgtccattagaatttggagactgagttaattcctgatggagaggtgtagtctctcccggtcagcattccccccacccccacacctaaacactcctaccagcagacctcattagccagacagtggctttcagggtgctgagagttctgtcctcacaagacttgtgggggagggagcagcgtatgtggcgtgatgtgaggagcatgaaggagggcagtggatccaaaaatagctcagttgctaagatgccggatgcatgccatgctggtaattcattatttgggtttagaattaacctatcagaaaatgcatctggaagaaatgtcagatacctgtgctaaggactctttcaaaatcccttctctgcttcctttttgtctgctttctttttttcctcctttaagacttagctacactgatctcccttgcagattaaggtggtaggggtttctcctcaggtcccatagcatcctgtacctgacacattttgggttttcatcctttcttgcttttctgcttactgtttgacactagactgacgtcccacagaaaacatcttttcctctttatggtctcaacatgtgccacagtaccacttagtaagatgttcttgatgggtttatgggtggatccaagtagttctgtatgacatagatctgccattgcccttctgctcctatagaatgagctctgagcacaagtgagggacaacttggagaaagaactgataagtagataaagagtgtaagataaggggcctcagagaagccatgatgtccctggggttgttctagactctgctctttgttgccatctacttgtttctttggtccataagatagttcttgaattaagcatgcttttctgctcattttgtgtctatagcatgcaagctgcagtgcccagcaactggcaggaagtctgtcaagtctaaaggatgctccgcatgctttatttctaaaggaaaaaggattctgcctgtctttccttctgtgtgatgaaaacacagactccttccccttccttctcttcctattcttctccttcccctgcctctcctatctctgcctcacctcccccgcctctcttctccctgcctctccccctctctactctacatcccctgtctctcctcccttcacatctctccttacccccaacctctcctcatcccaccatctctctttctctcctcccatccaccctctctgcctctcctcctcccatcccgccccgtctctccttcccagccactactctttcctcttagctttaatgaagaagtgagtaaatgcagctaaaaagtgtcccacctccccacttagtcctggtcacaaaggaaaacacagatatttactccagtttcagggctagagtttgtgagatgcacccagacctggactaaaatcaagacagaagccaaggaaacactggcacccagtatggtcaatgttgctttctcttgctgaggagctctgtctctttggatgcctctgttctccacagagttgctctgcttccccttgctctgcctgtcctccatgtcgcttctactttacgctcatgctcactttgtgcctcctcaccatttcacatgatccatcatggccactcccaatttctactatttcaggccatttcaacagtaagcatatttgtttccacacagatagctcatggacaactaattttaatattcctacaaatattttttaaaactaatttagagttggacaacagatccattaattggccttaatataaccaatagctaatcacatgacagcctatccattgtcaccagtagatgtacgtgtgtgtgcgcgcgcacatggatacacatgtacaaaatttacaagatgccaaggaaccatggcatctcagtacaatttttggctgctaatacaaaatatgtctctgataaaatataatgaaaagtaggttattttgtctaaaggttctgacccaaatctggtaaagttttcttgatgctgatagtcttgaagctttaatgccttaagagcctcaagacccatcattgcctttgacagaggagcgtttgctccacccttccagcagaactaacaaacagcatctgcattttcatctggcttcagatttcatcagaatgagtgagtgaaaggaacagaaatgtgtgagctcattgggataccaacaatttcttcacttttcaaactcaatcgctattattgtggaagacaatgaaagtattataagcggaactcaaatgagaagccatcaggacatgtatggtgtcatcataaacatttgagatggggacatgatagaatgctttgtgagatgcagtttgagaaagaccagagtgagtattcacttagttcatggtattaaacacctggtccttatacagccattgaaatagacaatgcatatttattttgtttagtatatgctcagttcctaagctgtcactgcatctctcttctgatttcatgttttttgtcactgtctcagttttcagtactctcctcagatactacatctctcatgaaataaaccccacacctctccccctacttacaataaagcccacaaactgtgcctattcaccatctccattttttaacccaattttcatgctcatagctccactgacattgcttcttttgtcaagattattgggaccaactatcttgtctattctgttgtacctcctcaaacatttccctctccttagcttcagacagtctgccccactgatttctcactagtaccagtggatgctcatcttccagacatatagggtccacaattcctttcctgtctctctcctctcacataaactgaactctggcctttaagcttgtctggcagccagtggctgccagaatcttatcttcaatcttattctttcccttcagctccaaatctgtgaccatagcagcatcttccctttgtggaccaggacctcaaactcataagccaggagcaggacctgagaggactctgctgtaaagtaggagtccacttatcacatggggctcagctcttaccctcaggctaggcatttcagtcagtgagttcgctcaggccttaccttgcacatacacctggaatttgacttctgttaccacgctgccactgctcaccaaggcaaagcaccattaacacctagcttgtcttcagaaatattcactgactggatggttcacctttgtcctatcttcttcagtcatttctccagagtgattattttaaaaaccaaaccattcaatgggcctcattcatgctctaatgaaagataaggtttgttttgttttgttttttgttttgttttgttttgttttctagaacctattcttggaattttgtactttcctctgtaaaattacaaagatgagaagagaaaacatgaactttcaagctgttttggtcaatcccctgataaagtgccaaggttatcagtgactgcaaggaccctgccttgtgtcccaaaccctatcatacttgcataatgtcacctttgccaccatacagattgctttagagactcctgcatactttgtatcttgcctgatacacacttaaaattacttttggggaacttaggcccaacatcttatttgattattgcnnnnnnnnnnnnnnnnnnnnccttccccctggtaagaggtctcacttgctcatcgaaacactgcaggtttttttttcttttctttttattacgtattttcctcaattacattttcaatgctatcccaaaagtcccccacaccctcacccccccactcccctacccacccattcccatttttggccctggcgttcccctgtactggggcatataaagtttgcgtgtccaatgggcctctctttccagtgatggccgactaggccatcttttgatacatatgcagctagagtcaagagctccggggtactagttagttcataatgttgcacctacagggttgcagatctctttagctccttggatactttctctagctcctccattgggggccctgtgatccatccaatagttgactgtgagcatccacttctgtgtttgctaggcaacactgcaggttttaacagggactttgaaattgccacctgctgtctagaagacttgacatgctcattgccaacaatgagcaaatgaaggctgccacatgggacttttacaataaagactaaagcagggaagagcccttccttctcatcatgaggctgaggcacagagcatgactgtgtccctgtgtgaaagagcttgactaacaggcttgcttgacatatagagactagagacagcgcagatatagggaccaagaactgttgaatctttctattcagtattgcttgaggttggcactgcgtctaccctttcatttattacaatagcttcattatagggcccaatagttcctctgttttacttgtgcccattttaattagttgctcggcactcacaaattcaagatctttaaatagtgcagtatattatatcctcgctttacggttgcaaacctcaaagcccaggaaattaaattacctgttaccgattaagaaactaaatgagatttgaattcaggtctgtgtagttccagtaactccctttctactccactgagttgccattattttatttagtactcagtaagtagagttaaacatatgacacaatctacttagtgtcatctttaacggggacaagcctctaatatatccacaaaactgggaaaaggttctagctgtccaagcagcctcacacaggtctctgaacaagtttctttatttgtaaaatggccaggtttgagtcaatagccactgatggtcttgtctttacaggaaagttttctaacgtcaaattgattcttagtacctctgaagatccaattataccgactgtgcctctaggatttatttaaatatgaaaacaaagcacatcaggagggggtgcctgtgtcagacttcatgatgagccaagttggcttgtggccctccagcagcacgcagagcagctctgtttcaactccgggatgttattgtttccagatcacagtctcatcctaaaggacacacacactgtcaggcaggaattaaaaaatattctcaagcaaccttttggaagatgaaaaggtggctcttttcccttctgaaattacagtatactctcctaagtcttggaaactcatcattcagagaggttattataagtgcctcgctcttgctttcacactgagtacagaacaatttgtacagcagatcaaggcgtgaattgatgacaggtttgaacccagaaccagtgccaattaatagctatggttatgcaaatctaaaaaccaggacatacatggacacgcacacacacatgcacaagtgcacacacacatgtacataaattcatccacgtagagtatcccccaacatgcatgtacacatacacacacacagtatgggctttttctttctgttggaatatgttcttagactgaatgcaggaaactatccctggtgggagcttttggagactcgcccaagtctaaaatatcaggatactgtttctaagtgattatctggttgaacactcaattctttgaataagaaatcaattcatccttttagagattctttttctgcagaagttctaatattttgaagttcttatttcgatggtcttttgctattcacaaggtattttcacataaattacccattttccctccaaagctacagaggttgtgctgtaactactatgtacattcggcttccttgcttacagcgtcacatgactctgtgaccatttgcataaatgacccttcggttcagtgacttagccttgttctaaagatcagccacttatccactgctctaccacccagacttctggcagtgtaaaagcatcagtaatttatgggtaaacacatctaggctagactctcaaattcactagctttgtgaccataagcacatgacttaatcttttggatatctgattccattgtctttgaaacagagttgatggcaacaaaattgtaaacttgttacagtctatgagaatctgcataaaccctgtggtacttagcaatgcccatatcacactccttcatggcaggcactcatcaaaggactcatcttaagccaagtgttcttgactgataaagatgtgccctgatcatagctggttcgtgagtgtctctggactgtccgaatattcagtgaaagttttgagtgtgaggtcatcccggggatgttttgtgggttttctgcctcttgattgactttatccatattggaaaaataacactcagggacaagcttgcaattttacagggatgttgggtgctgaggggttgtgtgcttgcctactttgatttttgccattctggtaccctgtgatctccttgtctaacacacacacacacacacacacacacacacacactgcacacaaaggtagcctgacaatgtgtggcatattgagagtggaacatctccagactctactattaatcattcagaactagttactgaatccaataagctctactagagggtgcatcaggttttgagtagccagctaactgcccacttttccgtagctacaaatctccatttgcttgcagactgtactcacttctggtcatagtatgtgggtaaggtgatgagggcattaaatcaaccaaggaaagaatttatgattgtgaattattaggataaaagtcaatgagctagctattatgtttataataagcagaagatccagcctgacatgatctgaagtctcagttgtctcatctttattatgggcaggtcattggccatcacctgagctgagctgtcattgtcttcctgactccttccctacattttacttactacagtgttaaacactgtgtaagacaaatcctctgtcagactcatctgcgaaatagaaacagcaatactgtctcaaaaggtccttctagcagtatataaagtctgcctgaacatcagtttccttaatcatacaaaggaaatacatatacttttatcacaagattgtggcggcagctaaatatgcaaggaagtttttttggggggggggactctaaaatcagatttaataattctatttttaattgcttgtttgtataaaattctataatgatcagagccagcattattgctgcttttattatttataagtaaaatggcacagacactgatttttcatgttaaagagatgctcattaaaggagttggcttgcaagcaaaaccaaataatcagattatgttcagaagcacaacatttattgtaatttacttcagccaattaagtcgtgtttttaaaaaagatttatttatttatttatataacgtatatgagtacactgttgctatcttcagatataccagaagagggcattatatcccatcgcagatggttgtgagccacatgtggttgctgggaattgaacccagaacctctagaagagcaaccagttctctttaactgccgagccatctctctagcttcttaaattcatgtttaagcacttaaaatttgttagagagaaatcagctttatgatgtcatttaacattagtaagttgaaaagttagtggcataaaccagtgctgtcctaattaagcaattgccagctgctctgggccaggctgttcaggtccccactggcactgcaagaggtactgcaatcacctttcttttaactccttgttcaggaaaggctgttggttggtgaggggcaaccaagcctgaatccaagatctgtgcatagaacctgctggaacagaaaagccaaaaagaaccatctgtagatgcactcctgaaataaagttttctgcttgtaatcgttcccaagcccaaggattctccagtattgctttggaagggaccaagaactactgttatagaaagtgagctttactatacaagaaatagcagtcagtgctcacatgtaacagctgacaaggcaatactcaggtataaatcacacctctcagacctattttctttgaatcgctgccatgataattaactgcagccatgaaaattcattaggttcagtttttattttaaatgagaacaaaataatccttacttcagaggattatttacaagactgagatatatatatatatatatatatatatatatatatatatatatatatatgcatttatatattattgtaacatttagtgagaaatgcaagtcagaggtcactcattttgccaagactgacactggagactcagtaggtttctctcaagaaactcaatggacatttttctttcttcagttgcacaaattaaactaaatcagtttcactgttaaagaacttacattccagatatcaaggaatgcatacaacctcctccatgcatgccagaaaataaataaaaatacaaagaggctaaacaatatttcaaaaataagatcaacgcacaaaatcaaatgtaagtctatgcatcagtaatgtacaacttgaaaattaagttaaagtaattatattaacaaaggcatcaagaagaataaagtacttcaaaataaaatttccatgaacatgcaaagcttctatactgtaaacactttcaaaatgttctaaaagcgctaagtggaaaagcatccaaatatacactaaagaaaagaaagatcaactagacttaactaagatcacaaattatatacattctttgcatctaagaacattattttataactaaaaagacaaaagcagactttttaaaaacagctgaaaaggcaaagaatgggaagaaatccacgtaaatcatgtatctgtgaagggtctgtgaagggttttccttccagaatataccagcagccgtgatagatctgcagtaagactctacagcatccaggctttcaaacaagaaaataaatacatatttgttttctttggggtttctgtttcttcatcttactgtgttatggatcaacctaacagtcttgtactaattatgccagaactctatcacagctagaccccaggccttcagcagaaaatttgagtcttcatttctccaaagagtatatataagtggccaacacccaacaaaatgtgctggatattactaattctctgggatatgcaagccaaaaccacaatgagctgaccactttacaccccctcaaatgtctaccactaaaatggtagacaataacacatgctagagaaaagactaagaaattagaactcacattgtggttgggaaagttacaggtctttaaaacattagacagacccacaggccaacctcatataaatattctgtcattgagactcttccaagactattcttgactgtgtcaaattgacaattagaattaaccattatgacactgttgtagatagacaatatgtgtgacatatacaagtatgatctatagtatacatgcatactgtatgctttaatatatgtgatctgtttaggataggcgaagcactgaggcagagaggttaatgtgcttccaaggaggtctgggtaatgatggatagaaacttgatatctttagggatgaggacaatattaagaaatttgatagtggtgaccagtgcataattatatttttactgtaattgaacactttataaaggtgtattgttcggcaagtgaaccatatcttaaggtatttaaaaataaaaggaatgcaggattttttgttaatccctctaaactgcaaaagaaaataaggttacattttcttccttccttccttccttccttccttccttccttccttccttccttcctttctttctttctttcttttctttctttctttctttctttctttctttctttctctctctctctctctttctttctttctttctttctttctttctttctttcttaaccctcttttcaagagtaaaattcttagtttgtcactgcagctgcaggaagaacctagggcaaatgatgaaatgaattaaccatgcttcatcttttaaaacttcttgtcagagattcctaggtggcctttgtacatttatctctccttacttaccccaaagcaatccgtccgttgcattcagaagtcaccttgctatctgctaagtgaccagagcctcagtcaccagtgtcttcttcctcttcgttgactattgctcaatacttgtgttgattgattgccttaccattggagagtataaagccttccctccaagagttgttcttggccagggaagatggctttgtgggtaaagagcctgctgctgtgtgagggcctggatttggatcccagcatccgtgtaaaagcttcacacagtggcatacgttttatagctccagtgttggggtggggggaagaaacaggtggatccctgcagctcactggctagtcatataaacaaaaggatgacattccgggtttagtgagaaaccttttcctcaaaaaaaaaaaaaaaaaatcacagaagattccctgacagtgttctctggcctccatgtgcattaacatggatgtgcatacatgagttatcctggcccaaactattgctttcccaacaatcacttgcatttaaccacaaattaagccaactgtcttctgttcttgttacccataaacctgtggaccggcattcatttaaatttatgaatgaatttttcagcaaacatttgctgagtacctccattatactaggcaataaagtagaccctgccagttaagcagcgaaaggatgatagtctctttcttttgaggtgtccctgtgcaatgatacaaatgtgatgaatattacgttgtacattagtgacagagactgcaagggatgacacagtagagcgcagaagcaggaaggccaggtgcagcctctgtaagaagttgacattagagcaatgacctgagaggaacacgtgagtggacactcactcttagaggatgctttctcttggttgggcaagtttgttgctggtgggctttatgacaccagagcctaagctgatgtagccttatgacattgtagcctaagctggccttgaactcagttcaaatcctccagcttcaaacgcacaagaactgagattctaaatgtgtgccatgactcctcgctgagaagaaccttaaaaaaataaaacttaagaaaatggacactgaaatttttcatgtagaagaactcctggcatgacacaggaacagcaaaagcccctggctgagcatgtgaaagaggggccagagagatgatcacacctggaatttgagcttatggtgactttggttctgatttgggaaatagtggagatgagctgcagagttctgactggtggataatctgtgatctgggtttttaattaattttctggatgttactctgaaagtacaatggaaggaaacaagagcaaagtccaattagcaaagacaaaaagatcaaccttcttacatacatacaggatacatacatgcatccatacatgatacatgcgtgtatacatacatatgcatgtcagttgttgccatcacaaaaatgagtttgttcctaaggtcagcgtctctggagcataatgagggagaggaagcaaaagggtggaagcaaacctgaaataaaccaggtaacccttccaggagcatggatccagctaaaatatcctgttatcaggatgtcaaatgttgataaataagaataaagcccaaagcaaaacaaaggtgattccacgtaagcctgccttttcatttgactgaagattgctgttgctagtaaaaataataaccatattttacccaggatccagaacactggcacccctgtcctctctgtttaatgtctttggggtgcgtttatccctttagttccctggggcaatctaaaggtctttgaatctcttcctgctgtgctaagttaatggtgaccccgtgccttgagagatcattgcatctactgagagaccaagcttcctgggccagagtcgaagtttaaatgcacacccgcatgctgagagcagtcaggagagcccaccgaagcctgaaagttgaattcattattccagtctcactgttatttctttgtgtaacacagacattttctttgctccataatcctctgcaatgaaaaggacttaaaaatctctccagggtttctccgtggctgtagtctaacatatgtaaggaaatctgaccccgtgtgttaggtgttctctcgccgtgttctgaatgggctaaacaatgcagaacgagtcagacaggaggttcaatagctcaaaatgcaatgcaaagggtggaaagagaagagagatcatttgattaatgtgagcactgtgaacttcggctaaaagaacaccaccaccccccataagctgacatatcaccaggcataggagagaaaatacagagcaagggacaaaatgaacactgtttaaaggggtggttttctgcagtttcggatactcaaattctttgcttctctgaggtaaactgcacgcagtgctacacaccccacgggaggctctcatgctgatttggctgcacgtcaattttctcatctgatttctaaaggaagctacttgcgatggtcctctgcaacctcgtgtgtcgactgctaagtcattgcttctcacactggaatgatctctactccgcaatggagagtggcatgccatcagaaagaaagatgaacggacaaagagctccgtagaaactctggcagcgagaacacagagaaacgcacggagatgagctaagttgctgagcggtgggctgacagggtaccggttcaggatgttgcacgtgaacgacttgcctcctcccaggagacactcctggatatggtaggtgttgctgtagccaccaacctgatctgacactcgcaagcagaactgggaggtggcttcacgcttaaacacgagtaatgagaaatttcaaataagcagatgctaggggcaatgtgagctttgtaagattatacgatgtttggagcctagtgaaagttctattacttttatcagatagttaaaagttctttcctttctgttttttttttttattttagaaatatagaataaattgagtgaagtttttatataataattataagtaatctgcttatgcaagccagagtgaaatttgtgaatattaattttttgtgaagtttaaaatgagactttatttgaaaatctttcatctattaagcccttacaaagaaggtaatgagcaattattataaatctgtaaagattttttaaagccatgcctaaatacatattttatttggttcatggattatgtttttaatcttgtactttttgtttgtttattttggcagtacaggggatggaacctaggccctcacacgtgctaggcaagccactattgtattacaaccaaccgctaatcatgtacccctgagctataaaagagacttaaattagttttcactgtttttaaaaaaatctgcaactccattttgagggctaatggctttaagaaatatggaattacaggtggatgagtgacaaaaatgatcacagaccagaaccaagcagatacttgttggtttgacgtgaatgattcgtgccattgagcaactctggcttcatgtactccagtggaattttacatatattttaagcctcagccttgtttacagtgattctagaggatagaaaggacggttggcataatgacttacacagtatctggtgtgggacttgttactgcattaacttttcagcaacattgatgagcaaatacagaaatcacagcactccaattcctcattttgaatataattagtcctcatatgtccaaccacaatttttcctgataacattttttttttagaatttaagagacatgaaaggaaaagaaacttagaattcttattattcccccaaaatgttgactttaaaggggaaacttgcttaatgggaacaaaaagattttgctattttcttctccttataatatatgtgtctgaccatggtctttaaatgagatatagatgtgcttagcacagtatctggtccaaagagctccacatatactatctacctacttccatctcctttatgttatctatctcctttgtgttagtttaaggttgtcatgggcatcgctgaagcaatggtcaaaggcaggacacagctctttgacttatggcgggtttctgttcttccagaagagtgctgtgtgaacaatataagtgtaatttctagcgagtgaacatattttaagaagagaaaggttggattaagctttctttgatcacaaatcctctttggggatgaagtgcttttggaaggtgaatgggagtcgcagttcaaggagtgggatcccattccaatgaggcaagatgaacctgacccataaagccggaaagtcaagctccccacttgccagcttgggtgggggaggactccagttttcttggctataaatgagctcccaggccttgccttaaagtcttgtgaagcctgaggactgataagaagagccagtgcatgtcctggcacaaatgaagcactccaaatgcaagttcacattaaaaacaaaaaataatttgggagaaaatatctaataaagaaataatgtgggtatgatgtgtctgccggtggcatttaaatgagatgtacttagtgcataatttggtccaaggacctcagtgtagattagtgatccctgttttgtctaggttaagttatctgaaagttggttaacattgttgaacatacctatctttttagctataatgtactatacaattcaacttttgaaatttttcatttatctcacaaaatggtttgatttactcttctttccaatacatgtttgttgagcacttgttatttatcagatactgtattgggtttctggaaatgaaagttgtttagctagcagagaggatgaatcaaaaaataaatggattcctatattactgctacaacagtgatgcatgtatgcatgctttgccttcgcatcacagatgtgccccagtccaatagggtcataaaagaactgactcatgactagaatattgatggataagtaagctataggtaaacagaaaattgccagacaggtcttccagtcacaatatagtagagccagatttactcaggagtttagggtcgggggtgtaaggaatactgccgtcctgctgtcccaagccacaagtagacagggattgctggagacaacaacaaaaaggcagaccaagctggctgaacttcacaacagcttcagtttagttctgagagccatgaggagctcacaagtgcattcaggcaggaatggatgcagctcaatgagacaccagcctggaggcggaggctacttagggtggtttctatggaacccaggggtacttccaaagaaatagagttgtgttctattttaacagggcaaaatttagacatgtgctgctaagcccacaagagtctgcttgcctttctctgtaatctttgaggtatagcaatggcaagttggaaatgggatcacaattttactgctgaattaaaagtgggaaaatattttcaaattttgacagtggaaggtttagaaacctacataagaaattttgtaaactttctacacttagtgactggtctctttttatatagtcgcttaagagttgagtgaatttatcccagttgaacctattggatttacatagtttttaaagttagcctatctatgtgttttttctattgaactacaactaataacaacttcagatgacaaatgaaactgcacttttcctttttcacttatacgcacatcaattaattctatgtaaacaatcattctaatactcaacacgaacgagactttaaagagatctcagaaggaattctttaataataggagtcacgtgcagtgcaccccatttgttaatttcatagtcaactcctttgtcttgtgctacttcttaaagtaggttccacctacatttacaatatccaataggtcagatgatgagattaactgagtaccgtagacatccacatacgaactaagttactaatttgttgacattaccagaaatgagtaaatatttattctctaaactaagagaaaatccatggaacctgacaaaatgtatttgccactgctcaactctaagcagaacctaatggtcaaaccgtgcagaagccaattctggtgaccattaggttataattctgtgtatagttctgttgtaaagtgtagctgttctgtagctcagaaataaccctttgctctaacagcctcagcaccaggagaggaacaaacctgaaacgaggatcctgtgatgaagagaaaagccagtgcattctgaatattcatataatctgaatgccctatcttttgctgaaaggccctggcaggtacagacaaaataaaaattcatttcaactaagagctaatttgtttgtagatgcccaagatgattccttttggggctgtagatagcatcctcctccctaagacattagccatccacaaaagaagcagtaagaagtgtctacaatcctgcttccatgacaaatgaaagtgcacacagtgcttgaacagctacatttgtattttcttcttttgctgtttaacggaatttcccagagcctacttaagtggaacgcgcacttacgtcaaccatctatcattctgctctgcccggagctgagtgttgtgaagcattggggccaggcagaagaaagaagtataaatgcacttgttttgaattggggacagaaaaacaaaccttatgagattaactccctgaagaatcatgcaaaagactttttctcagcagacaaaagagcaagaaagaatttgttcttattcagtctgaaaagtacctaggacttctaagctggttaaaacagatggctcagggaattatcctccacgttgactgcagagagagatgtggggatgttagcttgttcctaagacctttctccctgtcagagatacagcttcttctttgctacacagttgaaatcaataagggcaaagttccccaagctgactgtaacaaagatcccaagactggaggtcaactggcaaagcattagcaaatctgagagtgatttcgagagctctgcctataaaacccacaggtctggcaggtcttgctctcagtgctggttaaaggctgcaggtccatccacttttggaccactcctgcctaaaatgcagctttgtggagtaagtactattgggccaatcactttcattctaagggctaaaaccccctacttaggttcgcacttacctttaattttctcatcatttttagaaggttggcggaagtaaatatcttgcctatgctctactgatccaaatgatatcatagatgaaattaagcatttgaaaaggcaatcaagccataaaatgtataaaatgatcactttattggtttttgtgtcaataactcaaagtgaagttctgaattgtcatgactgtcacatcatcttcaggaaagcagtactaaagtatttcatgcaaattaactcaactccgagctaaatattacttaaattcatgaatgattcagtgtaggtggtatgcaaagaagtatcctagtcacagctaccctcacagttaattactcttttctttatgctagaagccacattccttcactaactgacatattgaggttactcctctgtcaggcttgtggccaatggccccagtgatgggccgcttagtgaggatccatccttgctataatcctgtccaggaggtcctgtactctagtgggtgacatagatacctgccaagacaatgactggagaaagaccacagaagagctgtgcataaagctccttggagccccatagagagctagaggtttcacagaggaggtgccatttgtactccacatctctgggggctgagtgtgagggaggccctttacatagacatggatagaaaagggcatggctgactcttgccaagataaagcctacagaatggcttctatattttatttatgcatgtttccacacctcccatattactcactgcagtgaaatggaaggtgagctctatgagagatagattttttttccagtcttactaactggcatgtggatatagatatacggtatagatggtacagacagatgtctctatatgcacacatatgtctagactaacattagcacataacaagtactcatttaagtgtgcatgtaggtgtgtagtaattgtatgacttgaaatgtactcatatcctgaaatttcagtgattttgtccatatggcatacaacgaacctaggtcttttgccctcttactcttggaacatttggcctgtaggatggcttatttgtaaattaagatggtgttactttatttaagccaacagcagcaaagtttccaagcactgaaatttctggttggttctgaatagtactgtaaactatagtcagaacatggcagcctaccactgtgtctatcacacatgtagtaaatattcaggctctgtgacattttaggagcttcagctcaaggccgttggtgttttattgattccaagtaatcaatcaaaacaaggctcccccaatgccctacaatctttaaaaggtgggtgttgtaatggctcacaagctagatgaagcttcatagtagtccacaggagagtcagtaggcagcatttttcagtgaaaacccagtaatatttcagtcccttttcaaaaatcactttctaagacaggacacatcttaagagttagaactataattcgaatattaaagtactataatcttttgtcacaatggcaattatttctttttttacaagggcattaaaagcatgctctctgtgtatgtgtgtgtgtgtatgtatacatatgcatatatatgtgtctgatatattactaagaaaaagtctggggtatagagcatactgagaaatcaccatttgatcgtttctcctttctctctttaacaaacttgaaatcaatgaaaaaaatatatgttaagcatatagatagatagatagatagatagatagatagatagatagatatagatatatattgaaaacataaaatatttacctttactagggtaacataccttatgtatactgatctgttcttcatgagaaactgtttaatgggtgccctatctctgtattacagaagaggttttgatgatgttaattttcctggaacacacactgagcaaaatctgaatgaaaattcagttctgcatgactccaaaatgctgctctttcagcatgtgtgaaatgcaatttgcataattactgatttcttggtaataattttaacttttaagtcatcatttataagcatgtaaatatttaaattgtagttaatgagtatatttacattgctttgtgacctttataaacagaaaacatttattacccagtttgttgatgactaatgatcttgtctaaaaatattttgattgcccacaacagcagttaacaaattctcatggtattttcattatgggcaaggagaagacatatagacattgtagtaaataagtgaagatacaactcttctcatgaacttcagataataaatcttatatgttccagacccaattgatggatatcaatcatctatcaataaggatctacctttatttaaagtcattgatctgtcagtgtttatcaatcttatcatggaaactcaaccagcaatgtcaaagaactgtcaaaaggaaaatggagaaatagggaaatagagaaaggccagtgcatacttagacatcagtgaccctatttgtcagtagacagtggagagtgcacaacatggatagcaatacaacacaatgaaggtaagaaatatattttaggtggagaagtcccagtagcatgaattagaaaagaaagtctgcctatgggcaaaaggagtactctacagtgtctgatcattacataaaacatgtaattataagggaaaaggtatactaaaatatagacacttaacaagtataagtttgaatctataatgtctaggatggtatggctgacaatcaatacttgttaaatgaatgactaaataaataacccaagacatccagctcatttggattagtctagcttcaacaacggactaattggctcaatgtgcaggctgggtagactccttcctctagctttattgcatttctggtttgacaaggtacacaatgtacttcttacaaggacaggaaacccgtagaatgtgtgttctctgctttcaactccaacctttaccagggaaaacaactgcacctccacccaactctgagctgaggaagtcagacctcatctttgtcagtgcgtcttcaactcctccccatctctgaacctcataatggaaaattttgacataaaaaaatgtctggtctttgaatccatttatttgaacaaaattctagaacttgtcgtatcctttctcatggctcttaaagccaaccaatacctattccctcagtggaaacaatacccataccacagggcctactatggccagtgtgtcctcaatccatccctgttccatcaaaaggtagtgaaagctttctggatgagatgaagcaagtgaaatcaggagtgatcctgtccagggacccatttagcatgtttcaacaaccccaacaattctgtgcctaggtgagacaaagaaatacgtaacctacagttcttcctctgtggagctcagtcaagcagggagaaagcagatgtaagcaaacacagcctgcggtctggtcagcatctgccatgagaggagcttttattcccaggaagcagcaggctgagatgagggaaaggacaggagatacgtggaaacatgaaacagggcagcaaattgagagacttgaaagatgagttcatggggaatcctgactcatacaaggaagggaaagttaggaaattaatcaggctgcatatcaggtaaggtctgttgagacatgctaggagagagggtttatttatttatttatttattacctccataaaagctttgtgaagtcacggaggtcttgggcaggaagcactgtgtctaggttggtgatttacaaggatttacaaggatgaagactaagcttaacaggagaaacatgaataaggctgcagccatagtccttagtggtgacatgaagaaggggacttgcagccagaaaagaggaacccagctcaagaaaaatcaaaggggaagcatccgggtggctaggtaacctgggcatttagactgcttctagcactagcaagctttggcaggctgctggctcggagttggtttcccacagctgtgaaatggccttaatttgattattattttttttctactgatagtggtgattagctacaggaagtaagactaattctcatgttggtagctgagagagaaggagagaggaagggagagagagagagagagagagagagagagagagagagagagagggagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttcctttcgtctgtaacattgtgccgatgcagtcatttaagaatatgtacctaataggagatgggattgctatacaggcacatctattagctctctatgcttgtccgaatactattatgctaaaagcataaatgaagaatccagtggtggatcagttaagaggctcagctgcattaaattgtctgtttcgcagacaagttcgtgaaagagtgtttaaaaggaaatttatttgtttcaatccaaataataaagagcactttagatccctgccaggggtaaacatgacccatttggcaaggtgttttgtcattctccattgtcgctaacccaaactctggtgctgacacttaagcacatgccctcttatttgttcctcactaaagatccaagtctttacacagtggcctttcattattttggagggaaggaggggggtctgttatttagtctgtgttttggtcctgtgtgatattagctgagaagatagcatgggggtggacagcaagggtttgaggacaataggaggttgctgaagagcattgcctgctgccctgggccacttaagacattctcaccagtggctttagatccagtttgtttgctacataaccctgaagctgacactgataccttctgcatttctatgcataagtttctctccattccatgttatatgcacacgaacactaacatctgccagcgagctccccaggtagaagggcaagcagggctgccatgggctctgtacccatttccctgattgaaatattctatgcctagcggtcataagaaactttgaaaagaaacagaaaccctgcctgcggggtgttttattagttacgtttgctgtggggcattaggtatctttagtagtaagacactttgtttttaaaaataaagaagaaaatattagagacctcttttttaaactatatcattaagtattgtatgttttctgcttccaataagctattgtatgatcaaatatggaagattattcctaagaagagagttttaacaccagcaaatattatgttgtgtttatcaacaacaaaaagcaattggctctcatatcttccttctggtttttatttcgaatgattgtgaaaccatgttaattccccaaatgccagtttcttttcagtcagttgtcgcaggacttctgatccactgagtccttaaaggaaaggaagacggtgcgatatatgtcactagtttttctggctacttgacatgtggacatctcttagacattgtcttttatttatgtttttgagacaggtggtatctttaatgcctgaatttttaaatgcaaactacagagtactcttaaataatgtgataaatgaaacattaaagaaaattgttcccatattttaattaaatattttagtgagcattctcctgcttaactcagttttaattgcattattaattgccatgaagaaaatattcctagggaaaaaagccaaaccaatgttctaattgcagcttttactgctttgcgtgataaaatgcctttgattggtgctgagccagaagggcttgatttaagataatatctgtctcggatgtcaccctgggagaaaagaataaaacctcagtagacatggcgcattgcagctgtctctgctgctccaatttctctgtcccattgacgtcattgggaggtttcagagccgaccagggtgtctagtaaaccagcaggtaaatgaaaggaagaagaagtagaaaatcactgattcatgtgcagccctcactccaaagaggtggctgccctgttcggtcaaataatgagcagaagtttttccttccttgcacaggaaaaaaaaaaagagggaaagaaaagaaatattcatcagttatccagaaatgtgggaaagcctccacggggttgcataagccattctgaaatcagattacagtgccaggagccacgtttgtcctgggttctcagatgtcataacccccatccagcttgtctctaatcagggtatgtgaagcagaaagtggcctaggaaacagccttccctggagacagggctattccaaacagtctggctaagcaccaactctcttcaggtgcagacttttttcaagagtttcagtactcagggctctctccaaaacgacaataataatgaatagagctgcaatattttccaggaaggggcttttgtttggggactatattgatcagcttaacacattaaatgcatgctatactctaaccctctagacacttagcacagagaaccttttctaaatcctgccatatagcatttttgtgacttggctgaacattattgttaaaatatgatcaaatgctaatttttcatctgctgagcaatttggctgctggcagaaaaatgggaatgatcgtcattctcctcttctcattctccaccaaccatcacagggaaggtctcacagtagcctagtagatttcatttcacagatgcaggcaccaaacgtcacgacatccattcaaacataagctgagtgctttctgttcatatgaggttacaaaccattagggctttcactttccagataatttaattgtcatcttttctaattctatgccctacctttggtgggtattaaacactggttgacatgtgtttggtgctgtgagataagagataaatggggcttaattattggtctttataagcgtagaaaagtgaggaaaagacgtggatcctcacatacctgtatcacaatgaaaataacgctgggtgggctggagagatggctcagtgggtaagagcacccgactgttcttccgaaggtccagagttcaaatcccagcaatcacgtggtggctcacaaccatccgtaacgagatctgactccctcttctggagtgtctgaagacagctacagtgtacttacatataataataaataaataaatctttaaaaaaagaaaataaagctgggtgaaggtacaatatctgacagtgaatttggattaaaaggacatttccaagaaccatttaaagactcctgagatttctggagataaatgcagtagaatcaccgtagactaagtggtctatgtgatctgaggaacgacatgaagcatacagacacaaaggctcttttgaaatcacaactctggaatctagtgacagcaaggctggggctcttggtggcacctcttaaatgctagtatgggggattttagaggtgaagaagcagttattcccttcagccaggaaatgaaactagtctgggcttccgtaaaaatgactaggagtggtgtgtaaagcatataagagagagaaagaaaatcatggttccatggaaagctacggggataaaaccaagtaaatggggtcagaagagttcgctcagtgaaatgtattattgagcgtgagctgtctgtcagacaacgtgtaagtttgagattctaacaattacagacacgttttctaagtcctttattcagtaaaggtagaaacgggaagtggggcaaaaattcaacaaatgcctccaaggaacacttagcacaacgcagagcacttaacacaggtgttttgagtggaagaaaatttcagagctagcctgggaggttctgtgcttggaagaaccactcaaataacctttgggaaaaaacacacattagcaggtggacctcctgtggatactacaggggctcctggcatgtgctgtgtgttcttttctcgggacaatatgaacaagcactggtttgcaccaacaggccaaaggaatggttccattcaactctagttcagtaaaccaatgagcgtaataggagcacaggtgaagggttgcctacaaggacctaaagagggattagccacagggttatctacaggactatgagcatcttaccacatgactaccatgctgcctcattggccactcatgagctctccctctaggaaatgttagtgggcacggccatttaagagtttcctgtggataatcacagatactctgatttcaagacagcaatagcttgatgagctataggaatggaaacatcactggatataaattattctcattagttgagaatagctgttttagtagattcttatcatagcactatcattagcagattttttcctattttacttatcatttggaaaacttgattggaatatatttatattcattgtatgcttttgataatctcataagagttattttaaaagaatgttggaagtttatctctcaacaaaatcactgtatcttgttgccctggatttcttcccatatattataaaaggcactacatgtattatatgaaaagctcttaacacttgcaactagagtgccagtgcccaaatatttcagtttaaaattttttaatgtttgtgagttgtcttcatttttgcttagaatgtagattcagtggaacggcccctccctcctggttctctcacccatcctccttaagtttatctgtttaagtgatactgtcctttctggccacaaatccttagaaagcatgccttctccttcatatctgtaggtcactgagtggagcctctgttacatgttcagtccgtaggaaatataggaaatgtcagttcacttgaagtttctttcattctctctttctcttttcctctttctttctttctttctttctttctttctttctctctttctttctttggatattttcttcacttacaattcaaatgttttccccttcccaggtctccctcctttactatccccccttcctctgcctctatgagggtgctctttcccacccacccactcccatcttcctacactggggtattgaataccccctggcccaagggcctcccctcctactgatgtctaacaaagccatcctctgccatatatgcggccaacaccatgggtccctccgtatatattatttagttggtggtccagtccccgggagctccaggaggtctggcctgctccctccatggggctgcaaactccctcggctccttcagtcccttctccaactgccccacctgaactttcttatggcaatatagacatagggccttcacagtaataggaaaaggtttcattgtctctgataagagccttttgtgctttatatcaatgtaaaggctgttttctcttatgacctctttgtgtaactgcccagtgctgggatacatgcaatgataatagcagcagctgctacagtttacagagattttaatatgtgccatgcttgtgtgtgccctataacaataactcactgaacctggttcaaacatcaatttatagaggaaggaacaaatggttaagttacttgtctaaagtctctcagatctttaaaaaagaattgagaaagttgatgttagtcaagtattttctgtctctaaagcttacttatatggataatggctagttaacacattatgaattatggactttgtcttagtcaggttttctattcctgcacaaacatcatgaccaagaagcaagttgggtaggaaagggtttattcagcttacactaccatactgctgtttatcgccaagggaagtcaggactggaactcaaacaggtcaggaagcaggaagcaggaagcaggaagcaggaagcaggagctgatgcagaggccatggagggatgttctttactggcttgcttcccctggcttgctcagcctgctctcttatagaacccaagactaccagcccagagatggtcccacccacaaggggcctttcccccttaatcactaattgagaaaatgccttacaattggatctcatggaggcatttcctcaactgaagctcctttctctgtgatgataactccagctgtgtcaagttgacacaaaactagccagtacagactttatctgtgctaagagctctgaggcaatggtctcagaaataggatgactgttgtacacatctgtcagtgtgggaagctatctgatttatcatcatagtatgaagagagccaaaggtttctataaggaatttggtggtttctctaacctcttcaacacctggatatatcttgaaacatactcttttttttttttttttaaagtctgattttggtcttgagcagagaaaaatacgttttatgaaatagtgactgtacagggagtcaaaggccatgaattccatctcaactttgaagttctgaagctgggggatcctaatctcccgcccttctggagcccatttcttagctgttagcccagtgaactacatggaaaaaaatatcttcagctcactttgccacatccctgcatgtgtctctgttgtgcttcaatttgctaccaagaaaaaggaagcccataactacttcatttagtgagctaaagactgtagttactctctccttagaatgattataggaatctctgtacaggtgaaagaagactcgaggtacacatgaaggtcttttcagcagctaagcccatcatactgatagagtcacgagacccataggagaatgggtagccatctagtccatcttcctgcctagggccacgtcccatttgaaccctgagaagtgattaagactccccactttccacaatcccctctttttcaaaggagatctcacaacctccctgggtatttggttaaaaaaccaaccatctcacctatcagaaatcattttgcattgataacctaaatacttaggagctgcaattcaaacttattttcttctgtctttagtggccaaaaacagctggcgcaatcacctctgttcttcatgaagtcctttatgaagatattattcgattcttggtcattccttcttattccaaagctttaagcggctttttggacatttgtccctcaagagtgttcatcttctcatctgcgagacccagaatgcacttagccgttgtgccctagagcctgcagagatgactatgtagacatgatagcttaggttctggttctctttatccatctctaataataacttttcttttgttagtagggatgtaaaagattttgctgagagtcataaaagttagaagggtctacatttccttaaaagttccaacctgggggcttagttgatttaagagttaagagcccttgttgctcttgctggggacttgagttcagtttccagccctcacacagtggttcacaccatacttcatgccagttccagggtttctgacctcccttttctggtctctataggcaccagctacagatgcagtgtgcatacatacatgcaaacaaaaccttcatatacataaagtaaaattaattaaaaattaatgttaaagttataaacattattgctgaaagctaataagctaatagaaataactaattaaaatatatccatgagtatttccctctgaatccttactcccatgatgttttcttttagaaaatcttctatattaaatttacagtcttctatagagagacaaggggaaattttggcatcaaaaatttctgaagtcaactctagatgaaagtgaactcagatatactaagtgggcaagtatattctaacttctgagtttaatattttaatatatttatgtaatatttttatatatcatgttttttatgtttatagggaaaagaacattttttatttatatttttgtatttctaggacatatcccaaataaaatcatagactcacatttactaaatgtttgaaatttaatttacggatgcttatagcattcactaaaaattatgtatgtgaaaatatttcatcaactgttgagctcaacataacttgaattattaccactcataatttttaaatgttcagtattagctatgaatttaaaaaattgctgaaaacagtttgatgtgctcttgtctctaggagtgcatattatccacttgttatggatcttataaaatgttatctaaaatgggttttgtaaaaggaatgatcagtggtgcatagctgctatttgaagttcagtgcatggccttttgtgatgggtaatctgtgtatgacaaatgaacctgatcatgatgacggccaccctctgaagccagtcaaaagtcaccctagcaccaagagaagagcttccagaataatttatgtttttctagggtgtccatgcctgtgtacatgtctctatgatggagaaaaaagtatgagtatctgatagaaagaccacccacaagtttaaatcacactgctttatttattattagcatgactgaatgagtcttttaaacacttggccttcatctgtggaggaaatggctcaaaagtcggaggaatagtacagacttttttttatgttagtgacttaaaaagtagcatttatgaataatgtcttagatctttctaaagatcccccattccctgtcattttacttggtttgcaaatatttgcttcaagataatgacatttggggtcaaagtgactcaagttgttttacctctgtcatgcaagtagatccttgggaaaattacttgtgtctcccacttcaattttctcttctagaaaatgagaagcatgttgcctagatcataagaccccctcatgctctcaggtcctttgtaacatcaataattcctctgcctccatcttcttgtcctcttgcctgtctagttggtcagagttgactgactagtataaagtatattagtaagcattaataaattaataataaaatataataataagccagaatatttgggggccttgagaaacccaacaagaatagctgagaccccttgacagaacattttattgaatttctttccaagggtgatattgattgcttaataatgacacaaagctataaattcctgagaatgtgttgctttttgcagaattaagttttaaaatagaagagagaaccttaaaagaaaaaaaattgattacagcctgccaaggcaaaataaaagagaaggaattttggcagggagccaagaggcctgggttcaggcccagccctctcctgaactagataaactgttctttccttcactgttctggtctcggctctccagtgagaggggaacaagtctgaactttgcctgcatcaacagctgtcagttctgggattcacacgctgtcactgtgcaggacatccaggagctgtgtgcatgtgcccataagggagagaaaatcaggggtgcagcttgcagtgtggaaggctttgatactctgtaactgcagacttagaagacatgtccctctcagaccaccatacctctaggggagaaaaaaatagttgtccccatgtgagcaaaaggccatttggaaggtactttgccttttacatttctactgtatatgtaggtcttggtgactcgtttggtgaaagagactgtcattatgcacaaggcagaaggaaccacaacaccaaaatagaaattaaaaacagcaaagagagagacgcgtgagcaggagttagaaaaaaaaaatttttttaagtaacaaatggaaaccatgataatttgaaaccaggctggtaactgactttctaaatcaaatttccaagattgaaatctggatgtcttaggttgctgcagtccctcttggatttgccaaacaggaatatcactcttgataagttaattttgacagagctgggaggtatagatatttgcgaatctcccacttacaatctaaattagatctctttatttagaataaaaaatgtgtttgaaaagcatgtgggttttttttcctccaggtttctgcacttgaaaaaggactgtgtctaattatatactcagcctagagtcacattcttggccggagcccatgataaataagcttaattctctcaactgtagcaaaataacctatagctgttaactctatcatttcaaccaccatgtgttcctgttgatagagggaataaaaaaaaatcgaccagcgtctcacaccatattcatgcttacttataacaaaacacctaagaatgatgtctttcacaattaaaactgagtcaaaattctacaggaattcccctaagctgtagaatcgcctcacctgccgatggggagaagctcaaagaggccctagcctgaatcttaatttctctacatgtatattcattttgcctttaaaaagagcattttaaaaacaaacaaacaaaaaacttcagtatattggaaaaaaaaccacaagaatatatgaaaggaactcaatatttccagtaacctgggatttctcctgagattcacaaatttaatttgatgacaaaagagaagacctaagtacttcacactttggttcaattttactgtcatttcactgacgtggaaccatgtttgtggagcactgaagaatgtgtttgtttgaaccaaaagtggaaagcgagccatggaaatcaatgctgttgctctctttgcaaagagttgggttttggttttgttttctgtttttaaatcaagctgatgactgatacaaaactcagtacaagaaaaatgtgagtggaaatcagtaatctgtagcctcatattaatacatcattaatatttctcatgttcacttgggttcagagattagccagccaagtagctaatatttggcagtgtaccctgtttccttccctagaaatcttaggcataagagtgtttgtcctttgttttggatttgggtatatgtgttcttaattttggttctcaaaaaaatctgagttaaaattctgtatcttgcccgtatatgcagcatgtgtgtgtgtgcaaagcctttggaagctagaagagggcaccagacgccctggaatcggactcatggccagttatgagccattagatgctcagtgcggatgttaggaactgaacctgggaactctgcaagatcagcaagtgttcttaacctttgagccatttctccagctccagaggtgttttcttaaacatggtataaaaaccgactctcaaatgactggaaagcagctggggtagagtcctccatctttctttctattcatttccaatgcaaatgatactttttggacttttttttttcctgtttataaaagaaagacatttgctctaagaaaagcttgtaaaataacaataaagtataaaaatcctttgtatttgataagaaatacagaaaaaaacaaacaaacaaaaaaaccccaaaacatatctatgcatgtgctataggtataatgatgtcttaggaaatccactctagaaaaataagggactccgaagccaagcggaacatgaggttcacttgtggctctccctctcttctctacacttgcacagtgttctttctccatagcccttggtactccaggccttttaatccatgtgacagaaagcatagcagcatagcattagaatttgtgacctagttatatatataaaaaaagctttcttgtcatagatttggttttggtttgttttttatagctagatactttagaaaggaatacataaactcacattgttaatccaatagaccaccttccggttatagcccaggctgggtggaaggttgtagattctgtccacaatacctaaggaggccaaggattgagacagatgttccaataattctaccttctaaatcccctaattcctccactgagaggtgatttctttctttctttttttaagaggacttctcatgcctgttattggaggttttgtttggtagtctatgtttcctgggggggggggggggtaccttgacacctcagagaggaaaattccagttaaattttatttgtacatctacgcgtcaatttatataatattaaagacattttaggtaaacagtagtaaattatgactttttcatacacccttatttttatttataactatcataattttcaaaacaaatagagtgaatttataattttcatcaaatcaaagaagataattcaatttcaagttttataattttagttgaaatggtcatgttttattttattttttagtatatattttctttatttacatctcaaatgttattccctttcctagtttctcctccaaaaccccctatcaccttccccctccccatgctccccaacctacccactcccacttcctggccctggcattcccccatactggggcgtataaaagaagtgtttcttgaatgtttaaaatattttcttcctggttccccattaagggaatgttgtgaagatcaaatacaatttaaagaaactgcaatttttacagtaaatctattacaaatgatatgaaacttgattcatgttactctgggtaggtatagcccacacttacgttaacatatccaagaatttgtgaaaattcaaatagaaaagttgtttatcttgggccatgtattaaaccaaataggttaagataccaaaaaatttttttaaattgttgacaaaaattgcttttaccaattgatattttgttagtagcatccatccataatttaatgttaccagtaagggtaacaatgggtatcaggtacaaagccccctgttattcagaacattactcaccttcatggcagagtgatatttgttaactagtgtccagtttgttatggttacaaaacagtttcctagccaccatcccatggtatcgcgccaatagtgctgtaaaagagcagacttgctgctattaattgtcctattttgtaagtgagaaaggaactcaaatgtcatccaagtggaaaataatcctttcttgtcagatttcaaattccatttcctgaagtctacacagtgatgcctccccggtatctttctgtcttcagctacactgactgttcattttgtctctgaagaactcatttatgcaatggtccttccattctgccagggactttctatatatgcagagttcctaaaaagacagagaaggctgtaaggtggagagaactgaaccaacaaatattgcaggcatcaagggtttataaactctgaacttcacagtcctgggaggtgaacagtgaccacgtgactctcaagccattatctctctgataagacataatctctttccccagacaggtgtttccctcttcccccgaaatgcccacgtgccaggacagtttctctcaggaatacctttctgtttctctatccaacccaatttccttcagaggaactctggaaattctctacaagaaagatacgtaattaccagctaggcacaaatggccaaccagatggcttctgtctacatgttcttgaaaacccagcaaaaggcattctggctctacgtattgagccttgtctcagactgagtcagagacaaaagaatggaggtgtgtctccagtctcaggggcctaatcagtagaagagaataaagagatggtaagggcctgaggaggtggaggactcggaggaaattgtgtctgatacatggatgtggcacatattgtccatattgaacctgtacaggtcttgtgtgcattgtcacaaccttcatgaaagaaaattccaagactaagaaaactttgtgtcaaaagattagcaatgtttgtactcaacagaaattcagtaaattctgtattttttctattcctgtaaatagtagtatcactggttaggtatccattatagaacaaaaatatttacatgttcttaactatttgtgaattaaaggatgaaatgtgttttattttgttttattgtaacgtgtgcctaatggtattttttcatccttgtctatgagtatatatttatacttttcatgccaccacttggtactcctaatatgtacattcataacgggatcgttgtaatgtttactggttgaaacacatgaaaattaaatgtcttaatgtggtttaaagcaattattctcatgcatttaggagctgatccctcattatttacacagatggcattttttgccgttgtaagtagccactggtcactgagaatacaaattaattttccaccaaaccagacaagctctttcaggcaaatgaaaaacatttcaaaccagaaatttcttgtttaatcatagtttacactaactgtatcttgtaactggaaatcatctcggaagtgggatcaagtttagtgaagtttctgaaagggttttaagttactagaaaataaagtctgcttaatttctcctatgttcaaaggggagacaagaatagccactgttttaggatatgaggcagtcctagttaaaacggtgagtcaccgccagcagaggtcctaatgacagaggaatctgcttagtgccattctctaagcttcacacatgaagccatgcagaaattatataattattcctcctggatggatcttcttattggcttgtaattactaaatatgccttgagtatcttcatatcctgaaattaagtcttcagaactgcataaggaactgtaaggtatgatctctggttgtttatgatctcagagttgattttaccaattagtatgtagcttccggggtcctaaaatgtgacctttctagcttctgtatgactcaattacttagacaaagtttaaagcaatcccaagagaaacctctgatttgcaccataacgctgtgtattttctactgcatgcaatggcttcctgtggacctaagcagctgtcttgttgatagtctacgctttctatgtgtgcttttaaaaatattccttgccattttggaacattactcataaatagaaacaaattgtcataaatttgtcttgtagaaaacgggaggggcacataacagctcccttacatgaaactattatctacactgactgattttgccatcctcttctaccaatgcaccaactagcaacttagttgactgtgaatgtgtcaaaaatggagactacgtaatggatccctaggagatttattgatcttctagctagaaatatcacttagcctagctagctgtttgagaggtggagttcaaggcgttagtgtgggcttacgccctttaagagcctcctaggatggttatacaggtaatggcaagagaatttacagtagcccccttcagaaggttctcattccttggtagctagcaatatggaagaacctgggttctactttagcagaaaaacttattgttttaaaatactaagcaaaaacctccgttatttcctatgatatacagtttattcttccaaagatacataaatattgcaatgtgggttttattttctattttgaggaccagtgaaacaatattgaaaagatattaatttactaattataacttaaggctgatgataaatgttggatttatatcatcttatttaatttatacagaaactctttgaggtaggcttctattttcagatgaaaaatgtaaatttgggaaatagatttgcatgttccagtttttcagatattaagtggcagaccaggattgtgactccaatgaatgtgctctaattctctagagtttcaggatctttcaccagtacctgataattttcaataatggatgctgggagacaaccattagtctcacgatggaccatatgggtcagctgcattcctttcatttgaattttatgggtaatgacctttggagttgatgattgcttcttatacagcaatctacacacaaggaactgctagctcttgcttttccaagaaagaatgatgtatggaatgctccttgggttccttgtggcaccatgaatctgattctatgtcttattgaaattattatctattgaccttctgctccaatcatggaagtttcatatactattttccttaacttagttacactacgaagattcaattttcaattacctgcacaatgtgctcaaggacacagccttatcttacggacaaagtttaaagcatgggttcctgctcatatctgaaactcatgctgtctgtgaacacttttctttcgtgtatttgcttgtacatttgtagctgctgccatccacactgcagtatattctgcctgaggaactgcactgctctttgtgcccatggtctttgcctttctcctgtgaatcatatcatatccatcagtgtttcagtcagcctctctagtttcaaacaacagaaaccaatcctgagttcctttgaaaaatgaccatttgttggcatgatacaggatagtccatacaattattagggttccataaaaggagttttggcagacaagtggaagcaaagaacaggaggcacctgccaggactatggccagggtcctatcacactcacaggctgctactggcactgctgtcacagctgttgccatggctccttctagtcctgctcctggcgataagaccaaaattgcttatgcacgtctcactttccagcacttagtgcattacccttttgccctcagacagctgcacccaagaaactgcagtaagacctccggggttgacctcatggggagtgccatgtcagcaggaatgcacacaggaagagtgctcctatagcctttgttttaaaattgtgtttgagatttcatgatcactgagcagcagcatattacagactttaaaataagagacatgctagacaacccccacacacaggcctgtcagaatcacatgtcccataaacatattacatggtcttctaagactcagacagtagccatatcttctcagttgtgcaaaagccatgccttttataggccatcaaacagcatattctccaaaaactccgatgacaatatgtgtttaaacactcactacattccctatatccccactcttctttctaatccactgagacactaggaagacttcatgggcttccagttgttaacatctacctcaaatactcttcttgcctataggtgaattttctatacttctactaaagataaactaaataacaatgctgtatagtgcagtcaatgatgttggcttattatagtaaataaattaacactgtcctaagttatatgaatacagtatctcgtttgaaccttctgataacatttacacataactacttcattttgctttgttttctttttaaaataaagtatagtttaggggaaccaaacaagttgtttgatgtttcacaagtgttaatgcgacattatggtagatcacagttcatacagccctaattttattcccaccttacaatgttctgtgtcacagagcacaatgctgttgctcaggcagcccaccatttcaattacctaaggaagctctgttgcattgcagttggtggacattcttacccagtgggaaacacaaatcttcatccatgaaatatgtagtaagtgttgtgaaccttgcttgccttcttccactagccttggagtgctcaaaagcactgaaagaggatttctcaatgttttctcctataccttttatatggcagcacctactacccacagctcctgtcttctttcagaacagacagtagctaagtatatctcatcaggttcagcaactcagaaaacttcagtttctctttctcactctccttcatggctactttcaggttacttgtcttatttgagatcatagacctagtctacatcaatactaagcctttgactcctcctttgaccatttatatcctgagtaaaggccctatgggcttagatttctattacttatctgttttctaaaatacttcttattttggctacatagaattccataaatgcacacacacgcacgcacacgctcgcacgtgcgtgcgtgtgtgtgtgtgtgtgtgtgtgtgtgtccattcctgcaccatatccatgtccaagtggatgaaccctggcatctcctgtgcttcaattgttcattcaaaaggaatttggatctctatctagtatttttatttttccacagactattaatttctaatatgctgtataatcaatctactgtttctcttttcattatcttttcccactgtcagtatgtaaactctgaatgccatttctcttgtattcaccaccatatcatgagccctttcaataattctgacacaggtattagacttgcattgggtacttgtcccactgacaccaatcctggagcgcttcatcttaatactctttctgagtcatggcttggtttccagatagtcccttgtctgtgctgacacttggagttccattgcataagcatagactagggacaaaatgtactagctgcctgccctgaaaacagcacctcagcaaggttctttactgccctgcattttcttcctggaggtacccagtgaggagtttgacagcacccacaggtggcatcaaccacctccaagtctgtgggagtccacttaattctgattctctttctttgcaatatgttggtcggatcttattttctgtgcctgtacttgcctttactctgtctttttctagcccttcccctttcttctctcccaatcaagctctgccatttgcttgagcccatggatgattgccttgcacctctgtagacatttctttgctgcccatcatcaatcttgcgaagaacactatggaaagctcccagaaacagccctgatggtgttccagtggcacaaatggcctgatggtttgccagtggcacaaaacaaattactgttacccaaaaggactatgggtaccttaaatctcttttgtcaagtgcatctgctaccctaaaacaaaaatttccaggcatttccttcctgacattaagataaagactattaagcatcctttccgatgtctgtcctaagatccctttaactcttcccatagttttttggtttctaaagctttatttttgcaacatgcctctgatatttctagatcagagtgttcatgtatggagagcagagatgaatttcaagggccttccttgaccacttgtaccttactttgtgaaacatggtttttattgattgacctgaagttcattgatgggatatgcttactactcctcgagtccccagaatcatctgtctctgtctcctagcactgggattaagaacaccatggtgcctgcctggatcctcacatgggtgctgtggatccaaactcagctcctaacgcttttactacagtggtcgtgctgttcctagaaccatttccctacatcctggatattttgtaatagatatgtttgattgagcaccataacaattggtactgaaaggccctgcaagctacacagtcttctgaacaaacatcacatcatctgtgcattttccctttaagcatctcctttctaaagcttggctacataagcaaccgcttactatatgtatcaagaccctttttcctgtcttgcttaaaagagaccacaggtatatatggacttcgcacgttcatttaattttgaatgccttgtggcttttggctctctgtatacttatatttttggttgtgagcctagcctttaatggctgagccatctctccagcccggctctctgtatacttatgtttcgtcatgtctccttcatttctgcatcatgttatcctgatggttattttgaagatacaaataaggattatctattatttcatttttttcttctctctctatcttcaccaccccactctgtgtatgtgtgtgtatgtgtgtgtgtgtgcacactaaagtacatgcacatgtgtgtaggggtccatggagaccagaagatgggtgttgtatcccctggatctggaattaaagacagttggaagctgtccagcatgagttctggaaatgagtctcagattctctgcaataacagtccacattctaaagtgctgagccatctcttcatcccccaattgtctaattcttaacacgtatatataattccatgatcccctgtcactctcaggaggaaagttttaagcaattaccctaatctatcatttactgctgattgtctttccagactcctctaccagctgtacagctacttgcatttttctgtgtaagaaatatttctgtcaaaaatgaaaatgtcacccaaaacatacctggggtaagagaaatgctactatctgggaaatccatcaatggaaactgggcctagagagacacctcagcagttaagaaaactgttgcctcttctagatgactgagattgtattcccagtagccacatggaagcttacaacatcaattccatgggatctgactcctttgggcatccaaggcatacagatggtccaaagacatacattcaggcagaacatccatatgcaaaaataagtaaataaacatatcaaccaatcaaccaattaatcaatcaaagctttaaaacaggaagctaaacaacatttcctttttaaaaaaaaattggaaatacttctttggttcttggttggcatagtttcccctcactccaaaacttcagcacacatttaaaattagttccatgtttacactgttaacaaagaaaacttctgattgtaaaacaagtcaaaggtatatccacatcttctatttaccctattattgctctctggagtgttttcttaatttgagcagtgtttgcagggttgagaggtagtaagatttttaaaagttatagacatgacagagttgagattgaacacctatttgctgtgtacatatggttactgaggtactaggtggagttgttatacacatattattatatcagttctaaaattccattaaatatttatgtcataggtatcttaaaacccataaggtcctatattttataaaatgtctcatttaatctgaacatcaattttattgttttgcaaatcaaaaaaaaaactgtgtagattagggagattattcagcccaaatttaagtggcagaacatcactggagcatggccttagtaaccccaaacattacacattatagaaactgcttccgatttaattaatgcctgctattgggatctcaaacaacgtaaactgatcagagagtcccattggaagctagatgaaactgaagatcattgtctctcacatgatgaggtttgaaggagcaaattctaacaggagactcaggtaaagctctgaacacatctctaagagtatgacgagatgaagtatgagggagatggagttgaaaatgaacagggaggtatgtgaatgtaaagaaggagtctagaatttagtgacatgaagagaaacttgctgtgacagctaaggggatgttttcaaagaggtaatggggttttgacaagcagatagagctaggagatgggaatctcagtacagacagggtacagaggcagtcagaaatcctccgacatctcacaagccggagatcgtaggcagccagtccatggaaagattatagcataaaccaatgccagcaaatatttacagagtgcaaatcactgtgacatgtggtaacaaacgtgacttttaaaggataatacattggtcaaagtccagaggctgggagatacaagaaggagatgagagaggtagcattagcaatgtgaagaatcctaggcctgatattagaagttctagtttctggttacgcctcattagaaagaggaagaattacatttctgtagctctgtgaccacataccccaatgattaataatgaaggtttgagatgtaggctttcctgattatttttgagagaacatggaaagcatgctttattgttgtagttgttgttgttgttgttgttgttgttgttgttgttgttgttgctggtggtggtggtggtggtggtggtggtggtggtggtggtggtggtggtaatggtgatgatgtgtgcatatgtgttcataccctgattgcagtttctttccttcctctcctccggatcctgttcccttccttcacctcacctccctcacctccatgtcccggttatttgctggtgaaattgcactttatctaccacagaagatagagatttctgttaaggccaaagatcaattcgatagagccatcagatataatgaattgacctaaatctgaacatttcacatgaaaactatgtaccctaccctctatcaaaacagattactcacatgagccagaggaagactagggagaatttcctggaccaatgactggtcagtttcatagtatgtaccctgcctaccttgagttcacttagcatctcccttagccctgtggacattannnnnnnnnnnnnnnnnnnnaaaacgagtaatggttacacagaactgaggtatgtctacaatgttattaaggaattgtatcaaaggataatgaaaggaagaaggtgaggaaggaagtatacattaagcatccttaaccagaccctctaaaaaccttggggatctttgacacgagtattcccaaatctgaaaggcatcaaatcgcaaacccttctggtcccaagcattccacttgacttgtatgttggatagtgagatttatgagtgtcttggcttgcctcttcagcatgctatttgattaaacactgctcaggacaactctgtgattgtgtttctggatgagattaacatttttcttggtggtttgagggaaacattttgtcattctctccagtgtaggcaagcttcatttcctgttggcactatttcttttgagaatccagactaatagagtacattttttaattagaaaaattattcttggtttattcccaggagagttgggattttgcagcaagtgattgcagcagtgctataaaaatagtatcactaaacatagttatgaatatgcaactacatttgtgaattatctaagtaacaacagttgagtacagttcaatatgttgagccaattactctttaaatataatatatcccttttgtcaaaagtacatcacaagcattttgggtatgaccttactgtcctaaaatatatggaaaaaatgtctcagagaatggatttttaggtaagaaaagaatctgatgcatttcttccaaagtggctgatttgcagtaagcaagagaagaaaggaaaagcaaggctggataaacaaactccttttgacaaaaagatatgcctatgtttagaagattgcgttgagggcatcacattctttccagatttgagcattgttctttgggtatcataatctcagctctggcattattacactgagtgagatgaggtgaagagaaggctccaatcccagctctgagttccctttctttggaaataaataaaatatttggcttaaattactctctttatgcatgacttcctacctacttcattcacctcaaatgtatttttccaacctggaaacaatagctagtcattgagcaggagaggaatatacagagggagaggtgctcttggcttcctttcccagtctctgcctaagtatgtcgtcatggccacatttagtccaatctcattcacttttgaaggttagaagaggtcattacacctgtttgccccaacattgttgcagtcattgaccaggcagagagcatcaagcacagccatccatctgggggctgaatggcatttggacaaagagttagttgttcacagggaaaatattaaattttttgaatcaataagggatgctgaaacatccaaagattacttactgggaagtgattagtactggtagtcctgaggatcaacagatgggaacctggttaatgggggatacagtatacagaatacagaatctagcagctgccagactgcattgacaagcaactagaagcacaaaaacaactatactcacttatttctcctctctttgaatggtgtctccataaccaaaggcagagggtatgggaaaccatcattgatcacctaggcaaccaagaaaggtgtaggatggattgaggaataaggctagagagtggcaatggggaataatcaacaagacttttaggacttaaattgcttagtttgttaattttatcagtctcgcatttattactgaaatactgtttaatcaaaatctttatttctctgtggaatcttaggtttggtcctataattactatttgttatctactaatatgcttgatcctgaaggtacatttgagatcttccaaacaatatagcacttagtcctcactatgatgttgagaatatattaactcaatttttacaatgaaaaacaagaactgaatctgtgaatgaggaaaggcaaatattcccagctcacttgtattttcaggcattgcagacctctttccacatggatggactgggtggaaggtctttaatacataacatgtattcatttaccatctatccattcaaagggtattctgcataagggaactgggattaagttgctgagtactgctcaaccttattctttatgtgagcctgaacaaggtccattcattctttgagcccaacagtatcctaaaactagtatcctgatcataaacttaattctaaaatcaacaggatgccttgtggagttctctttcctgaatcttggccctgcctcagtttaccttcaagggtacatggagtgtgagtagccaaccactggctcactcccaactcctaagatccaccccaacattctgtagatttaaaagaggggtaagcctttctggttgtgttttcagtagcactaacatcaacacactgcgtagtaactaaaaccagaaaaaaataaatgtttgaaacttcttaagttaaggtcaatttgtagaaatcatggaattttccaaacctaaattctaactaactccaccctctctgagtctgctgtcttagcctcttgttcccaaattttatttccactctcaagccgcaatgctatttttttaatacaccaaaaataatgctataaaatcaaaatatagacaaaagaacaggctgtaatccctctatcatccatgtaagaaaaccatgaaggaaaaattgcgtttcagtctcctgtgtagcatgtggtagatctcccaacacaaactatttaaatcctaagtatcatgactattactatgcacacacggtcatttattaattgtattttgaattaatttaagatcattaaacaggtaattcataagagttctgggtgtcacatctaaaaatgaatcatggagcatggctaggatttgaagaatgggagagcattgatctctaagaggaatgaaaaacacccaaaggctgaaaactgaattacacaaatggacctggagaaattctgttagctgttggttaactttctctctctctctctctctctctctctctctctctctctctctctctctctctctctctctctctctctctctctctaataaataatcctgactgctgtttctcctccatcctcttctttcagcctctccttctctaccactatcatctcctcctcctcctcctcctcctcctcctcctcctcctcctcctcctcctcctgctcctgctcctgctcctgctcctgctcctgctcctgctcctcctcctcctcctcctcctcctgctcctgctcctgctcctgctcctcctcctccatttctcttcagaaaagggaagttctcccatggatatcaaccagccctagcatatcaaccagccctagcatatcaactagcagtaagactaagtgcatcctgtcccattaaggttagatgaggcaatccagtagtagaaaagggtcccagagtcaggcaatttagatgggagacatgaagacactgaacaatgttgatcaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctccctagcatcccatctcagcaggcagtacacataagtacgaatgcttagcagtactaatgatgttttgctaaatggacatgtcggcaacacgcaatctaaattcctgcttgtatccatagattagtaaggctctcagccttggtgagagaagcttctttttgtactgggtgggagttgatgtagagaaacctaacaagtcaaggtactgagagtaaataactattgaatgctcagcccaaagagagatatctatatcaacctttccacagcaaacactgtggaagctgggaggagttaaagcaaatttaaagggtcagaaaaatagaaagaaatcctatgaaagtctgtcttctgggctcaacatgcctgttgtaatcacaaactcattgctgctcctactccctgtacaaaacctgcagaagcctgggtatattaacattccatcatggacacagggggagcccacaaggccccactcctccccgaggatctataggcagctaatggttctaagggatgcagtaaaagacattcaggtacctggtgcctcagcatcctctcctgcaccatggaactgagaggcttctaaagcagatgttgtttgcaaaatccgattattcaaacttcagggtagctctgtatgacgcttggtctctaagttagatgatgatagtgccctcttctgcattataaattaaggtgaaggttctctctagttgctgacatgtttttgtacatgatttatccttctcacacttggaaactgcttttgctactcttcttaaagccacaagcatgaatttattgtgagtggcatagcaaactcaaagctttagaaatgtgtctcaaaatagttgccaagagcttttgggagccggtcagttagcatccactgggaatgatgcttccttgaaggaaaagaagtagaagatgttgcccaggcaccagagagagtcgtggtgttggtattttcttttttttttttttttttgagcaagtcttggagtcaaaagtaagaagcagccataaatgttattcctatgaatagtagcactgctaatatttgtatgtctcttaatgttcttggtacagtttgatttcttacagcagatattgcctttgactaacatatacagagggtaatttataaaaatcttgagtgtcttaaaaggcagtgccagcccaaaaggtaagcttcaagtagacagtaaccaaggcaaacctggagataaatcagggctatacaggcagtctccacccagcactggctgtgaagtgatgccttttgtctcttccccctttcatggggtattaaatttcaaggattggccccctcatttggtctacctggaatgccatacaggccacttgtctgatcacgcaggacctccttagtcattatattggctgactgtattagggaaagaaaaatcatgatttgttaaagtagaaaacaaatgcttgggaatcaaaacataaatcctgtgggctttattttccataaaaaacatggaatatattttctaaccctgtatcaactttctgacatatgcaggcaatagtataactgttttataggttagataattcaaaacttaatattatcagatgagctctcccaaatgatacaattaaatgataataatgttcaagaccaagttgcctgtcacatgacttgcatttctttgttacatactctcctgtcacatgactttcacttctttgttacatgctctcctgtcacatgacttgcatttctttgttacatgctctcctgatccatctgtccccttctgctttctgctcccctcagcctctgccctcgacactctcctcactatttgcagagtcagaacaacagcaaacaaacatggctggagaaacccctgaccatgctgttctggcttgttcagtatcaatgactgcagtcttatataaattgccagctcccctacagttttaaacatgccaacacacacacacacatacacacgcgtcttcaaaacaactattttagagcattccatcattctttagattttcccaatatgctcacttgccaagctcttactgacaactagaataaatcacaagacaactaatgtgaatgtcacaaacccaatgtttctactgtgcacatctttttcttgcctcttaaagatactacatctgcacctgtctcttctctcattttgatcctcaattttgatcctcagtctctctctctctctctctctctctctctctctctctctctctctctctctctctctcttacacacacacacacacacacacacacacacacacacacacgagatgtaacactaaacaaactcaatgaacttcgtcacctctaatttactgctccatgtctagtttgcatttcaccacaaactgctttgaaagttgtacgtatatttctccaccttctatttttgtgcatataaaacgagtaacaagttgggaaaggttcttagcacagggaccttcattcaggagcacacaaagaaattgataaagagttataaacaacagctaatacaatagcattaatcatgtgacctcctgtgggatggtcatgcagcagtgggtcctatggatggggaagacaaagaggactttcctgaggagctgctgtttactctgtggctttaatatataaacaagccacactgggaacaagcacagaggggtatcaaatagaatcaacagtgagggccaaaagcccagagccggaacagtttggtttacttaagaaaaggaatgtaaacatgaataagaaagatggtggtgtcaaatgaggccagaaaggcaataaagacaatatcataaagactcacaatgccattgtaagaagagcactgggttttattctgactgtgctattgacattttaaagttttttcaagtttaatttttttaaaaattttagtctaggtaacatgatgacatggtgtatagggatcagagaatagacacaaaagagcagtatctcctgaaaaaagtaccaatagcagacaatggcaattttcttgagatttagatttatttctatagtagaatgtgcaataaagggcagatgttagacccagagctactggccttgcgagtagtcagatgacagtactttctcctgtgatgggaagggctggaggaaaagattcagttgggaaaaagagacttgggctcagccacttgcaatcaaagacacgtatcaaaaatgtctatgtgtaaatgttgagttggcactggacactcaagtcatcctgtacagccccatcattaataaggtacttgagtttctaagtcaggcacatcaaggaggttagagacattcattcattcaagagtttaaaaaaaaaaaaaaaacatctgtttcaacccagattctgctattcaacagctctgtgaccttgggaaagattaagaggttgttgtccctcagaatgttcatattctaagtagtttgaaatcttacatacctcaaccacatgtggtggtgaatacttgtaacctcagctcttgtattctagagacaggaggattaagagtacaagggactagagagatggctcagcagttaagggcactgactgctcttccagaggtcctggattcaaatcacagcatctacatgtcagctcacaactgtctgtaactccacactctcacataggcatatattcaagcaaaacaccaatgcacatagaataaaggggaaaaaagagagtacaaggagagcctgacctgactactgagatcctagctagccttgtagctagccagctagaaagattgataggagcgtagatgatagatagatagatagatagatagatagatagatagatagatagacagatgatagatagatagatagaatagatagataagataaatgatacatagataataaagatgctatataatgggtatgggtagatcatcttgaactacaacagacatagtcccactgcagtgacagggcatcaaaggctgtgtttgtctcctgcagcaggaattccaggggcaggtagtctaaggctgtatgtcactgggtgctatcaccaatcagtggtaaaaatattaaacatcctttccttttcctctgttgctgagttgctgccactgggatctaggaatcaagcgcccatctctctctctctctctctctctctctctctctctctctctctcacacacacacacacacacacacacacacacacacacacacacacacacacaaagggtatagaaaacaaaggtgaagaaattctaagtattgaagattgttttctatatggtgaaccatctccaatagctgggctttttttcttcagtttctgatataattagattattttcctcttcactttcatctccctagaaatctcctgtatattccttgttatgaagtatactgcagtgagaatttacctgctgggcccatgccaagatgtcaccctgagaacttatgtcatgcaacagatttggcacaaggagacctatttgtgaggaaaggaggggagtgaggaccaggagaaggggtagaggcagtaagtggatatgtagacagacagataggcaggcaggcaggcaggcaggcaggcaggcaggcaggcaggaagacaggagtagagaagaggatggacagaggggagaaaggagggagagagagagactgtttgggaacacgtaggaaaggagagagggagggagggagggagggagagagagagagagagagagagagagagagagagagagagagagagagagatcactggaatggtggggcagctctttatttcagttatttgagttttactgatatttaggaaatatttttgaaaatgaacaggaaacttgatggataaaatgtagttgtgttttttaaaatttatttctattagatattttctttacttacatttcaaattttatcccctttcttcatttcccctcctgaaacccccctatcccatccctcctcccattcccctacactgtggcatagggccttcataagaccaagggcctctcctctcactgatgtcccacaagtccatcctctgctacatatgcggctggagccttgagtccctccatgtgtacactttggttggtggtttagtccctggtagctctgggtgtactggttagttaatattgttcttcctatggggctgcaaaccccttcagctccttgggtcctttctctagcaactccattggggggccttgtgctcagtccaatggatggctgtgagcatccacttctgtaattgtcaggcactggcagagtctctcaggagacagctataccaggttcctgtcagtaaacacttgttggcatccacaattgtgtctgggcttggaaactgtatatgggatggatccccaggtgggagagtcactggatggcctttccttcagtttctgctacaaactttgtctcggaacctccttccatgggtattttgatcccccttctaagaaggatcgaagtatccacattgtggtcttccttcttcttgagtttaatgtggtatgtggattgtaacttgggtattcaaaacttctgggctaatatccatttatcagtgagtgcataccatgtgtgttcttttgtgattgggttacctcactcaggatgaagttttctagttccatcgattcatgaattcgttttttaatagctgactagtactccattgtgtaaatataccacattttatgtatccattcctctgttgaaggacatctgggttctttccagcttctggctattataaataacactgctataaacataatggagcatgtgtccttatgacatgttggaacatcttctgggtatatgcccaggaattatatagctgggtcctcaggtaatactatgtccaattttctgagaaaccaccatactgatttccagagtggttgtaccagcttgcaatcccaccagcaatggaggagtgtttctctttctcctcatcctcaccagcatctgctgtcacctgagtttttgttcttagccattctgactggtgtgaggtggaatctcagggttgttttgatttgcatctccctgatggctaaggatgttgatcatttctttaggtgcttctcaatcattcgatattcctcagttgagaattctttgtttagctctgtaccccatttttatagggttacttggttctctggaatctaacttcttaaattctttgtatatattggatattagccctctatcagatgtagggttagtaaagatctttactaagcaagtgaaaggtctgtatgagaagaacttcaagtatctgaagaaagaaatcgaagaagatctcagaagatggaaagatctcccacactcatggattggcaggaataatatggtaaaaatgaccatcttgctgaaagcaatctacagattcaatgctatcctcatcaaaattccaaatcaattcttcatagaattagaaagagcaatttccaaattcatctggaataacaaaaaacccaggataatgaaaactattctcaacaataagagaacttctggaggaatcaccatgtctgacctcaagctgtactacagagcaatcatgataaaaactgatgggattggtacagtgacaggcaggtagatcaatggaatagaattgaagactcagaaatgaactcacacacctatggccagttgatctttgacaaaggagctaaaaccatccagtgaaaaaaagacagcattttcaacaaatggtgctggttcaacaggcagttagcatgtagaagaatgcaaatcgatccattcttatctccttgtacaaagctcaagtccaagtgaatcaaggacctccacataaaaccagatacactgaaactaatagaaaagaaaatgggggaagagccttgagcacatgggcacaggggaaattttcctgaacagaaaccaatagcttatgctctaagatcaataattgacaaatgggacctcaaacattgcaaagcttctataaggcaaaggacattgtcaataggacaaaaaggcaaccaacagattggggcagttcttttatatgaagcccacacctgaagcatttggcagcaattgcagatgatgaccagctatgtccctgggaggagcctagtgaaatcacctgtaagcaaacactcctccttgatccttttcaaattcattgcctctgctttcattaattgttgttatataaatttcgaacaacttcccagtctgtataatgtgtatgtggtttgggggctgaccaattgttaatataaaactaattgatgtgaacactcccagggaaaactgtcttccactctcaacataccttagttgcttgtagattttgtgtaggattgaggctttaaaatctttctcctttatccatgttagcatgtctattggtatctataggcataatgtttttatgcactgtgtaaaaggttaccctcgtgttattcaaatgctgatttctctgccctcatctcctgtttcaatcctgagctcaacattgtaatgcttatttctagaatctcctgtttctagtttgtgtaaacaattcttactattaattctctgccttgtcaataaatgctgatcacccaatggctgggcagaagagacaatagggtagaaacttcctccagccagccagaagaaagatgggggttggagggagggaagaggagagagaaggagagggaaattgaaattcagatctgccacgagagggttccagaagagaaaagaaaaaaaaatctataacctaaagagccagatcaataataatatacaagtttcttgggaagggctgggaggtagccagattagcatagggggttaaagtaaagcatttaactgcccagatattgaggtgcagtttgaattaaagcttggtttctctgtgtagttatttggggaattagctggttaaggaatgactgccaccatactaattttctgaatctatagtaataatcattcaacaggtgtcatctttgttcagcccatgtttaggcagtcatgttggtgagatagcatgaaaagacctgctagcatttctaggaggagaaatctcatagaaaattccctgatcctctggctcttacagtctttcagccctatcttccacaatgctttctgggccatggggtgtgggagttgttttataaatgtattctttgggactgggtttccctctgcattttaattggttatggttttctatattggtctctatctgttgcaaagaaaattttctttgatgggtagaggactacagttactgtgggaataagaacaaacatttagaatgttgttagaaattgtgttgatttggtgaagtggtagttgtaggttcttccataagacctattacttcactagccctaagtagttggctaggtttcctgtaccaggcatgattatcctcttgtggaatgaccttaagtccaactagatagctgttggttactaccaaggcatgtgtgccactattgcactcttagtattgtcgtgccatattagtcactgtggctggtaagtaggtagcactggttttttttgtttttgtttttgttttttgtttttgtttttttttttttttgttttgtttttttttgtttttttgcttttctcttttggaagcttgtatggtgccttcaggtaccataaaagctagtcctggggaggaggtattcagctcagcttcagtgcagaaggctctgggccctgtgattgatatgcatgttgtcttgagcaatagggaattagctccttccacctatgaatgacaaccaagagcatttgcagttttctataatgtttggggaggctcttggataaccatgatcaaacaacagggaagagggcttctcatgcctggtgtttgggtttttatttgatgatctattgctcttggagagagcactgttatcccagatattattattattattaaaatgtgtgctttcctgtgtgtatacactgacttacatgtattatgggcctttttaggtaggtaggtaggtaggtaggtaggtaggtaggtaataacatgattccttttgactttccagacatccttcctgttattttacccttttttctcccatttttctccctccccactccctatttagagccaccttctttcccatttcctcataagaccactttcttttccaccctcagcctgacaatggtcccattttactgtcctagcctctgtagttactccgggatatgtgctcatatctgatggtttggacctaggagtctccactgagagagttcagtatctgtcttcctaaatctgcatgacttcattcgatatgctctttttgagtactgtcaattaacctgtaaatttcatgctttcactctcccttgtggtcaaatagtattccatactgtgtgtgtactgcattctcagcattcatcagctgaaggacgtttggttgtttgcatttcctagctattgtaaatagagcaacgatgcacacttctgagtggagtagagtgcccagtccctctactaggtcatatggtagattacatttagcttttgcagagtgactggaccagttcaccattccatcagcagtgaatggagtttccttttccacacatcccctccagcatttgctgactgttgttttgttgatctttgccagtctaacctgggcaacatgagatctcaaagttgttttgatttgcatttccctagttgtcaggaacaattaacatcttttgagacatttcttagccctgtttttcctctttaagaactctcttctcagggcccagtcttgtttttttgtttttgttgttgttttggtttggtttgggttgttattgtgtnnnnnnnnnnnnnnnnnnnnttttggtttttttttttttttttttttttttttttttttttttgagggggttgcttggttttaggtttttgcttgttttgggggtttttgcttgttttctgtttttttactttttgatttttttatagtctacatattaatatatctaatgttctctccaattctatgggcttcctcttcagttgaagccttttattcatttagagtcagcttttatgcaagatgatgcatacaggtctaatttaatttttctgcgtgtggacgtctagtttttccagccacaactattgaagatgcttttcttttttttcctattcatgtttttggtttctttgttaaatgctaaatggctgaaattagtgtacttagtttgaatcttcagttttgttctattggtctacatgtgctagtaccaatagaacaatttatttttgtgctagtaccattttgtttttattactagtgctctgcatcatatcttgaaatctggaataataatctctccagtattgttctttttgctcagaattcttttggctatttggattttatggttccatgtgaattttaggacagtcccccaccgcccatttttgttaagagtgagatagaggttttgtctttccattttcttatgtctcttaaggattaaagttttcattgtagaggtccttcatcttggttaggtttatccctagatatttcatcattctttgagaatgggagtgtgcttatgatctcttatctgaatgtttgttgttgacgtatagaaatgcttttgaattgtgtaagataattgtgaatcctgccaaattgctgaatttgtttgtcatttctagaagtttctggtagaagttttcagacctcttaggtataatatcatgtcatttgccaatttgaatagtttcactctttctttttatatttgaatcactctaatcttcgtctcttgctttatttctccagctagagcttacaaacaatattgaaaaggaatgtagacagttgacagacttgcctcgctccttgcttcagcatgattgcctcgagtttgtctgaaattcatgttgatgttgacagtgggattctcatatagcttttattatcttgagatatgttccctctagtcccacattcacggggacttttatcacaaaggcatgttagatttcataaggtgttttctttgtgtattgagataattgtgatttttttgttttaaagtgtatttatgtggtttattacattttttgacttgtatattttgaactgcagggataaagtcaacttgaccatggtgaataaactcatatctgtactctgttcacagttactgtactgagcatttgtggatccgtgtttattggggatatcagtctgtagtttaactttgccattgtgtctttacctggtttggatgcaatggctaatctttaactacactctaagtcataacccatgacaatttcaatatgatctgacacattattttaaaggaacaccaaaaactcttgcctgcatctcactgactgtaaccgtgtccctaaggcatccctagcttccaggcaattaaaaactgtatgagcctgcttgacaactgcatcaatgcctaccacccttgctttagctgcccctgattcactaaacctttcaaaaacatatttgtcctcctggctctgggccatcttcttgggaacctctgtccccaggtgaccaccatccattcacaggcttagattttacaacaagtgtgtcatacattaacagcttcctggtgtgcataaggaattctgggctgcatgtccagatgagacaggatggtaggatttcaagtctcccctctaaaaaggcccatatgtcatttctatgctaccattttggtcctgtgctgtcatggctagaaaactatagcgcatagctgcattgttacatgttgtttaacagtccccacagtggtctttcagctttctcctctgtcacagctttatgctttgtctcagcgaacagccatccaagatcctttaactggcaaagggcagagcctcaattaaatctcaggccccctttgcgcaacacttttggccaatccagagcaataatttaccactatttatagggtctcctgagtccctctgaatatttcttgatcattccagacattggaggtttttaagtagatgtttccatttatagtcgctgatgtgagctttctatctaccatctcggattctgctcacacttgcattagggtctgtggaattgccaggaaaggtgttctaggtgatgaggataaggtaagagtatgtagaacaaagtcaaaagtgagtgagcccagtgctaggagagtgcatgactcagcttggtttaaatacagaccaacagtggtggcatacaagtcttggtaaaaaatcagaccatgctgttagagcccagctctcaacagtgatgatgaatttgaggtttagataaggacagataaatgccactttcagttttgttctatgtgtttaatttttaataattcactgagtcctaagtatatgtatttaaatatacatttaatgtaaagtgtggaagtaaatgcaaaagtagatctctgctacagagattacaaaggttgagagtttctgtctttttctgttatgatatttattttttccaaaatagcaatgcgatttgtagcttgtacactggcgcagttgttagtctttatatcaatgtaacacaaaatcagctatcatgcacacaatcgtcccattaagtataaacgttggttctgcctacattagataaatgtaactggaatacctcccaattctacattaaaatagaataaacatgtaaaacagcataggaaatgaaatgagtgtctgagttttctagtctgttggggaacagaataaaatgtttaaaaattataaaagaatagcgactcagttataaaattgaaaagtagtgtatactacatatactgaggctggtaggggtgtctctcatctgtccacataatccacaattcttgaagtggcaccgaaaccaggatatgcacctgtgaatccaaagtagaagggttagaaatgcggcgtggaaagtcagctgtcattttgattactgaaagtgatattctggttggaccaggtaacttcccagtcagtgacaatagtgttgtaacaaagagaaaaatctacgttgacagaagtggttgtgaaaagccaaaacaaaacaaacaaacaaacaaacaaaacaaagaagaacaacaacaaaacaaaacatggtgggggggggggatgggattattggcaaagctgagacctgcttgtggatgagcctaccaaacaagtcagcccttcaaacactctaatcagctgcttgtgaatctgcagacagacctgcaggacaagcagttggaagagacgcttcgcagtcctgtttcctcgggcttcgatctgaaggtagacacagtgtctgttattgagagatgactttttaaataacaacaccttttaggaatggaaatctcaataggaactgacaactgaagaagaaaaggatgttgcattgatttaaaataaaaggtagatgggggaggtggggaggatctatgaggagctggaagaggggaaactgtaatcagaatatattgtatcaaaatctatttccaataaaaataatagataaataacaggaataaaatgaagcaagagcttctgtgtcaccttcaaaacaccggtgctctgtgtcacctttgacaaggatgctccgggcaggaaagttgaagcttgttacagtgatttaggattccgatgctctgtgttagcgccaagcacaaggagaggatggccacttaccaaggatgctccaacctgcctggtcccttctctccttagcacttagggagtgaagcagggggacttcccctggagaaggacaagctgagaccaactcagggcctgttggtttcaatcacaggaagatttaatttatgaaattaatgaccaatgacgccagtgtgaaaatgactggggacaaggcctgagaactaatgtaatcacaatgccatttatttttggaatgatgacatttctgaaagtcttcaaatgcaaaatcaatgctgtgctggctagttttatgtcagcttgatacaggctagagttattgcagagatagaaatccccccactgagaaaatgcctccctaagattgggctgcaaacctgtagggcattttcttaaaaagtgactgatgcagaaggatcatgtgggtggtggccattcttgggctcctagtcctggggtctataaaaaagcaggctgagcaggccatgggggcaagccagtaagcagcacccctccatggcttctgcatcagctcctgcctccaagtccctgctttgtttgactttctcccctgactgccttaagtgatgaaccatgatatggaaatataagccaagtaaaccatttcctccccaagtagcttttggttatggtgtgtagtggctggatttgtgtgtcaacttgacacaggccggagttatcacagagaaacgagcttcagttggggaaatgcctccatgagatccagctgtggggtgttttctcaattagtgatcaaggggggagggtatattgtgggtgggaccatccctgggatggtagtcttgggttctataagaaagcaagctgagcaagccaggagaagcaaaccagtaaggaacatccctccatggcctctgcatcagctatggcttcctgacctgcttgagttccagtcctgacttcctttagtggtgaacagaggttttgaggtgtaagctgaataaatcctttcctccccaacttacttcttggttgtgatgtcttgtccaggaatggaaaccctgactaagacatgatgttttatcacaatagacatcctagctaggacacatgctaaatggttttatagggactttgtgcattttgcataacaattacacctgaactgaggacaacagtacatgaaacagcctaagtctaaacctgggtttcctcagtagcacaggctgggagcctgggagccttctctaattcttgtcctttggactgcctttgctatcctccaggtttgtgacttcttgcactggccagctgtcatcttcttcctctagttgtcattgcttcagttatatcagggagtcatgagtagatgaaaagattgcatggtatgaaattctcaaaaatattctagctaaaatataataagcttccgtgaaaatgaaaataaaacgagaaagtaactgcgcactgaattttttgatcagtcagaaaaaaaatatttattgagtctcacagttatagttgtaaatattagcatctagttagtaaacatttttattccctgttcagctttcatctgtgatatacatgctttgttctgcaaatacagcattcaaaaatgtgcaccctgaatactattaacttattaacagttaaaatggggtaaatcagatgcaaattatcctttcatccttaatagcatttttgtgctatataataaacttataggatttatttctccctaacaccagttcaataaagatgcatttaaagctttagaaacagcatgctagagaaacaaagcaccactattacactcaagtgtgccccttcctacacattaactcacctgccactgaattacaggaacaatacattagtaaccactgcttacattgccaaacttggatattgtaaacgacttattatactgaaaatatgctttaacacccaggaaagctaattctggatctaaatatttcacagttatttgcttatgccttgttcttcttcatgttttagtttttaaatttttttcttgcgagggaggaaagtttttatttggcttacatatccctaatcacagtccttcgagggaagctaaagcaagaactcaaacttggcagaaacatggaagcaggagctgatgcccaagccatggatgtgtgctgcccactggtttgctcctcctggcttgctgagcctgctttcttccagcacccagaaccaccagcccagggatgtgtcactggccttttgcctagcaagtattgaaacttctcagggatcaaacagttgctttgctttagtccgagtgtttgagatttccatgcagtgttgtggggatctatgagacagtaaagcactcgttacagtcaaggagattacattcttgtaattgtacatttttagttttaaatgaagctaaatcttctcatttaacaaaaaccttggacataggagagttttgtgaactttaatcttcatgttgtagcttggaccattaggtttcttcgccttccattattttatcagctttgccctaaatatcccagtttcttctattctcctaagaattctttcctgtttacttgaaagtgcccttctctctctctctctctctctctctcatgcacgtgtgctctcttgctctttgtcttgctctctctttctgtgagtatgtgtgtctgtctgtctctgtccttctctgtctctctctctctatctctgtctctgtctctctgtctctctgtctctctgtctctctgtctctgtctctctgtctgtctctctctctctgtcttacacacacacacacacacacacacactcccacatatgcacttttgaaattatcattacattccattttttgggtgacttctcctaatttattctggataaatatctaataacatttgttgataataaatcataaataaattatttctaaacatttctttgatagacatctacttttagcacttaatgaaatgaaagaaaatgtaaatgctaaggaaatgggtgtgcttgtttgttcttaaataaagaagaaaatattggctaaatatttgatagtacaagacatagaacatcttgatactttttcaaagtcaatctattgcggttttaaattgtcagtgctaactaagaacaccacttcacaaagacacaaaacggcacaaatacatttagagccatttcacacactactgggaattgtttcctaatccaaagccaaaattcgccggataaatttttttgtgaaatcaggtcagcaactcaagaattaaaaaaaaaaaatcaaacattctagcacagtagaatccaaggatacagtcacattcgtatggtatatgctgaagaatgtgagtgtgtgtgggagtgagagggggggttgattccctaatgaagtggctgtttctgtaagaacagaacactttacctgtgaacagtaaaaacactgcacaccatacatacaatgagaatctggagtctggctctcatgtgtttccagcagggctcactggtgtgcatggcacaatatcctgtggaatgcaaggtgaccatgttacatgttcagaaccaaggcagcagggaagtcccaccatggtgcaagaaagggggcagctgccaggaatgtcctgagccattacatgcttaattttgagttaactcttggtcactttgtccaaaaatcttttaccattgccaaacgtttctcaacctccgcgttcagtcacctgacctgtatgacttaagcaactgaagtacaggtaagttttagctttaaaggttttatgcaatcctcgaacaggcattcttctatctgccttctttaccttgacacaattaatttactacttacctgggttgatgtgggtataagaacatattccttccaagtgccacatggtgatccattagatggtcacatgacaggtcactttctcattcacccgtgtcacttgtgtcacttccagctgtgtcctatgcaaaggctgaggtgattgttctacgttggctctgttgcattgtcccttcctgtgtctaggtcttgcatgcttgtcttctgtagctgcattacttataaccttcagcaagatcctgagcacagatcgtaagaataagcactcttcccttttcatatttttggagaaaataattcaatttttcatgtaaattatgatatcacttaaagggattcgcttgactaaaggatatcccttctattgatgttttttttaaatctagattagatgccagacttttcctgcatctattaagatagttgtttactttatttattatctaggcttcggtataacaaattagattggttttgagcattacaacatttcatttctttgaaaattcatatttgtctatcataagtcatcttcatgttttattgggctggatgttaagaacttttactcctgtcatctgggcatgctgtgtagtttttctttgtaaaggttcttttttgtctgacttttctattagagaaatcttgacattctgcaacgagttgtaaatattctctctattccagcataagtagaatcagtaaaaatttcattaattttttgcatgcagtcttctttgtgagaaagttctaaaccttgatatcaatttttgtaatagatacaggcctcttcacattatctcttgtgcacaaacattagtagcttgtataatttaatgaaattatccattttatagaactcatcaaattgtattggcataaagctatttgtaacccttcttaccatcctttgtttgcctttagaattttctctggcatcttttcctcttcttccttatgttggaagtttgtttctctctaagtcttttcatttcttgctctcatattcaaagagattcattcccttctttctctttttccaaaatttattaaaacattaccatgaagaactatgaataaaaacaccacacaatgaaatttaaccagacccaaaaatctatatatcttaatgaatatctgtacagttaaattagccattctcaaactatggaacttcacattggattacacacgcacacacacacacacacacacacacacacacacacaggtttttgagacaaggtttctttgtgtagccctggctgtctaggactcagttggtaggcagaccaagctggcctcaaactcacagagatctgcctgtttctgcctacctagtgctaggattaaagccaggcaccccaatgcccagtcaaatatatttttatgcacttaattaccagcaaaaaatgaaatactcttggcagagttaaaactagacatggtcccatgagcccattacttgcagtcagtccttcctcagcactagtatctatcctttcttcttgttatagttggggtttctatttctatgttgaacactatggctaaaatctacttggtgagggaaggatttatttcacttacttttttgtataacagttcaacagggcaggaccttggatgcagaggcctcggaggggtgctggttactcatggcttactcagcctgcctgctttctgcaccccccacaacccccctttctctttttacttgcttatttgggattcttatttcctcaatttcttaaactagctactaaagccatttacatatttattttctaataaaaaaccatttagtgctatggcattgtctgtagatattccttacctgtgttcaacaaagcttgatatgggcattcccacttttattcagttgagaatattctttatttcctttttctactgcccagtatattaggtgtgtgtgtgtgtgtgtgtgtgtgtgtgtgtgtgtgtgtgtgtgtgtgtgttacttttattttttttttacagtccagttgttaccccacctcccagtccaacctcccacagttcctcatcccatttctcctcccctcccccccactgtctcccagagcatgtctacaccccccaattccccacccccacctcctgccaggcctccccactccctggagcctcaagttgttatttcctttctaacttggtctttggcccaagagctatttagaataagtttactttctcaacacctggccttaaggttaatttctcatttaatttcattctgcaatgggaacaaactttgcatggctttaatattttttaagttacccagacttattttattgcctaatagaccatctatcttggtcaatgttccatgcacacttggaaggaccctgtattccaccgttgctagctgcaatctttactggtgtccattaggggaaatgcgtggggttatgcatccttttccttgtctgccctaggctactgtgcctccagtcatcaatcactgagctgataattctgatttttttttcctttcttctcagtctatccatcttgcctcatgtattttgaaattgttgtgagatgcataaatatttaggactactatataatccacacatatatcttcctttatcgttaagatgtgaccctcttcatgccagacaatgtggaggccatgaaaccctacttgtttgtataaatttagcaattcttattgcattctgctttcttcgtctttgtaatctcttcctcccaccctgcttctgtcttcctatgtatagtggcttacttgaagctgcattgtagttgagacatgttttccacaccatcctgaaaaatgtttgtcctttaattttagaacatgggtgattttatcttgaagatattatcaccctggtcaggtctgaacatataatttgttctcttttcatcttatttatctgtcctcttaacagattttaattagtcaagaacagtttgcatattagacagccttctgcaaagtcagaggggcttcagcgcacagtcagtctggctgtgtctcagacttcttgtggacaaagaacaaagtgagatcagaatggtctgattggacacacttggcttttgccttgtttgagcatggtctagtctctggatggcagctgtgattggctgaggcttggctgctggaccttgtgaaactcaaccctgtggctctagtctgtccattactcagctagattgcaggtcgccccaaaggactctatgaaagaaatatatacgtgagccaattttagtttaattccttttattcctttttcttctgctctgttttgaaagcttgtctattatatgctgccattttcctctttctttactttattagctatgacttctcattaaaaaaataatagtgagtgcaagatttacagtaaaatagttagcttatgagagtctaagtaaaagcaatgtgacaccatttcatagatactataaggatctttcataaagtgtttccacctctcccttctttgactctatgcctttgttgaggcatacacatacatacacacacacacacacacacacacacacacacacacacacacacacgaacctcacaacacatcttaaaatttgtgcattttacccaatgatcttttgtgtaaaactagatttcatccagtgttacttttggcaagaagtattttcctctaccactccttggaattttggttagtgggtaattaaggtcttcaatttccaccatctttgggatatccattggtgggggtaggggtagatagatcttccagttccgtttgctggtatacaaaatggaaatgatgatacaggaaagagagaatatgtccagaggtggagagaacagagttcagaacacagaggctgatctcatataaagccatgaaaaatacctgtagaagcaagaaaacaaaagagatgtttaaaaatgaccagttagtagttaatgtattaaatcaacacaggtttaaatccaggccctaccgtctaattactgaatgcttgtcagcaagttacacacaaaccttctgaacttacgtttctacatcccttagaaacagtttcctgaaggctggatcaatggctcagcagttaaaagcatttgctgctctggcccaggacctgggttctattcctaacacatcaggcagctcacagccactataactctagttccaggggatccaatgctctcttctggcctctgtaggcaccaggcatgcaagtggtgcatatactgtaagcagaaaaacaaacaaacaaacaaacaaaccaaaaaaaaaaaaaaaaacagtctacaccttctaaactttttaaataaatacattttgagaaggttccctccttcctcacaaagagatcaggtgacatattgagtcctcggcacctggtggggtacactccatgtatgctcaatgtgcccagcatctttgggaagaagaagtacagtttttctgtccagtctgcctcagagagaagaagcaacgttggaatcttatttttccacttgatctcatgtctttttcctcccgctcttctccctgcttcttcctcccaaagcacatatttcaaatccaaatgtcaggctgtctgcaggtgcagagctcaagactgataacatttggggcccagatgttaactgacgtaaacgctattcgcggctctgcagagtggtggctgaggcattgatttccaatttcatgattattatttgagttactaccacaccttctagcccttctacctcaactaaaaaggagatatgtggcctgcttatcccagagagaatacactcagtaatttaaaatataaaatcccttaaatgttaagcaattgcattttcaagcagaattgggaacacagctttcagaccgacccctcatttttccagtgcctttgaaaggccaatggcttctgatgcctaatgggaaaataatctcattttcaaaatcaactcacagtaataagcacaaaaatgtgtttcaaatctgtgacaagatttatatcaacctttaacattttttattaattattttatttatctacatttcaaatgtgttccccttcctggtctcccctctgcaactcccccaccccatcccccctcctttttagctctaagagggtgcttccccacccacccacccacttcctgcttcaccccccccctttcatccccctttgcttcagcaacaagcctccacaggaccaagcgcctcccttcccattgatgccagagaaggcagttctctgctgtatacatagtggggccatggatgactcatgtatactccttggttggtggtttagtccctgggagctctgaagggtctgcctagttgatattgttgttcttcctatggagttgcaatccccttcagctgtttctgcccttcccctaattcttccattggggtccctggcctcagtctaatggttggctgtgagtatcgcatcagtcttaggtgctagcagagcctctcagaggacagctacaccaggctcctgtctacaagcacttcctggcatcagcaacagtgttggggtttggaatctgcagatgggatggatgccaaggtgggacagtctctgaagagaccacctccagtagatagacatggcccccagttgagagatagggccatttacctttcttaaaatctttaacccagaattgttcctgtctaaaggaaacacagggataaaaaatggagcagagactgaaggaaaggtcaacttttgttttagatttgaattgctttagaaattgtgtggcagctcacttagttaggaaatggctaagacagctcctcccccagatgaatgaaagtccaagaagctagtaagcttggcgtttgggagtcgccaggagcatcactggtcttcagttattcattaatccacagaacaggcagctgctaagaattagtgctgtgttccagtcaagtgccaggcactgctagttaagccattggcaagtgcaacagattgccttagagttgataagaatggaaagcaattttgaaaaaaattaattaattaaatggcacagagctacgagagatgttgtgggggaaaggggagctgtttaaatagtagtttgaaaaagaaactgtctagtaggtaacttactccaaagctagagaataagaaaaacagtcacacaatgaacaagaggttaatcagggttagaagccagagtttatgcattcatcaaggaatcgttacttaacacttttcctgaactagggtttggcctgctcctcaatcaaagcagcctgaggctgaattcttcagaacagaggaagggtgctgtgagtagatgtgtcgggggccacagaaagaaggttagaatttactcttgggactacatcatgattttacttttgtgttagattgatcatgtttctctgtctctctgtctctttgtgtgtctgtgggggtgtgtgtgcatgtgtatacaaggtgttctatgttcttgaggagcagggtccccctggggaccaatgagcagagaagagtcacacaggacaaatgctttgatagacacaaacaaacacctggatatcggtacaggtgcagctgtgaggggcggtaacactcgcagaagaggaaaagcgtggaaaaagctgactcagcaacttagcaatcattgcagaatatagactcgactattgtctgacccagttctccagttaaaagcaagtgtggaaatggagagatggcaggatccaatgataccctgtcacgacccctgctctatcttagctcagataccatctgaagaaagcagatggcgcctctgtggggaatcaggagagggctcttaaccatatagggtgaacgtgctcagcacactattgagggtttttttcatggcattaatgttatctacacatatcattttttgattataattttctattgctaattcttccttaagggacccttttctatgttgctttaaccacagagtaagaaccatgccttgttttagagagggtgctactaaatgtttgctgagtgcccttcggcaccattactgcagattcacacttaaaaatctttttctgttaagaaaacatccacgagacgtctcatcttagaggcaccccagagatcttttccctcacagatccatttcatattgaagtgtggggtcagagtacagggagcccctgtttcggtgtattccctccagagtgggcactagaagccagatccccccgagccagagctcttcagcattccagcactatccctggtaaagtctatgtggaattattgccaattaatgcaactttccaacctcctggggaagaaaaacacatcagtaggaagctgcttctagaatgcagatgagctgaccactagacttctcctcatggtgtctggaaggagagtcatagactctagaagtggattctcaaggcaacatggcacgagtctgttgttactatgcccagagaagttctgctctgcctagggcatggactcatcatcatgatgtctgtgcttttgtacagttaagcttttcgttaggaaagccaccggttggttctataaatgtggatctctgttactgtgagtagaggcgaggatccctgtctagcttctcttctacaggaccagagagaagtactggccagtgtaaatatcaaggaaatagtcaaatggttatttttacttttcaaatgttaagcaagtgtttgaagatgttaatctaagtataaatggggggaaaaacttttctaatagaacattgatgagactggttttttttttttggttgtgtgaacaacattcccacatatatataatatgtgtacaaactctagacactgatgctcctagggtggcattctcaggtgttgtggggaggatggggaaggaaggttaatgtcagaggattagatcagctcgactcaagtactccactgcagtctttgactgacaaacattttgacccaagtggatcggcctgtcagataagagatgtcaactgtgggattcttgcattcatccaacaactatgtatgtgtgttctgatatgagagtcagctccaggttctagaaatacagaaatgaattaaggcataagtcttgcttctaggaggctgtggtctgaaggaagaaagatcactaagcccaggaagacagtccaacatgacaaactctgagacaaaaatgccttgtggaggaaagggcctagggcacagattatataacagtataataataaaaaaaaaagaggtcacttcaaatgaagttgtatactttagagccttcgttctttccctctttcaaataggtcacaaggaataagcctagcaaactgtgaggattaaatgatgcagatgatgctcggtgagttgctttaaaaaagacagcagaaggaaaagcggagctcagtccccagggcagtgtgcagctctgctgacccgagcgcttaaatcttttttcatagagtttgtctttccagtgggaagatttgttagagtccgtcaaaggaactcagctagagaccgtttccactgaatcagaactgacctatccctaggactctgctttatggctcttcattacagacagcaggcttgtgcaggtaattgggagtcaggacagcatccccctagggacaatggcaaggccattcagtggcctcccagttcagcttgaattcctgaaggcagagctgctcctggtttaatcaaaggcttcatgcacaccttgcacttctcttctttatctctgatttttttccttccaggctcaggaagtttgacttctcatcttccttcaagggcttaaattggaggccaggaaaccatgagaaacagtggtgccttctgccatctgctggctccttcttgtcaccagcccaaagttggcttagcaaagattccaagggatgagaggcgacactgtcagaggaggtgtgaggcagatgatgaccctgctttaccacaaagcctactgaagctggtagtgtggtactccataagcttgttttagggaaaacacaattgtgtttctttcagattttattcttacatcattaccacatcagactcatcaaggaaagtcacattctttatggatccatttgaaggcaacaacagaagtcaatgctaaagatgacagaagcaagggtagggagtgagaaggagaaagaggccaggagaaacatgtttcagtggatgccagtagtctttaattggttcaggaaacacttttttcccaaaggatctgttatttgcaagattctgacccaaatatctgggacacaaaaacaggtaatattgcctcccttgactatgacaatgcattgggaagcattcaaataaatggagaattaaacagagacctgcaggtattctcatgctatagttagtccagcatatccatgggttttaggatgtagtcaatcgtggctagaaaacagttggggaaatatgtatctgtaacaaatatgtacagactatattttcttactgtgccttaaagaatggagtatagtaactgtgtacctaaatttgcgttgcattttatataatacataagccctaaaatgattggagttacacaggaggagctgtggagattacatgtcaatactaagccatttcataaaagggacctaagcacccacatctttggggtttggaatgggatgggtgtttctggaattgagctcttgggaacagcaaaaacaattgttctacataaagaactgtgagggagcacagaggagaggcggccatcagtgtggcactgcggtgccagagaggatccctggaaaaggtgatccaagatgatattagaatagagccttgtactagaggcagcagtgggaaaggctgccagttccaggaatgtcactactgcccaagcagcagagatctcccactaagcagaaaacagctgttaaagctttagatattagacaaaattcccttggctgtgtagggatgccaatgggaccaggagaagcaggcccaaccaagtagagaggctgcatacaatgctctggagatgggtgagcaagcctgctaggataggtctcttgtcctggaaggaaggtgtctttaaccagtcctcgtgttggacatggacaacctcttccttacaagcatatggctactcacaaagtcagaaatgtatatgctgcatcctccaaattcacctgaaatgtcaatgtaacttcacgaatggtagatgttcaaccttaactacaccagcaccagtactacttggaatcacaaatacagtcaccaaacgtaagatggttctgaaaattgtggtatagcttgctagatgaacaattcagcagtacatgggaagttgtaattctagaagccacagtgaatggtaaaagcttctaaaaatctatattcaaatcaatatgaaaaatgttcagatgggggctgggaagagagctcagctcgtagattgcttgccgtggagggatacggacctgagtttggagcctcagaaccaatgtaaaaccttggtgaagaaacagtatgtgtctgtaagtgcatcgttagagtagaggtaggggtagagacaggcagagagccctggaagtaccctggtaaatagagaacaaccgagaaaggcatctgccattgacctctggcttctgcatgcatgtgatggtgggtaaccaccccccccaacacatacatgcacaccattcactcatccacatacacaatatagacatattgtgtgtacacatatatacacatacatacacgtggatagaaaatactgaactactagcaatggcacttttcttcttctatctatgttttatagagctttcttatactgcttatataatgcttgaatctaaagaagcctaaacttgaaatgtgtgtcctgatcaaggcagagacaggaaatgccctagataaatgacactgtttatgtgtttgtttctaccattgcgggttcccttttcttcctgattgtattctggtttgtgtggtatattcatttcacttgttaaagcccccttcagtctttctcttggccatcgctgcccccttgctcccttgatctgtgggatgtattgtgatgtctgcccactaatttttgctgtgactggggctggtgtctggttggtgattcacgtttgttccgaagccgaacatctgtgctggttgctttgaaacagtgccccagggaatgtgaaaggccctttgtctcactgaaacttcttctctacaactgagacctcttcctggcttcttctgatttccagcaagctacctcccttttgagttcaggctatggggttacagggtaaaggagaaaaagaaaagaaaaccaaagaggaaagagtttgtgtggggagggatctagtgtcagctcatatgggcccacgtgcttcgtaagtgtggcagagcacccttcccccagtctcactttcttctgctactgttttgtgaatgtagcctctgcacacaggaaggctgatagcagaaagacaaatgagccctactagaaaactcatggaaaaaagtcttaagggttttgcatacttggccagatgctgatgtaagtccagagagcattgatagtcataacagtgagtggcatcacatgagcactgaccaaagcactcaagctacagactgcctggcatcccaaacactcaccttttggtcttgccaaacttgctggagtttaagacgttggctgtatggccactctttaaagtattctgctggtttactatggaaaggctatgaacatgtacaccaaaatgaataataatgataccgttttacatggaatttagaagttcacttgtaggctttggctgaccccagtttcaccatttaagaacctgccctctttgccattaagaagaattcagaaggttggagagatggctcagtgcttaagagtgccagctaccctttcaaaggtcccaagtttgattcccagcacccacaaggtagcttttacccatctgtaactctgctctcttctggcctccaggggaagggccatgcatgtaatgcaatacatatgaacaggctaatacacatacaaataaataatatacatatgtataatatatctatatatacacacacagacataataagtatatatgaagagttcacagaaagaatcaggacataaaaggtttgcatgtcaccaagaatccttctttacaaagtaactgtttagcttctcagcagctagtagagatgtcactcaaggcaggtgtgcaatgtgcttcattatacttccacttgttctgaagtacaggccaggaaggctggcaagaatgtgaatccaaaggattacacacctgcctgaggcattgggaaggtgcccgtcccagaccactgggcttctgagaagatccgtctatggagcacatagtaagtggctgcagcacctgcttggccctttgcctagggctcctcatgtgcagctttctatcagcctttgtatggagtctgaaagcagctttgatcaacagtctctagggtggcaccatactccctcatctggttccaagggaagccagagttcaaggcagtctgctgcctccttctggctttttcaagaaggtactttgtgtccctggagaatcattcaggagtggccatagactgactcttacataccaaaaacaacttttgatagaaaagaaatggcattccattacccagtatgccattgtgtaactgagagtgaaaacggctgtaaagttatggagtgggaaaaggcgccttccagtgttccatcagcaactagcttagctctccctcatccgtggtctttgtatgctttctgctgcccatcatcaaagatggctcaacactatgcaatggaaaagtctagaaataaacagttcatgagttttaaatagcatttatcacagtatttctcatctcaataaatttgtgtgtgtgtgtgtgtgtgtgtgtgtgtgtgtgtgtgtgtgtgtgcatgtgtacacatgcttgtgcaagacagagctccacattaaatggcttccttaagaactctctgctttatttctcagcaccaggtctatctgcaaacctgggcttcaccgatgtgtgttgacgagctggccagtgagctttcgggacttgcttcagtacttccggtgctggaattacagctgtgaccctgcacttactttttcacagaggtgcttcagctccagagtctgatctctgtgttttcacataaagaatgtatatccacagggctatgtctccatttctccagtatagttaagaattgtcttggtcatagttgatgtgaatctcttgctgcgactgatttgcaaactttatcaccagtgtgtctatataggaagaaacagcatgcatggagctgctagcatctgttttgtttgtttgtttgttttcagacagctgcttagggtcttaggatgtatccccttcatctcaatgagttcagggaaaccagcatgtttccttaaacaagatattgatgtttggttttctctgtcttatttacctccaatgtaatggaatcatattataaagcttgcagtgtgtgtgtggcttaatgaaattatataccagaaagtaccttgtaaatttaagaagtataagcaaaagcaacatacacagagagggagagagacagagagacagagagagacagacagagggacagagagacagagacagagagagacagagagagacagagagagacagagagagcagattaggatttctcagaggatcatggcatctggataaacataaaggaaactgaactagataaaagaccatccccgctccccatacctctcccacagtctctcagcagtgagagacagcagggggcagtgtgtgcctgagagaaactgagcaaggtgggctctgtctatttgaagctaagtggagctgtgcatctgggaagaaaaacatctgagatgattaaagcaaactggggaaagacacactgctctacagtgctagcaagctggggcagaaacaagacacaaaaaacacatagctcttgtttatgttcaagataccaaacttctaaaatagcactgggcttgaaggttccttcctgggtaaggggcactgatcagaatctccctgccctcggctgtgacagcctgtgatgggattcttctcagctcagcagcctgggacagtaatttggtgttatcagattaattaagtaatttatgtggctaaatttacatatgaatattaaatatcaggcgtgggcttctctaatcagacagccagtgttttcagggtaacactttgttcccaaaacattcagaaatatgcaaattggattctttaatgaggctgatatttatgtaagggagaagtcttccagctaggaagacgccttcccatgatatttttgtctgacacctaaagctatgctagatgcttccctctggagctgctcattatcaacaacattatttatttatttattttccgctttccattctgactctgtgacagtcggtctggctgtggcgaggtcataagatctgccctctggtccaaattctgggttgctatttattaatagtaaacctgggtaatgagtagagtatgcggaacttggttttctatggacagaacaggagggactgaaaccaagagctacagactaaaaaactctctgcaaagctttgcagggtgagcctggcacacagtgcctgccacctgtaagttctccatataggtgaactgtcctgtgcagttctcaactgaccagactctcctgtttttccttctaagctttgatgtggaaaatggcccttctccaggtcggagcccactggaccctcaagccggctcttcgtcgggactggtacttcatgccgcctttcctgggcacagccagcgcagggagtcgttcctctacagatctgacagcgactatgacttgtcaccaaaagcgatgtccaggaactcatcacttcccagtgagcagtaagtaaaactcttccggttcctcactgggtttgagcctcacccttgaccctactgaagtagcagcagcagcaacggttgccatcccaatggaggcaggagagaaactgaagaagtagcaaagacatccatccatcttaaggacttgcagaatatagaccagggttcccatggtgtaaaggaaaacaaatcaaggcaagcgcagtgttcagctcatgtctgctatctgagaatgttcactgggtttatttcctgacctgttcaattgtttatagactggaaaccttaacacctttggcaaatcatacttgaatatatggatgtatgaggtctaggactggaacaaaaatggtggttgcttcctaacctccctcactggccttggctcagtgacatttaggtaagggatcacccagccacatgcctgtgtcccttctgtgaaaccttgccatcatacttatcctctgcctggctccctggagagatacagagcagccaaagcacagtcaatcttcttgattggctcattctaattgcagctaactgttggtttgtttgtttgtttgtttgtttaaagaatgacaaagggtttgtagtgcctgtttgcttaagtttctgaacccaaataaaattggttgctgaaagccatgacttaaaaggtttctgggcacacaatcatttttaacactgcatgttgtgaaactatcagtaactccctaaaatctccagtctggaaaagtccactaggttcttgtcctctgttaaaaaaaaaccccaaaacattcgccttcttgtgaaaggggtaaggaatgttttaaagttggcagtaggaaaacattttgcagagtccctctgctggtaacttttattgcaagtactctagtctaggaactggagagctgactgggctattaacagcgtttgctcttcttgcagaagatgtaggttaggttgccaggacccccatggctgctctgaaactctggttctaggagatctaacatcctcttctggcctctgtagatgctaaacacatggtatggtgtacacatatacatgcaggcaaacacttatatgaatgtaagaaaaacaaaaacaaataaatctgtttttaaggcagtatatagttataaaacattccaatcatgagtgggccaaaatccacatttttttactttcttgtaaaagatctattgactctcctatacactttgcagtatgctaggctgcaggggtttaaaaaaatgagcaaaataatgtgaaaaatcaaagatgggttacaaccagatctcattcctcaaaagtctgtgtactctgaagggaactgcactaaatggtgatgttaagaggggcacacacaggcacactaaactccgcagacaactcacattgaatgtgcgtgtgctgtaggccaggttcctttactcatgctatctgttagcctaacatccaaaccgtagacactgccaagcctacgtagtctggattttatcatgagagagcaagggaaatgcagtgaactcaaagtacgcacacatgctgtctcaggccattttacaaacaaaaggctagctttggaataaatgtatttccacgattaatttttactctactagttcccaagctcattcgagcctccacaaagagtctccagctcatgtagcctttatagaagaggctaataaaaccctaggttaaactctcccatttccttatgtggaataaaaatgatacagagagtttaaacttgaagataattgaaaacttacaagccagttctgactctggcttatgaaactacagttgtgaatatctctgcacccagcattcctgccacttgtgttatctctttatgatttcatggaccacttaaacattcccataccattactattacctttatgtccctactatagtgacaactttggttctggacaagcaagaattgtgtgtgaaaattatctagcatcgttcttttcaactttcttatttctactagttcccaatagtgtggtgtgtgtgggtgtgtgggtctgtgtgtgtgttgcatgcacatgggtgtatggataactatgtgtatgtgtctgtgtgtgatatacataggtatgtgggtgacagtgtatgtgtgtgtgcatgtgtgtgtgtgtgtgtgtgtgtgtgtgtgatgcacatgggtatgtgggtgactctgtgtgtgtgttatgcacatgggtacctgggtgactgtgtgtgtgttgcatgcacataggtgtatggataactatgtgtatgtgtctatgtgtgatgtacataggtatgtgggtgacagtgtatgtgtgtgtgcatgtgtgtgtgtgtgtgtgtgtgtgatgcacatgggtatgtgggtgactctgtgtgtgtgtgtatgttatgcacatgggtacctgggtgactctgtgtgtgtgtgtgtgtgtgtgtgtgtttgtgtgtgtgtgtgtgtgtgtgtgatatgcacatgagcaggcaggtgactatgtggagtccagagcaggattcaggagtctttctttactgttgttctctgtcattttgctttgagacagtcagagtttgaggtagccttgctggctagtgagctctggggatctgcacatgcctacccatcaatgcttgggttagagacacactcagtcatgcctagtttttatgttgatgctggggactaaaacctacttcttcatttgcagagaaagcactctttccattgagcaaattccctctttaaagataagattgggctggggagatggcttagcaggtaagagcactgactgctcttccgaaggtcctgagttcaaatcccagcaactacaaggtggctcacaaccacccgtaatgagatatgacagtgtacttatgtataataataaataaatcttttaaaaatgtaagattattaaaagtagggagagcatgtcccttcccaggaaagtacacctgctaatatctgtccttattcagaatattgatatcaggatacattaaaatcttcctgaagaatgagtaccaaaagttttgttttgaaaatatttcaacataactgcaagaacttttatgttttccagttaaggaatttattcttctccatatgagagactgtagagtttaaataatattcagtttcttctggtagtatactgtgtcagagccacattggaaaattcagtttcacactggtgtttgcatctaaactaaagtgatattcttttttttaaaaaaaatcccattttaggaatatacattttcctttatctaattccattgtatcctttatttttaaaataaattattttagtttttaaagtatttcaacattttaaatttgtattttatatgcatgggtatttgcctggatgtatagctacataccacacatgttcagtgtctgcagagaccagaagagggcatagcatccctggaacaagacatcctgtaggtgacgggaatcaaaccaaggtcctctggaaaagcagccagtgctctcaactgctaagccatctctccagccccatgaagtgaggctctttaactccttttctcctaattatccctgtacaggaagaattgaaatcaatacagggacagcccctcctttttccaatgctcctgcctctgccaatagatccaagaacagggggtcatggcaactccaggtatcctgatgcaaaggctgctgggatgtctacagaatggcttttccccgggagcccttccaatctagtacagaggagttacaaatacaaactcattttaaaaagtggaaaactgcataattctgccgcattaaatccgagcactaggagaatgttggctttgaaatgttacttacatggattggctcagtagaatatacggaaattacttgtcggttaggggagagtaggtgaatgagtaaaaaacaaaacaaaacaaaacaaatgtgaatgggggatgtaaaatggcttcaacttttagcaacaaagactagattgcaacgatgctttctagtaagagagaactaagttttcttggctcccctaaggccagtgcagctgtgttcctgagtgtggcgatctgttgggctctgctccattcctgggctggaatcatttctaaacaaatgccttcacatattttggtacaggtttctcagtggaaacacaaattactggaaattagcaggggcggtttttcttccagaaaactatggcagaaatttgctctctccacaatgagattcaaagcccacctgcaaaaccacaggggggcggaaggggggggggagccgtatttttttcatctgatcatcccatgtgcaaaggctcaaccagggacctttcagaagctaccacgtacaaaggcgtatgtatgttctagagggaaatagcacctaaaatccaggataaaaagtaaaagtggtaggccacttaaatttaagacctgtttattgatggaggggcaaagagtacaatggggtatcaaagactcaagttagagccacagctgtttcagttgattgccatgactgttaagatgtggggtctcccttatggtctaaattatctgtaagtaaaaccatacgctgatgaaacattgccggtatgtatgccatatgctaaagtactttacatatgtccattcatttagtctccgcagcctcggtgtggtaggagcacgtttttgttctgttttgtttatgcagataaggatgaaagcatgggacatggagtaagaagccaggcttgaaccccagaaattcagatgggaatccaatccaaagacatgggatttaaactaaacaaggccctagatttatcaatgatatgcctaccttccagctattaacatgttcactctttcttttagtgagtatgtacttaaatataaacattttgtgaataaataagacacttcctgtgccttcataaacctaaaggatatataagtcagttagtagcattaacaccttcagaaagaaagacaacactagagaggcttgtacagcactttagaaagcctggctaggctgggtgaacggcctattggaggagattcggctgaagtaaaaagactaggtaggctggagggtaggctggagaaggctgctctacctagctttctagctagaaggactgtggagggagggctgaggccggtgaggcaacagcccccttgtagtgaaaggcctatgagctgttttgcgagctgcaggtgagcagtgcttcaaaacatcctgtagggagaccatcaagaggtgtctggtttgcaaaccatctcaggagcttgagagttagtagcattaacaccttcagaaagaaagacaacactagagaacctaactaagcaagcagctaggggcaactgtggcctcctgtgcatataatctcaagagcatggactgacagcagtgaaggcttggtgggcaattaataaatatttgcaaattgcctgacagggcttagtggatgcttgtgggatgaggcagagaaaagctttccaccgggccagcatgctgcatctggaattaacatcgttcattaacgattaggctcttccgtctgttacacacagcaatgtccgtgaaagcattttgtaactatactatacaatagaaacataagttgtacagactgcaatagggccagtcatacaaatcttaaagaggcagaagacaggcaggcaactgcctaattaccataataaagatccactactgagggctacctcattgctcacagaaccccgtatgcagatgaagaagttaagacacagcttgtttaactctcatggatgataatactatcttagaaacaagacaacactggccagaggcagtaggtgtgcttccaatgactgcagttctaatctgtagaagacaggctcaaggcaactattagtgcaagacaattccacatattgtaatgaaacagagaaatggggagtaagttaaaactcagagtatggtggtaagaatcagcattttttattgcattttaaaaagccatttcatggttaagatatgacctacacactcaattccaagatccaattgcaagatgtcattccatacttgggagtcctcaagttagtttgtaagggtgtaatgttccaattctgtcactagagggtgcttgtgtaacagttctgaaaattccactttgctgttgagatgcttaaactgctttctccagtgagctgggaaatcaaccagtcaatcgatcaatcaatcaatcagtttccatagtcaaatatttttctattgcaattgaagtctattcttaacttacaaaataacatattatgatttcaaaatagttttgtaatctagattttttgtttgtttgtttcattttacttagtttcttccttgatacttgctctacatctgcttatatctctattggctattatttgacctacagcattaggttagtcactctaacgatcttacagagccagtgcaggtgatctgccaatatacctcctccctccccgcaaagtttctgaatatcctgctgtcagaactccaaaaggaagtcccctgggaaagctttgctgatgctgtgctgtgctgtgttgtgctgtgttgtactgagctgtgctgagctgcgctgagctgtgctgtgctgtgctgtgctgtgctgtgctgtgctgtgctgagctgtgctgtgctgtgctgtgctgtgctgtgctgtgctgtgctgtgctgtgctgtgctgtgctgtgtgtgctgtgtgtgctgtgctgagctgtgctgtgctgtgctgtgctgtgtgtgctgtgctgtgctgtgctgtgctgagctgtgctgtgctgtgctgtgctgcgctgtgctgtgctgcgctgcgctgcactgcgctgtgctgtgtgtgctgtgctgtgctgtgctgtgctgtgctgtgctgtgctgagctgtgctgtgctgtgctacgctgcgctgggctgggctgggctgggctgggctgggctgggctatgctgtgttatgctgtgttgtgctgtgttgtactgagctgtgctgagctgtgctgtgctgtgctgtgctgtgctgagctgtgctgtgctgtgctgggctgcgctgggctgcgctgggctgcgctgggctgcgctgcgctgagctgtgctgcgctgcgctgcgctgcgctgtgctgtgctgtgctgtgctgtgctgtgctgtgctgtgtgtgctgtgtgtgctgtgctgagctgtgctgtgctgcgctgcgctgggctgggctggactgggctgggctgggctgggctgggctgggctgggctgggctatgctgtgttatgctgtgttgtgctgtgttgtactgagctgtgctgagctgggccgcgctgggctgtgctgggctgcgctgggctgcgctgggctgcgctgggctgcgctgcgctgcgctgtgctgggctgcgctgcgctgcgctgtgctgcgctgcgctgggctgggctgggctgggctgggctgggctgggctgggctgggctgagctgtgctgtgctgagctgagctgtgctgtgctgagctgtgctgtgctgtgctgtgctgtgctgtgctgtgctgagctgtgctgtgctgtgctgtgctgtgctgtgctgtgctgtgctgtgctgtgctgtgtgtgctgtgtgtgctgtgctgagctgtgctgtgctgtgctgtgctgtgtgtgctgtgtgtgctgtgctgtgctgagctgtgctgtgctgtggtgtgctgtgctgtgctgtgctgtgctgtgctgtgctgtgctgtgctgtgctgtgtgtgctgtgtgtgctgtgctgagctgtgctgtgctgtgctgtgctgtgctgtgctgtgctgtgctgtgctgtgctgtgtgtgctgtgctgtgctgagctgtgctgtgctgtggtatgctgtgctgtgctgtgctgtgctgtgctgtgctgtgctgtgctgtgctgagctgtgctgtgctgcgctgcgctgggctgggctggactgggctgggctgggctgggctgggctgggctgggctgggctgggctatgctgtgttatgctgtgttgtgctgtgttgtactgagctgtgctgagctgtgctgtgctgtgctgggctgggctgcgctgggctgcgctgggctgtgctgtgctgcgctgcgctgcgctgcgctgtgctgcgctgtgctgagctgtgctgcgctgtgctgagctgcgctgcgctgcgctgcgctgcgctgcgctgggctgggctgggctgggctgggctgggctgggctgggctgggctgggctgggctatgctatgttatgctgtgttgtgctgtgttgtactgagctgtgctgtgttgtactgatgtgctgtgctgtgctgtgctgtgctgtgctgtgctgtgctgtgctgtgctgtgctgtgctgtgctgtgctgggctgggctgtgctgggctgcggtgggctgcgctgggctgcgctgggctgcgctgggctacgctgggctgtgctgcgctgtgctgtgctgtgctgtgctgcgctgtgctgtgctgtgctgtgctgtagtgtgctgtgctgagctgcgctgtgctgtgctgtgctgtgctgtgctgtgcaccctctttaattgtgaatttctatagtcatactccctctccagatcacttgccccacatcagctccatgtgagttgatatgcctgtgtcttattggatgatttgacacccagctcagtgtgtgttgcactgtctgtctccctaaatgacttgacttccattccgtaattaaacaccagatatccagggtcactgaagatctgcataactctgaatcaatttccctgggctccaactcacccttgcatattatgaactatgtcagctttatctcgaaaatctggacaggaagatctttcacccatctggacgtttgccatatgaaaatgcaggcagttggggtgcaagttaccacatgccatttctaacaatcatttctgactccatttttattctctctgcttttagtccctttctgaaacccctgagcctctcctctggcctccttaactacagatactgccatgaacaaagtcatccccccaccatagctctccctcccgccttggcgaagcctaactctgtagtatcaatcccttgttaacaccaccatcctagtccgtagtgccacctgggtgaccctgatcaccttaaactcagcatgtaccctaaagctccatgggtcccatgaaaattcccaagtcctctgcactttttttttttgtttttctcatgactattttctcagatgctcttttttttttttttttttgaaaatactatttccttatgcaagcaaatgctgaattctaacaagatccctggcgtctcttcaatgcatcatttcctgttcccttcttggccgcatctcctctttctcattgccagtaaccctctcagcggtgctcccagggctctccctgaagtcctgcccctcagcaaccacgacgttttttattttattttttaaaaaacacattcttggcttgtctatctcaccaccaccaccccccccccccccacccttcactgaactccctccctggcttacctggtcctgtgaagttaatcacaacatcataggctttcaaccttattctctacacatgcctacagtaaatgttttcctatagccgccaatgattttattcactgtttttccatgtgaaactctctgccgtaaccatttctctcattagtagcatctatcctctctgccttcttaccgagtacacccctgcctctaaaagcccatctcagacactactgactcagccaagcccttcttacttccactaatctagagttaatctctcttttggtattcagtatttcattcatgctcccactcagtacccactgtgtgtatttctttctgtgtttgtgtgcatttttcgatctccttcattacgtttttatttgcaagattgtggcttctgcataatttgctttgccaactgggtcatcatatgccatcataaaatcacaagtattgtgtcaaaagcacagatcttggggagcaaagaggcccagctaagtgctaggtagcggctactgacttgatagcacctgcgatgtgcttgcctcacagctgcacggccaatagtaaatgtaccagtgcacacagcggccaatcacataaagaatgcttactgcttgccaacacacaacagccaatcacataaagaatgcttactgcttgccagttccctttctggttcttatcactgttcaaactgggccttcgaagcgtttcagagaatgcctgactaaagacgagggtggagaccgccacactaacaaggcactttgctaaagcccatatcagagaagggtagacatggacactcgtgctcttccgctctgaaacccaacgttgcatggtgcctggtacccggaaggtgtttaattattgcagggtaccctcgcatgaccatgaaggaagggccacctttgctgtgatggtagaggacagaggaggtaggccagacagggaggggagttcactgccatcagcttccatgttgctgattcacggggtgccagcaaattaacctaatttggtgatggtggctaatgcggtttcccaaaccttcagctgagagcttgctgaaggcagtctttagcagattaagggagcagatgccagcgcacggaaagtgcgttgctgcaaacatagtttcactggtcccaagcgcagactgatgaaacaggaggtagagcgtaattaggtctttgggaccagatgagtgtcaactgttactgcttaggaggctcagactgcacattcccattaaaatttttttccttgggtactttaaaaagaaaaagaaaaaaagattatattaaaaacaaaaagtaatggaattcccagacagaaatctgtatttaaatggtattaaagctgtggttcaaatcaacaaaagccaggaaatccaatgttaccctttatccagactgttataccattttttccagtgcacagtgtgcctatgggcagccctttgagtttcctggctcaggcaagtcaaatccacaagtcagtatgaattataggaatctgggcttgccatttagtgggaccgcatgccccaagggcacatgcttacttgccaaagcttttagacagaatcacacagttaggctgggagtcacgagctgggtagtgtttttctctttcaggttcatgggctcctgcctttctcccagaacaagtaggtcactaacactgataaacttagtgtaacatgtgtgtcgcagttgatattcatctcttctgcttctttctctcttttcaccagacacggcgatgacctgattgtcactccttttgcccaggtacgtagggatcatgctcgcctgaaattcatcactggtgtgattttaaatacagtcctttgaccctaaccaattctgaaacattctccttgcaggttcttgccagcttgcgaagtgtaagaaacaacttcaccctgctgacgaaccttcatggagcgccgaacaagtaagcctcgttgttctgcagaattttagttccctcccacaacagcacagaacgctgaaggacactggactcaaacattagagaccagccctataagctgagtcacaacacacaacccatctggaaatatacagtctaagggccaagaagttctcttgcgtttcaaagatcatcatagcctcagagggtcatagaacccacgatcttggcaaaggttaggagaggtttgcaaacccatgcattcaacctctggtttagagaaggaaatcttgagtgtcaggaatctggcaactagcttgtggatgtaccatgggttagagaaacattggatctgaggcttgattctcttgctttccagtcagtagttaccacagcaggatctatattcagtctttgttaagtggtccatccatcatttgtttgacttcatccagattctgatgaggcaggtaataggaagtgcaggtagagcctaattggacaattatcctcctctcactgtcctgtggtttgttctgcagtaagtctccttgcaagaggaagttgcatactgctgtggcatctctcctatcccggtctctccactgttctgcaggctctcaccagagagcattatcttacacactatttgtgtgatcatgcccatctttggctagggcattgcaggggaccactctttgggatgaaaagtagatgcttatacattgtagctaagatgcctcaccacccagattaaattaacatgatggaacattggttgtagtatatttagaaaaaaagaaatagttgagcattccctatcaaaaaaatccaaaattcaggctttttgaactctgatatgatgccaagaatgaagagatccacatctggcctcgagtgatcgcttgcacagagttgcactatgagatcgccattgggttatttatggaatgtgcacataaaacaaatgaattttctattcagtcttgattcccttccctaagatttctcaccatgcagattaagatattccagaatctgagatataaacaaaaaagcaaatctgaaactttcaacactcagggacacccagccaatatgtggaacttgggtttggagctttgcttcctatttattcacttaataatccatcccttgaatatttatttcatacatactattcatccatgcctgcatgtacctaattgcacagatacttactggccattcactttatatcaagcactgatgatctcatagtggtccacacagctaaggtctctgctcctttgtggcttatgtgctaacaggaagtgccggtgattaatcagtgagcagtcagatcacatctctgtcacatgggctggagcaactgggacccaggagttttctgtctattcccctctacactttctgcctagactgtcttcttatacctgtcacagtcagattagccatgttctgacatcttttaggttgagtgtcatctttttcaatatgcttttctgatcctgctaagcctacctgagtgatctctatttggcccaaaggcatgctaatgacctaacacactgtctttactggaaattaggaatttccttaccattgcgtgttgttctccgggtaattggtttctgggactattcatattggccacacattcagttctggaatctgcttagaatcattctgcttggaaatcatatacgtgggcaagttaattatcttttctggatcttggtttcctaaactgtaagataaggttgtatggggattaagtgaattaatattcagaaagcactcaactggcatatagcatagtaactgtaagctattataactgataattcatcttactgaacctagaagggttttcatatcaattatctcagcaatggcctccacaagcaatagtcgtgacagatattattacttccactttacagataaggagtcaaggctgagattaaatgacctgactatgatcaaccacacagcttctagtgagcacctgttcactccccctgggtgcagaaaaagtccttggacagcttaaacgtttatgtaggagccatgtaagaaacagaggacaatcagagaagctaaaggcaaacattaactaagccagtgtccttaagaatgtagccccaggtcagaatgttacaggtgggacaaggaagaaatgatgagtagatttcacaagcttctttagtataaccacatttgagaccaaactgatgtgttacacagatccaagtagacatggggctggcatgatattttcaatgctatttgttagcataggtgtggctgttcctcctctatcagtagcattagagacagcctaaccctgataattgatacattgaagctgcttccttaaaaattgggtcttcacatcgctgtgtgttctggattacacaaagctctgggaaacaggtatcttaagaccctaaacaaatatcgtgcacagaatgtacctagaggcatgatcaccctcacactgagaaccatctctcaaaccaggacgccttgtgtcacatttgtccaagacaagacatatttataaaagggagtatgtctccagcagttagccctcggcatctgctgatcttcttgcaagtccatatctgtgttttatagagttagtcttgccatgtattgttagacttttagattatcttatttcaagatagggtttccctctatagccccagatgacctggaactcactaactcaccttgtggctcgggctggccttgatctcatggcaatctagattatagatttcacaagcttctttagtataaccatatttgagaccaaactgatgtgttacacagatccaagtagacgtggggtaggcttctgaagtacttgggaatacaggtatgagctactatctccagcatgatctcacatatctctataatcagcttcaaaggacaaaaacttcaggaaaggcagatcctctagcacttctccaataggggcagagagcacttctgtgaggttctggctaagacctgagtggtgttggttttaagccacaagtggaccaatatggtaggggtaggttggagagctgagagtccactgatacaggccactctactgctaggtggtcagtgcccaccaataaataagaaaagaaagtgaagataagattgtctaccaggggtgcacacggcatacagaaagcattccccctccccactacatgcattatgttaacaattggagctgtaagatccatggaatttagaagttgctttctgggatatttaacgtgggttccagggtaccactccctgtcttgaatgtagcatttaagcagtaattatgtccttggcgtggttttcatgagacatctggctagtgtggtttattatgtgaaaggaactcccacccagagctatacttctcttagcttacggtttcttttatcttttggctctttgctctgcataaagcggtccattgtctgcccgagctttgccacccaaagggtaaaaaaaaatcttaaaatttctgctaaggtggtttcctttccaccttaatgaaatgaaggaccaggactgtatttcttggctgcaaataaaaacttacacttccgttgtcccaggagttaattttgaaaactgtagctttcatttggggttgttaatcagagacatttccttgaagtacttgatggcttccaaaagaccggtggtactgttgagagtactcaccacccagtacccgaaatggcctcttccatcatccagtagcaatgactgatatgtgtgacatatcagtggcatacagaggaatcacatcgtctttgcattcacaattcttcagaggtataatctgatcagaatgtacatattctttgaaaattaatagccatcttctttagtgtgtacctggaatgtctttcagagatttgtatattttggcataggatttaaattagctgagaatcataaaatcttgaacacttcagatatggaaaatacctagccaaattccctcagagaaagcgagggaatatatgtgagccccatcacacgggacctcacacactgtaaatcatcaggaaatagtagttattgcctgcttgccccaagtgagaaagaaactgaggttcggtgagctaccaggggctacgcacctggaaggtgccagagtctggattggggttaagattcttggcttctgctgtagcccagttctctttaaactatacgattcaggctgaaaacattaactactgtggccacaagccttccctgttcctatcaacatcttgcaaccaggtaatgaacttccaaccattcttttataatttagagactgcttgaaaccagacaacagtattgtttcttttcccttgggcccatgagttttccagctggcagtccccatgacttaccgacaataatgtggtttccaggagccatctactcattaaagtgtactgagtctcctttctagaccacttatcaggaagacgtgataaaccaagtcagcatggcccttgccttttctcccatacaagaatacctatctgaatgaacaactttaagtaaaagctaagatgtcacaagattacttccaagacaaaagaatttacaagaaactgcagaaagaattagataatatgagtagctactgagagagtaggtatttctaacatttaagaggtcctagtttgagatcttcttttccaaaagcctcctggggaactcggaagccatgtaggagaaaagttcaaaggtgctgtaaacccattggatatgcagtgaggtgcacatcactctgatgccagactacaggggtgcgactaggaaggaatgagactcggtctccccttatattccttacaactgtgccaggggaaaagacaggaaggtgggagacgaggtacagtacaacagtagagtaagtgtaggaaactacatagcacaggcaagggccactcattccagcataagtgcaagatggtttcaatacagtcccaagttatacaagagagtcagcccccaagacagacatccacaaagtcccagcaataagaaatggcatgcaacatagacagcctatgaaccaagactgagcaccaaggcaccatgagaggttagagagaagaggggcaattttcgattaggaatatgtgtgtccttttgaagaagatttgtaatcttcaaaggtgcatgatgtttagtgtgcagagagcttccccagcaaaaggatggcctgagcatcagcaagaaaggagcaggctgagttcaaagcaaaggaagagacccacctgggcctgagcaagtgtccatcaaattttcatgcatctattgatctaacatgacactcagtgagtgttaccgtgtatttggcatatgaaggctttctcagataacatcctgggacccagtagtgagcaagtctttccttgcctacataaagtttacctttaatctagggagttatgtatcaaaccctaattagaccgttcatattttaattacaattttggagttcagcaagggagaagtaggaaatgcatgagagcacacagccagtctgtggtctgagatgaactgtcaggcaccgaggaagtctagtgataaactagagatggacggtgaggacagaaagctaaaaaggctttgtgtgccaggctgaagaatttggaatgaaatccttcaatttccttgaaacaacaacaacaacaaacaaacaaaaccccagctctcaggactagtgcagaagtattcagtggatggtataatgaaagtaaaggttttagcacttcggattcagaaagacttggctttgaatatttccctgccagttggaaaccaccatgtgtgctgtagcgggtttctccagtctcctgctccctaaagttaaatgataacactccctcgggagggaactgagaaatgtcaagcacggtgtccaacagagaacagcaatcttggcatgaggattcccctactccatcgcacatgagaatcagatgccaaagaaaatattgctcagcatcacccagtagggccactggtggtagctatggaaacctgtccatggacctgcagctacacaaaaagcactacatacaggttctcttatcccagggaaagaaatatctggagagaagtcacaattgtggccacccagcaagcagagccttcctcagcaatggccttgcatgcttttctccatcatttagaatttggcctctccctcagacctgcctatgcatggggatccaaagaggactttaaagtgcagatccttaggccctgcaccagacatatgaaaacgaactcttcagaggtgggaaaggtatttatgaaatatctcccagagtgaggctgatgcttgcttatgataccagagcttgttagactcaaagtctgggccctggctgagtagcatgctatacattctcgacacaacaattaaagagacaacagaaaacggagatttattcaatagagcagcactgggaagcaactcagtggcaccctcctcccccacacatacacaagaccatcttcaggctctggaccagaatgttaggttgaatagaaggcaagaggggcccataactaaagagttctgctcaagctatctatggtcctgcctatgactgatctatccatctcagctccaggtctgacgagtcctcagcactgcatggatctttttttctctttccactggggaaaatcctaatgtcttggggtccattgtctcatcagtctaatagtcaaagggatgggtacaagtgtctgtctttaggatatcgtcactcatgtcaggacacttatactcataactactggcctgcatctctttcttgaccatcaacaacatcctgtgtgggaaagtggcacagactactgtcagggcttctgaaggggcatctgagaccaccagtgttggtagcatctgagagcttgctagaaatacagatctctctctcccctgagggtcactgcatgggatcccataggcaagggtaactgcaggtcactgctttgaaaccccagagacagggctgcttcttgtctactaaatcagaagaccagaggcaggctggagcaaaatcttctaatatgtctggtagatgactctgatgcactctgaagttagaggtcactgttgtatacttgcacagggagggcctccagcaatgcactgggaatctgcgagagtctgatggagaaattctgccaagcaccagaaggaagatgagaccagcaaaggactagggactgacaggaaacaagagagaaaagctagtatgaaaagcctacgagataacacattctcctagctttagccccgaggggcagagacagattccagagacttgctggccagtgaacctagccgaaaagacaattgccagcttcagtgagagacccctgctttcacccatacctacacggtcaagcacatctgcacacatgtgcacaaacacatgcaaataaggggcgttgcactcttagtggaatacgggttggttggtttgtttcgtttgcctcttggtgtaaggagatggtgaaaaataacacctcatttctccatgaagagccagtgcctccagtgaagaaaccaggatcgctgtgggctagttgctgggtgtggtatttatcaaatgatttgtcctctcaaacatctcggtttcctgaggtgcagataatgtaggtcctgaactgacacatctctaagtgttcctctggctgtggccttctgtcctccaagaactgggattcatgttgacttctgaattgagacctaagtaacagttttgatgctgttgttgttgttggtggtggtggtggtgggttttttgtttgtttgtttgtttgttgttttttgtttttttttttctgagaggctctatcagaaaacctgaagtggaggggttggcagtggacctgaggtaaacaacttccttcctggggagttgttgcatcctgatgctgtgcagagggaaattccaggccatctggatatgagagaattgcaatcgtctacccatattacaggagccggccttccggtgatagccttatgtcactggataactcattaagccctgaaaatctcctggggcatcagggattgtggtagggtgggggtgcttttcaatgcatactcagcctctttttctgcttctccacaggaggtcaccagcggctagtcaggctccagtctccagagtcagcctgcaaggtaggcctcctccagagatccatctctacattctgaagcaattattcgagactgttattagaataacagcgtttatatgcacactgtaaccctcagaagcaagtcacttggtgaccttttttcaacagtgtcccatcaccccaagtgaagcccaactaaaaatacttagaaacaaagtgcccactgtgtgcctagggcttcacaattaaatgtgtggtcctgccgcatccagaagaggaggcagctgtatgtatgtcaagagtgcaacttgaccttagcttgctgaccccccagtgaactcctggagtgctaacctcaaacattcccccacagggtgtccacattagcccaaggtccccaaggcacattaaagggtttcctcttagcatcagctctagctacaagttgctccgcatcctagccaggtgtgaaaccaaaggttctttctagctcacaaagagtttctcttggatgtcatccagcttcattcctctcatctttcagttacgagcatctgctcttcctgtgtatcgaagtccattgagaaggagggccaccttggaggaacaccagagagatatgtccaacatgtatttgtcacatacaaccacttaggtgactttgatgaggtccatgaattcctctcccttgaccctgtcccattcttatagcaggggacgaagatacactcggcatggccctctgatatctaacagtgctagtccgggtacttcctcctcagatgttgtgttctgttagtatgacggccataaggatctcagaagtgtcataaattactaacctctgaacgaagggaacaaaggcagtgcattccatttcctcatcggcttctgaagcacttacagaatatgcttttaaaacttttagaaggaaaaagatgtaggaaaaaagtgaaagaaagacatgaggcaaggtggagtcctgtgatatgagctagaaagaaggaaacagtgttctgcccacagacttcaaaacctcggcatgctgatgggccacttccgttaggtataaaaagaaacagagtagcgtcttagtgtgtagctgtgctagacgctgaggagatcaaaggagctgttttgaaccgcctgttgtttcatcttattggcctgcccacgtggtggctttgtttgcaattctaccaacatgtttctgataccaatttgaatatttagaatacatttcctgtttcttgtaataaatatgagcatataccaggagggtgtatggcacttagggttctataaactaactcattagcaaaaacactgaaagatgttttatgattattggcacattgactacagcttggcatcgggagctttcttaagtgcctttgaaacaatggagctaagatgtaaggatgccccttaaggcaatttgtttttgtcggtctttgtggcaaactacaacaatcctcggttttctctggaaagagactgtggtggtactaattattacgtaattactggtttcggaatcttctcaacggtaaaccacaggcagaagaggacagaggagacacacatcccgtgttttgttcttattatcagctgaaataagtcgggcagatttttcctgttattttaatatttatcagcatatgacaaagaggcatgtttaaatagaaactttaaaggggaatgaaaaacacacggctttgagtgagcagcatggagcactggagcactgctttagaacataaggttttttattgaaaatttatgaaagaaaatcaggtgtgcatttagaagtacttaatttgaacttgtacattttgatagaaatagaaggtttaacaagtacaggacgctggctggaaaaacagctcagagtttaagaggacactgtctgctcttccagaggttctgagttcaattcccatcaaccacatggtagctcacaaccctctgtaacaggatctggtgccctcttctggcctgcaggcatacatgcaggcagaatgctgtatacataataaataaataaatctaaagaggaaaaaacgtacaagataatagtttgaacatattcaacaatggaagcaaacaggagaagccagatggcaaaagatggctccctgcagcatcttcctctccttgttccccacccccttgttctcctctctccctcctcttctcctcccatacttttctccctcctactttttcttctcttcacgctccttctcttcctcttctactccttcttcttctgctgcttcttcattcatgtaaatgaaatgtgattcttcaattccaatgaattcttccaatctggttgaagtttctaaacttacctcgagtcactgggtgatgaaatctctcaatcagagtcagctcttctctctgctggaccagattctcagcttttggggagcaataggaaagtcttgtctttgaaatgacaacttgtgtttttagcatgattgttcctattttgtcgagaacttaattctggggtacacaatggttccccagtggtgtgtctgtcccactggatcctgggttcctgggggtgagaccacatctttctcatctctttgtctttatagtatggtaaattatgtctacacggccggaacagagtcaatgccaaactggccaggactacgtaaaggttggactgtatttgaaagaatgtgctcataaagataaaatataataataagccagtttctgcgtctgaaggaagtgtttacttctgcgcttctgtttctttcttcagagtttttatcacttactctactgaaattagaaggtgttggggccttacgtatgccaatgtgttcatgcagttttgaataagaaaggatgaaacctaagaaggtgacattttgctgacaaagtagggaagccaccattcaaagatggaggactaaatgggcagagagcagctccaaagcctgagtgcgaagatttgggaggtcacagtgaagcctcgtgagggcagtaaaaatcctaggttatgagccgctccacttggagaccagcatcactttcttttgaattagtaaagtcttggggttttattttctgtgtaggagtgaaaaagaaggaaaataatataataaaaagaaaattaagtctaaaacaaggcaggaacttgaattctttcacctggacatattcaacatggaagactgaaaactcaagatttcccaaaggaaaaaccaaatcaaataattgaaacaaatcaacttgtatacatatgtgcggttatgtaaccactgccaggctttccccatacccttattcctgtgctcgggcatatatctcatttacgctttttttgactatgtcatgagagaacctactaagaaaataaatcgctaggtgatcactgcgtttgcagaaggaattttttttcctacacaaaaagattagaaacatatttttttttagaaactctcacctctgagtctcataaatgacttaatttacaacaatatatacatcaagtatagaattttgtggcagccagaataacgtgtggagtagggtattctatcatactatttcatctaaaatttactaagagccattggtgcaaatcatgactatcaccacttgtaatagagctgtttttaaagtaacccagaagttcatggatcatccaaaatggcagccaaccatgtcgatgagatatctgaagagctgcccggagatctccaagccagactaccgcagactacagcttgggtgtctgtagcattaactgtagtgatttccaacatgagtcaattaaaatatatttcaaggaaagaatgtatttggagaaataggatgaggaagcagaagtcttccagtaaagcacaaaatgtgctgacctatctcaacagcagccttaattaaggtttttcccaagctccagggaggccatgtcttctagcatcacttcagggccactctggaaggaatgatgatacaactgatgaagagtagaagagacctcctttcaggaagcctgtttctccacatgactcctcactcatcttcacttagctttgactatttctgagattcaagtagatgtgccagatgcacattttgctcaagaaatagaacaggggctcagtacatggtctctgaccctgaacagctcagaaaagtcaaggctttgctagaactgccaggcctgggatgtgagcgggacggctgtatatgggcagaggtctctctgaggaccatggctcaggcttgaaaactgatccgtggcagatgactggagagggaggccagcacaagctgaacctttacttcgtttctgcattaagcaagaacagtcaggcaggattacaacacacgggcaaacagaaataagatcaaccatcttatcaaagaccctggccactcaggacaaaggaggtcccgaaggaaattacaaaaaagaaaaggggaaaaataaaaatagcagacattttcttcagtgttcggtatgatgtgtgtaacctggaattctgggacaatcggctcagttacacccatatataaagagcctttatatacaaatagaagtcataaaatagaactataccagaaaagctgggaaattctcaagatagtgccccaaatggtttgaaagagcctgttttgtctaaaatagccatcctataaacatttaccccagaacatggacgctgaactgcctgcaatgatttgcaatgatttcatatatgtctaaatttaaggatggctaactgcaaaatcattagtaaggcagctaaagtgagaatggtaaaaactgttcccttgagcaaacacagctaaaaataaggtcttgcttattagtggccacgttcccttgttcagaattaatttcttcatttagcaggaaaagttttttttcctcatattaatcaggacctgggggaccagcagcatctagtcccttagcatttgcagaaagagccaagtccgttcctcacagactccacatcgtgttttcgcgctgctgagagacactgtccaccccctccccctgaaagctggaatcatgcatgttagtaagtatttcagttatgccattgacgtcaatggagtcattaaatagattgctggccctcccagaggcaaatcactgccagggacctagatacagacacttttttttttttttttcaaagacagccatcaggttttgctatgagagagaacgaaaagtttacactgtagccgactgtctccaaacagtttctttttgccctttgcattttgttccggcctttctttctctttggttacagtagactccaaaagacacccagatattattgcctaaatgttttgtgcacaaatggatctcctgtaattgagaccatagaggaagatactgaactttgaaaaaaaggagtctctagtttgctctgttcagcccatcttgatgttaattcaggggcatacattgttctagccaaatcactgttgtctgctactgaagttgtttgacgtttggatccttaaacaaacagcgtccttcaaagaggcacacagattgccttttctgctgcctctgcacggctcaaagctgtagccctcatctctgaatcaatctttctgcagctgtttcgggctgtggcactgagcctctgtagcgaagggtggaggaggaagccaggaagacaaactggttctcagggctgtctcatctgcagcagtgtacccacaggaggctatccacgtgcctgtgtcctcccaaaccccagctgctgcccgcctcaagcccgatcacgtagcagcttccaggcctgtcggagaaaagcccttcgggacacagctgcctcttcctgggaatgcctgcaggctctgtttacctgagctgcagctggaatgtctgccaaggactcgctccacacctggacttttctaccactgaggctcagagccagaaagctaccttcatcatctcttcagatctggctcccttcatctaccatgcaggctataaaacttacttcttactacagtccttgcccctccagtccatggatggttcccttcctttatttatcactggggtgtatagaaatgctagacacttgaaacttttggtaacccttcttgagttacgtggagacccaggttccatgtcctccctgctctgttcccttgttctgcagttcctggcttgggagaaccaaaactgcaccgtcttcatccatttctctctcattgccaggacagccagctcctttaaccacttctttctagtcttttcttctctcccggcataaaggactttgttttcctgtacccaaaacattatggtcatcttccaacgtggtttgttgtccacagtgtttgcacgttctgacccaaccttctttctgatctagcatgcttcttctaagccccattattgattgttttgttattgtcttgttttgattttgggtggtgtgtgtgagtgtgcatgtgtgggagtgtatgtgcattcgtgcgtgcatgcatgcatgcgtgcgtgcatgcatgtgtgcgtgagtgcatgtgtccttgtctcccttattgccttacccctacattgctcaattcatggttgtgtgagataaatatgccagcctcctgcctcctatctttccacactgactcttttcccagggctgtatatgttttttttgcttcttcaattcttgagtgacgattaaaataaacatgtattttcaataaaaggcctggtatatagtatatatttagaaaataccacatgatttatccatttccatctggaatgtacatttttatcatttgagactacttatctgacatcttcagattatgtccctataatgtcctattcaattattatctcagaaacttttaatcagtgtctcaaaatctcaaaaatagtacttgaaatatcttgttttcttccctaaccgaagcatgagtatctcaaatgcatagacaaatcctctagttttgggcttccaactaagaatgtaaaacctaactgatgcccagtaaacactaatggaatgagcaaatagcagtgaatgattgcccaagcttgagtccgaaacatcggaggagctcggctgcttcctttgctttgttcaggcttgcctacatctctgctgactctcagaacatgcgcacagtgctgaaatccctggctaaccttgatggcatgtgacgctcaaagcacgtgaagtgaagcctgtgctatcatttcagcatgaagtaacaaagttataagaaatagaaagaagcaaaatgactaaatacatgcagcttatcataataaacgataacattctctcagtacccaccacagggctacagaatgggtacttaataacttaccaagatggactgagttcggaatctggatcagtctctccagtaaattattctccaaaactttggtttcttatctggagaaatattattgttattgtagagtaaattctcagagtaaataagaaaggccatgttggttatgactgagctagactacccgttccaaattctagctctgactaccttgtgaccttgggacaaattacttaatctctcctagtctcagttgcttcacttgctaattagtatgcaaagagtgcacatgccctataagctacttatatggattaagtgacttgacacaggcaaaacaatgagaaaactgcaattggctttctagagcatgcatcacatgacctcagcgtgcctcgtgtggcctagtgcgttgcagatggtcagaatgggagagctaagaatccaggacttctggtatcagcagggaaccagaacagaaagcaccatggaactttcaggttgacttctcctccatggtaatatgatataccccttccccgtgccccttatcttcagtttcagttttttaaagatttcaattatctttagtcaacctggtccaaaagtaataaagtgaaaatcccacagagagggaaattcataagcttacagtcacatggcctttgagtgtcttgatgacattgcatcccgatccctctggctggggtgagtcggctcactctgcagatccatgccttatgaactaactgcccctacgttccttagtcaccctctgggttgtgagattggatgctgtgctatcacagtgcctgtcttcaagtaaccccagcctcacttagaacagaacctcttatattttattgtttactgttgctgatctatgactgagcctaactcttaagtaaaatttcatcacaggtatatgatcataggaacagacaacacatgtggggtccatttgggacttcgtgcgattcttggcatgtcctgcggtcttgagatatgtctcctgaagataatgggggatgttgtaagacctgaaggaatgctttcttagtttaaaacattttcctcctcttcccatttaaaaaaaaaaaatcaaaatccggttttgtagaaattgactctgagttgaagacagattctctgtgacatattagtgagacagtaagagggagaatgagctagtaatgcatatgtcaggttattacccttgaaaacaaactgccaagaacagcaaatggctctgacaagccagaccgcagctatctgagcattttttgcataaacctgtgaggacctcgcttggtaagatagcctgactgagtacagccacacaactcactgcaactgtttaagtccacccatcagggttgatacacacctttctaggcacaggattttccagcgcaggcagctcagcagggagtagaaattgaggccagctcagagcttcccttgggagacaggtaaaaatcctaccagcagaacaccacagggaagcacttgcttctgggacagggaaagctccctcatgcacaccctccctcccttctcctctccacatgggtaagtagatcttagcctgcaggaagatggaaatgaaaagttgctaggagaactccgtagaggaaggaagggacccttcttagtgtccctttttactcccacatcctcaagacagaatgatccaagggacaagatgggttctgctcgcttctgatcactgtgggctgattctagatcagttctcagaagccaggagaatttcagggaagtgtttcactggagagaagagaaacaaagcagggactgtccccttgaaatagagaacaggcaatagaactcactgggtcttagcttattgtcttgacttcctcttgtccagagctgttttcaaggaccaagggtagcactcagacgtctgtgtacatttctcacccctttcttcactgtgtcaatgaagtgagctgaggccatggtggacatctgactcacttaaccagcagaggcagccacaacagatttctcccaattgtactctggtcttcacatttccagggtccagagtctagctagcatgagatgtttccaagtccctcatgcctgcctctgacagcaagagaggaaagaactacatttctaggtgcaggcactatgctgcatcctctggatctatgatctactacctactgtttcttcaggtattgttcctcacggattgcaaggacagctcagggaagagcctggacttgctcaagacagcaggttaacaggtgagaggtcagaactgagatctggatctttctttcttgaaagcacatgatctctgcaggcataggcacatacatacacatatacacatcattgagacataataaaaataacatcttttcctaaggtggggggtggggtggggctggctctgcagttagaaacaggtacttctcttggtatctccagctctaagaaatataacaccacctgtccaaggcacctgagttcacaggcagatacacacatatatacacataattttaaaatgctaaaaacgatttttctttttaaagaaagcctgtgttctttcctcctgagcctggccacagtccccacctacagaccacttcagtaacctctgctttgttgttagtagtccagccccatccctcctaagtactagcaccagtgtgaacttgataactataaggaaggagggtccgtgatgctataactatgccccactttttcacacataaaaggaggaacaatgctaaaaccttttagagctatggtaacactaatagaatctttgcatgcaaatcatttataactttatctggcattcggtattatttaacactgtctctaattattgtcgtctgttattatggggaatgaaatagattgagacacaaggaagagctttatcaataaatgaccttgaacttgagccctgaggactgaacagaaactagttggatggtcattgagaaagaaaccaatacctcaaagaaacttcacccataaaccctagtggctgcagccccagtgaggagcaaggtgggaaaggctgggcagacaggagggcaccggtactttctggttgtgaatgataagtaaactttattattagtttacttgggagccttggcaaggttttgagaatgagactggtatgagatagtttgaatcgtgaaacacaaaccttaagtctgagccccaaggcagaatgattaacagggcttatgtgttcccaggacctgaacttcttccaccataatcgttagtccagccctcctacccccccaaccccccaggattaagaagcaggatctggagctagccttcctgttcttctttcttcctgtcttgtttcatgctctgtgattacaaatgagtgactcaacacgtctgggtctgattttctcatctgagaaatggatcaccataagggaagaattagtcaattgtatttaaacagtttagtgtttagggtttagtgctagagcaaaggcactcagtgcatgctaattggtggtacagttttttttttctctcccatttttttaaacaattatcttatttatttgtttgtttatttgtttgtttattattgtgtgtacttgtggtgtgtgtgtatgtgtgtgtgtgtgtgtatccacttgcacgctcacttataaaactgaggcagtttgcagaagatcttttctttccgtcttgtggagacctgagatagaactcaggctgcagctttggcaggaagcacctttgctggctgagccttctcactggccccaaagacggcttttctgagttagggtgcattcagatgaggaagtgttttctctcagcaacaaatgacctgcaggacttggcaactgtccagctgttacagctttggggaacttgaagcaatgtctgtggggtagaattagtttcaaaagcttgtgatgatagcccagactgccatctactaacagcatggacgagcctttttattctctttggctatataactatttctctagatgctcaacacaagcccacacctctgtattccctatcctccatgtcaggaaaggacaccccagaagaacctaacagatagccaggccaagtaaacactcaccggaaggaaatggggaactctggaccggaaaagacgtttcacacatttgtaagctcaagtcttctaggtattcagtgacttactgccaaacaaatcttcatttctgcatgcagctacccagtgtagtcaccttgacagacagtgactcctccatgtgtgcctgctgtagtcagtgccaaacatgtacacaaatgtgtcttcagttggtttgttacttttttgtccagggttcctcagaagaattttgtcaacacattaggtctcttcctctgtgatcgactattctcttttccttctctctctctcaaagagagttcagctgtcttctctcacctcctgcccctaggacccctagtcttcccagctaccttctatatagacttcctaaaacaagcagttcggattgctgcttctgtttcctgctgcctgctgtgggtagctgctctcagttcattttacctgaaatcaggcatgccctcccttctcctatcacccatctgtccagttggacacatattaacttaaaaaatatctcatagaaaagaagaagtgatgttttcacaaattagacccagatcctgttctcaagtttacacaacaaagactgcacagacagggacttatttaatttcagtttctcaatgtagatgccacccttagggacaaaatagctgcaaagcaattagctacaggttactggttaagtaaagggtaccacgcagccctgccaagttgacacctcaagccggttttattgtgggcaacaactgcccaccaaagcacataacctgtctcaaagagtagcccagcttgaatgatgcctacttgttagaggtaagatgtttaaagtcaaggaaaatgaaagtctccatgcaccagacatcttgcttcaatttcaagttcacggcattgttctagaaatcagacagggggtgtgtgcgcagggccagaagtgcaaagctttgtctttgcatgcccctggacagtatgtacattaactgtagtgtcacaaaaatgttactgttctcaccaaccactcttcttgcacagccaatcaaaagagaaacctgtgggtttcaactttacaaaaacccacttcctagatctcagaaccaattactgaaagactcaattgagattcattatctttaaaaagttaatttgccttgaatgtcttgagggagattagtgtgcctggaaggtcctctttatgtgcattgctgagatcagcaaggtagggttcaaaaggtctataccttctcttcagaattcagaaaattgaattccagtctgactcacaaagtgatctttcagacttcttctttttcaaatctgaacaaacattattctcagcatatgtcccctgagccttgtgtttctgtcactcagaatgctcctgacactgtgaagaacccactaacaccagacatcgctcctatcctcgtaccagactgtgttgacaacggttcccagcttgagttttctgaggtggacaactcatcgcagggcagtatgtgcctttcagaccagtgtcaagataacatcagccagagcattcacataagacagcacagactatcacataccctccctctcttcctcacctcacttgtctttctatcttcttttttttttttttttttttttttgtcttgtaatgtagtccaggctatcccagaactcctgtcccttccatctctgcagtactgagactacaggcataggccccatcgcactcccaggtatcttttggtgaagagctgcatcagcatgttactgaagaaacacaactgagggcgctatctgtggcttaatgagtcagcagctcaccatgtttctttgcccccaggtcttgccttttcttcaggtcttaagcgacttgttttgctcaagtcctgaaaacatttacttccacgtcatcttccgctacaggagccatgcttcttccgttccctttctgggtgccttggggggggtcacgttccctttctgggtgctttggggggtcactctttgctctgctcctcaggattttggatagactctttcgtgcaaacagaaaagctcccccaaattatggttatttacttcaacaaaatggttccggaaaatccacttaaattcttttctactctcaacgtgggtcgtttctttctaaaagatctggcatggaacacaagccataggcagatatgtgtcaacaggctgtcatagcatatactaagtaaggtatttgctactaggaattatgtcttgttaacttcaaaaatcacaacaaggttaagatgtgatcctttttttttttgttatttttgtttttgctttatctcttttttttattattacgtattttcctcaattacatttccaatactatcccaaaagtcccccatacctcccccactcccctacccacccattcccactttttggccctggcgttcccctgtactggggcatataaagcttgcgtgtccaatgggcctctctttccagtgatggtctactaggccatcttttgatacttatgcagctagagtcaagagctctggggtactggttaattcataatgttgttgcacctacagggttgcagatctctttagctccttggatactttctctagctcctccattgggggccctgtgatccatccaatagctgactgtgagcatccacttatgtgtttgctaggccccggcctagtctcacaagagacagctatatcagggtcctttcagcaaaatcttgctagtgtatgcaatggtgtcatcatttggaggctaattatgggatggatccctggatatggcagtctctagatggtccatccttttgtctcagctccaaactttgtctctgtaactccttccatgggtgattgtttccaattctaagaaggggcaaagtgtccacactttggtcttcattcttcttcagtttcatgtgttttacaaattgtctcttatatcttgggtatactaagtttctgggctaatatccacttatcagtgagtacatatcatttgagttcttttgtgattgtgttacctcactcaggatgatgccctccaggtccaaccatttgcccatttttataatccataaaactacacctcagcaaagaagaatagcaagaagacattcaggtaggaagtaggtgacatagctaagacctgaagcctagcttttagctccaatccctacatacttggtactaatctcctcctggtgagaggtcatgtgcccactggcacctgtcatgaggtgaaagctcccttgtaatcaaatttacatctgttgcacaatcctggctttctccgaacaccactcatcagcatctgaactgcatccatctgcttttacatccagagtctagaaatcaagaaaatgcagaggcggtatcttttgttgtattctctccttttagaggagatactgagccaatgattaatgactgtctcctcccctgcccctctctctcccctctcactctctcctccttgaatctcagtctttaactcattaacgactgaggattcggggaaggctatgacatcaggaaaagagggcgggaccaagttttcagagcactgcagattgcgactcactgcttatgaggtacccctgatgtctgacatcagaaggagagacttagatttcagatctgcagtgaaaccagggtgtgccttgcaggcacacagggaggtacccatccagttctagacaggctctggaaagtcccattttgaataatttgctctgtcaacttccctagctcagatgaaactagctttaatgaaagagcactgggctggaactctggaaattgacatcttggtgccgataccagccaggtgtgtgactcgaggtaaactccgtagcctcccaaacttagtcattttttcatttgggactactttgaatctttgacgctagaatcaacttttacaaagccttccaactgataaaatggcccctgactcagaaacagtggtgtgtgggtgtcaggatggataattctttgtcagacaagaacaactcaggggttagtaactggggcttttagagttcaagcccaagatgtattctctactcccaagccttggttctcttccatgtcctcccaccctaacattctgtcacactaattttccacaacgcgttagctttttagtattctcccagtcccaagtgtagccaacacaattaaatagtggatgacatcatgcactcccatgtgctggggaaacagcagtgcgaagtctgcactctcaaggagcttgagattctcaagccagtcagtctccactgagatccctgctctctaaagtcgagtgttaccccttacaccctccccaaacctgggtctccgcatcttcatttcacctttaaatccttcctctctgtattgttaacagaactgaacgagttatttcacctagaccaatttaaatagtgccagtcatagaactgtgaccgagtcgtatttattattgttatgactgtatgtgtttatcagcctccatgtgcctggggtcttggaaggttgaatccgaaccttgatcattagcacttaacgagtagttttaaaataattattcagcaggtattcctctccctcctccacttcttcctcttcctcttcttgttccttcctcttctcttcatggctcttgtgcagaaaaagatgcagaaaaaggtaaggaggaataggaagagaaacagtccacatgatctctcttgaaggagaatcctcaggatttgagtaggaagatgagaaagtgtcccacttttttgcaaattgttttgaatttcactgcatatattctttgtacatgatattatgttaaattagggcattttcatataagcaaaatggttgaacatactaccccctctcctttttaccccattcccatcccactgcccctctgcccctctagatgactttacttctagtttccaatcacatctcatgcatgactgacatgagacacatacaatcgaggagccataggtgaggatgaaatgcatgtttgtctttctgagacaagcataagtaacctaagctgattatctccaggttcgtctgtgtttctgcaaagggcatagcttcacttttcctccgggtgcatattacctaagtaggtgcatagacacctaattttccttctcgctcctttgtcactggtcacctaggctggttccgtagcttagttgttgtgtgtcatgcaacagcaaacattaaggtgcttgtgtctctgtgatatgttgcttgaagtccttgtagataactatccacgatggtgtagctaggtcataagacaggtctggtcttacgattttgaaggccctctccacttatctcactagtgtgtgggtcagcttacccttccactagcagtgtataaacgaagcctccccctgccccacccacatcctccacggcgttgttatttgtattctttatgtctgtcattctaaggtgagatgtaacctcaatgtcattttcatgtgcatctttctaatggttactaaggctgaacctttcttcatatttttaaaggtcatttgtgttttcactttttgagacttgtctagtttgcaagcccatttcattggtcaggttgtttgatttcttttaggtaattttttagttccctatataggcaaggtctctcatcctggagtctgtctcgtcaaccaattaactttttccatttcctttgctattcagaagcgctttaattttatgaggtgcagtttgtcaattgttggccgtattgtctgagtgactggaatcctgtttagaaagctcttaactatgacaatatcttgacatgtattctctactttttcctctaacaatttcagatcttatagtaacattttattattatattgtatcatatattatgttaaatatattatatgtatctataagctcttatatgaacaaagtcacttggagttgactttgacttagagaaagaagtccaggcttgctcttctacatacgaataccccattttgacaaatcctttcgctgaagagcctctcttttctccagtgtatacctccaacctctttgccataactcatgtgaatgtggttgtgtgggtttacctcgaaaccttccacttgagctccttgatctagactcctggttctgagtcagtgccatgctgggtttattagtatagctctatagtagaagtgacattcaggaatggtgacacttcccccgttgtttcttttgcttaaaattgctttgaatagtctcagtcttgtgtgcttccatgttagttgtaggatcgtattttctgtgtggttgtatttttgcatgggaagaatcctgttgggattttaatgagtattacactgaacctgctcatttctttcggttgaatgaacattttcacaacactaattcttctaatccatgagcagggcaggattattccttcttatactctcttcttcaattacctttttcaatattttaatgttttcattgttcacgtgagtcacatggttggttaggcttgttaaaagggtgggtgggatggttcgttggtttaggaaattgtgaatgggactgctttccagatttctttcttgacatgctgattgttggtatacaagaaggttactgatttttgcatgctaattctgtatcctgctatttttgaaagtgtttatcagaacaaaggtttttctgatgagtattcagatttttttttatagactgatagcatcaaatggggttatttgacctgctcgtttcctattcacgtctcttctatttgagaacagggaggctttcacccaggtggctgagcctcttgtagaactctgagtatcacctggttttgatgcttctgtgtcagagaaagagattctttctgtttctccttcactcagcatcttgtttagtaactcaaacgcccttagtgagtattcactgcagcatgaatcaagcattgtgttgcttaatccaggtacacgataagtaagatacaatgtctaccatggtggagctcacagtctggggagcacacataaactgttatgtaatgaaatgtgcaaagaatttgccacaaacacgagtgaaggcccgtgggagcccagatgttgctgtaagtcacattcttgtctaggatgaagaatgctctgtaccaagctgaactagagaatttgtaaatagagctttattgaatttaaaaaatgagtatttccattgctgggccatatatttctatagctgaatttttcagtcatttcaacccaagccagaatactcactcacctgtcatgaacaacaggattagaagaacattacagggttttttttgtttgtttgtttgcttgtttatttattttttttaaccaggggtcttagaagaagaaaggtagaggagatgtactctgctattaggataatgaaggtaccagagatataaaatgagctgtaccttacacaatgggtaagagtttacaaagtgaaattttaaaaagcaaatcatgcaaaactacacaaacatttagaagctaccagagtaagggatgttattggactagaagacatctcgaaggcaggaaagggaaagccatgcaagactggtgtggtgggagatagggcagcaaggatggatgggaaaacaccagagggctttatacacctactacaaaagctggggtttttctttgtgtgcagtgagccgcttccatttgtttagaaggcaattgtgccattggaactgtgcattcttggggtagttaacacaatgtggactaccatggctaggaacagaaccagatagaacagaagacatggcaaagttgggtcctcattcaccattcaactacccgtgtgatctgcagcaagttcctaacaatttctgagccttatccttcttgtttcttgcaagcaaggtgaaacctaaaagtaattgcagaagaaaccacaagttttgattgttgcctcttggttatcacaatgtgagttcattaatgtgcaatgcttaagcctcaaaaacaacactaggcatcctgaaaagttaagtatacatacctgggagtgtggcagggatgatgtaatgcttacctagcatacatgaagtgcctgggttcaatccccaccactacatggtgacgcatgcctgtaattccaacccacagggagtagaggtaggtctctgtctctgtctctgtctctgtctctctgtctctctgtctctctgtctctctctctctgtctctctctctctctcacacacacacacacacacacatacccacacacaaacacatgccacacttttaggtcacatggctcaccaatcctacactgaaatagccatatgagagaatttaagggatgatatgtctacaaaaagtcttgaacacaaatattagcaccactattttttaatttcatttttactagatattttcttcatttacatttcaaatactatcctgaaagtcccctatgccccccccccacccagctcccaacccacccactcctgcttcctggccctggcattcccctgtactggggcatatgatcttcgcaagatcaagggcctctcctcccattgatggccgactaggccatcctctgctacatatgcaactagagacacagttctagggggtactggcaccactacattttaagaaactcaaatcacaatctgtcaatctggtggtcaggaactgtacaaaaggtcttatagtcaaacaatgccacatcctttagcagtaaaaaaaaagccgagaaatgtgtgctagagacaacatggaggattctaaaataatgcagtattaaaagaaaataaaataggtcagctctggggtgtatgtactctgtggctgtccttatttgaaatactctgaaaggcaaagctacgaaaacaaactacaacttgcctggaactagagtgtaatatacacttattacacatgaattaatgtatatgggagataatattaaggctagaatgtatcatcttaataaaactgattaaaaaaaacacccccactgaattatatatctggaaaggtgccattattaatgcataaactctgcctcaatgttactgtttaagacaccaaaagcagatgtgggaaacaagtgctactccactttcgatttatagatgaacaaattgatttcacagacattttcactgtaaagaaaagagaggtaggactcaaactcctcctgcatattcccgagcccacacctctgttcatactgcatcctcctataagactataggattatgaaaattaatgtacgtatagggtgcttatggggccaaggaaccatgggatgcggggagcaggccaggagtaagagtggggtccaggcgtgcccatcccaggacatttatcctgagatcagcaggagtaggattggtatccccatcccaaccccaggcaagcatgtcctggtgctcattgccttgtgcccacacagagcaccccagcaccctggccctggccaatgatgtccactcaccctaaaagtccctacctattcccaaaggtttgaatagcttttgtccccaccattaaatgagctgtctcactgaagctgcccctcttgagcatcacaccacagctgggcgacttctcccagcttcccctcccaggacccacaggttgtgatcccaggcaaatcacacctctcattatcagtggggaagcagagcctgaatgacaggtgcctatttattttatgtgagatgaagataaactgtcgttaggtatcaaaagctcacagttcattcagagttccgtagcagttggctaaatggagtggaaggacctgaaagaaaatgacatacatggctatgcagaggtccaggctagaagagaaccctccgcagatgaggagaagtagaagatgaaagcaagaagggccaacttttttgctgccttttcattacttggaagaaacctggagttccgttaacagaagacaaagagcaggagtctttttgccttcagcaaacagctgacactccttcccatcataaactttgtaattcaggatgtaaaaccaaatccaacaaaccagccccgccagcaggttaaataaataaatgttaaataaataagggcggtttggcttcccttggccacaagcccctgcagaagacgccacgtgcttctggtaactgaagtctattagtcagtgtttcttcctgtgtaaatatgggggaagggcccatgtggggtcatagctgaagttgtaagaaatcataactttctgtatgttttgcttcgtattttcccatcacggtgcatgttgtaattaatagttatgaatcacaggtaagggaacacagctagcatttcatccttaattatgaaatgtagttcaaattcagaaggaagaaacatagcctgtggccttggcagatgccagcccaggtgagttaatgggtttttcctgtattgcctcctatgactgatacagtgtggccctgatgagcatgccatattgtgagactttattattaataatgcacgtcccaagacaaatatatagcctggtaaacagtgatgtttgccttatgtatgactgaatttgatttgcaacatttccccacaccaagaattggtgctttccactgcatttggtgaaaaaaaaaaatgaggatttgcatcataaacatgaggcaagctgagatcacactcaggactccttgtcctagaaagtttggtaacaagaaaatgagactcggagttccttacgaaggataatattacgtctggaaatgcatgggacttagcccacctggtaaagagaattctggttttgatgacatttagtccttgagtcactgtccccaaagagacaggaaaagctattgtgtgacttccatggtaactgaatgttcaagtttcaagtagctcccagaaatccccaccatagccaacctaatactgccagctttgtttgctgctaagaactcaccagtcacaagtccttcaaaggtcccttcttggatactgaccacgtgtgacaggaccccaagcattgtgagcaataccaaattagtctcagtcctcagagagattacagttaacacatgtggggatgatactatatgtgacacatttatctttaaatggcaataaaagtaaagggtggtttccctccccagggaagcattttagagttgtcccacttcctcccatggcatgctgaattcacatcaacagtttgatggaagtcagagaagtgataatagagaggccatgagttttcatgtcagggtcccccatcatcatgtattatctggatcataaaatccctgaggatgatgtctgcctaaacactgcatatctttgaggccagtgcaatgtctagtgttgaataagcatgctataaatatttatgaacacataaattaacagcataaccctagcagagctagcctccgagcctacattccttctccgggaacagcagtagtcaattcttcttcttgggagttgaaagaccacttccagcactggctgaggatgagcgggatcgctttcttgcatgtgtgcctaagttctggctcatcagtttattaactctgtcttttcatcaactgactcatttcttcctcagtttcccaaactataaaatgatgataattatactccctaactcttaggtttgttaagaggattaaattaatatagttcttaggtgggtacatagtatgttctatgaacatacttgttaaatagagattaaaaagaatattggttttccagaaaaataaatgcatattaatgttagaacaggcctaacatacccacggatataaagtgtgaacatgtgtcaaagatgttctctgctcacaccctttacttaacacgtcctggcccgaataagtacacaatgtgatactgaatcgggtgctatcaggtctctgaggagcaagggcactttgcgagctaggaatgcagagagggattcatgaagaacaaagtgaacctggtctagggataagatagcaaggacaagcagtttgtggaggagacatctacacaagctgatgggagcaagaatcagatcatgagacactgtcatccctagaactggggccttgtttcttggagaggaatttgtcatggtccagaatgaaggaggaacaatgtccagagccttgaggatgatgcaggggagaaaacaggcagtgtgttggaatggaataaactctctggtagagaagttgatggcagaagggaccaggcacatccatgggctctttaggccaccataagtacgttggagtatattaaagccaactaggacctaacagggagaaaattgaaacaacagaagaaaaggttacaaattctgttaaagttctctcatactttaatgggtatattaaattgtattgggggggtgttgaaaaagtaagagaaacattgaaacaatgggtcttccaggcagagttgagagttcatttgagatcttaaataaggaagatgaggtgaattcaagcccaaatacaagtgatttgctatgcactcagcaaatcacccttcattgaactgatgcaattgatgccgttggaaggtgtgggttgatttcaattccaggagtaatgatggggtccactaccattcttgcccttagtatatgctcacagatctgcttagccacagagaaccttctacatttgcatacccccatgacccccactaccccccaacgccccactcctacctaccactcagcaggggaaaactgtaacatccatgaaagaaatatgcagagtcagctacagaaccatccagagggtattagcaatggactggctgcttttgagtttcatacttacatgaggtctaagctagacactatctggtcaaccttgcaggccttctctcaggggcaaggtcctttctcgatctagcatttactaccttcgttctgcaatgccaagatatcatgggtatggaaggatgcaaaatctctccttagtacggaatgctttcttctgacagtggtgatgtctataacatttcatgaacatgtgcttttgtgagtgactaagctgagtttttcctgaacagcatcttcatgtactttcaaacaaccagtgagcttagtttccttggcatctcttcttcatagataaaaaggctgaactttagagaggttgagtactttttttctacagatagaaagctgtccaagtgtaaaaggagagagtagaagccagtctctgggattcaagctctttcagcaagaagcatttttgtcagcttgagctgttccacatttcttctagttatcatattgtcactatcctatgaaacttacttagagagactatgatgttcatttccagctatattaaaactgggttctattttcccatgttcttaaaataagggattaattcattggaggtggttggagaattaatggattttattcatatttccttcttttgagagcctggtgaagtgaaaatcttgtggtttgttggttttatgcaagcatggtgacctgtgttgggaaaatttccccctcaagtcaaatgtgctgacacacgtgacagcccacgccgagcaacatgtgctctggggacaagccacggcctgatcttttcccaccatgtaatttcaaattgaaatctgacctttacaacacattcctgatattgaggtcaattggaatattcagatgtgctatctaggcatcttattcatctaggttacctgtggctatcctgatgataagtctttggcaacaagacacacttacgtggttgtggcctgtgagttagggtgtctgtaaatgaaggctcatatggaagatctccatttccacacatactcagaggcaaatggtccacactgggattaagaataagatttgagtttcttctatgcaaggattggagaatctgcgttttaaaataacaccattggattcttgtgtaaactagtatttaaaaaccactgcataaatgtctttcaatcatggaattccttccctgtcctgtccatgtgaagatagtgacaactgttactgagtgggcgaagatcaaaaggtaaagtattccaggactgactctgatcactaggaccagactaatttaaaaccttgtctcatgtaccatgcacccttttctcagttttgagggtcctggttgctcagaaattcatctcaccttgttcttcctctcttctgtagacatgataataccttaaaccatctaaagtactctgactctgccactggaaaaggaacataaacatttctcctgcctttctgtcccataataactttgatgaagctggagtatgttccaaaggactgtaggtactgatgtttgcagaaggccatccccaccccaccccctactgaggataatcggaaaacaaacccagatagagaattctggtcacccagctgcccagacctgccacaacaacctatctgagggatgccgatgacgtggtaatttggtctgtggcatttggcttagtggtttctgttgtgacataaaatgattcaggtcttcacatctacacaccagagcttcacaaaattaccttctggagtccttgaggtcagatgaggaagcagggaaaagcacactcgaaacaaatcccctgtgttttcactctgcctgctgagacagacatgcagcagcagcctgctctgtaactcttggaaggtcatctaaaaggacagaaagacaagcagaggtctgaagtctccctgaggacccccttcctgctgcaaacactagccatacaactagctcactgggatctttcttaccttaacttcttttctcattcttttccttcatggtcattttaaagatctttggattttatatttgctgagcactattatgcattttatatacgatatcaggttgatggagaatatcttgggcccaaaccattcaccatctctggccttcaggcctgggccattggggatttaaatcaccacagtaattctcaaattctataagaaatttaataaaaaccatggtgcttctttttttttaattgaaacatgaaagaaaacaaacaaattagaatttgacaaaatcctcttggtacaaaaaatctcaaccaagaagccatctaattctcctgtgtggccaggtgtgctatttctagtcaactacttaaaaattctgaactatcctttcaaattttctatcaacttcaaaaattgtgtggttcagtgccagctccacccaagcgagtcaatgcttacgccttacagaagagaggtaaactgatttaaaaaaaaaaaaaagaagaagaagggtagatcagtaggatttgggaaacaggcatttctagagtcaacttctgatgtttattcctagacgaatgtgcgggcagatctactagataccaccttcttggtaactctcctgacagtggccaccaaacctaatttgtttaggcccaaggtgaattttgtatttgtttttatcagtttcctccatcctcatagaccatattagccagagttcaaggccagcctggtctacaaagtgagttccaggacagcctgggctatatagagaaaccccgtctcaagcctccccccccccccccccaaaaaaagtattcattaaaacacttctgtcaattttctcttcaacattcatactttgaaaatacatatgtaaaaataaatcttaagttctttcttttcaaagccatattttatgtataggttctttgtgtttggattatatttttataaactgaggataatcagacagatgaagaggaaagaaaaaaaacaaaacaaaacaaaatgaaacacacagtaaaggaaaaatcaaagagcagagaacctggcaagagactggggagaaaataaggaataagtccaaaaggaatttctaggggaagccccgtgaaagaacagaggacaaaggtgcagtgcagggcgcgctcagtgactcaggccttggctctgctcctgggtgactcacttgctggaaaacatcactgagtccgagaactctttacaggtctcaaactttcttggaatcatttgcaacttcattttgtgtgcatattttcttctcagttctttaaagtggaaatacctgtgacttatccaaaatatttgtcccctgaagctagattttatctctatcttttagacacttactagttaaaattaaatggtgggctttagaatatagaaaaatgtttgagaaaataggattggttccttcccagaagcctgcctgtcttctgaagaattagatggacggtggctccccaccccccagccccccgtaggtgctgcccaagttcatactgagtgtggagtagatgagtgattttcttttgtctctttctttaatcatgatctacaataagaaatactcttcacattgtgactcagtccccatatgtccatgtgttctgtgaaacaatgcttggctttggtatacatgtccatctggtatttctattttgttctcttccattatcccctgggttgttttaaatagcttgagatctgacagctcactactggaccttagtatacttcccggtatctgtcctgtcctcccaagtctcttccaaaaagacatactgataaagcacggtatagccaattttgagaaacatttctcttacactctctcctttctgataaaatgcttgcaattcctcaaacaccaaggggtctttcactttcctgcatgtcattttctctgcccagagcacgtcagtttgtttccaccccacttcctctttctttcctaattctagctgcttaagattctgctcagaagccaacatcccttcctctggggccctgtgagtggagcactctctttggcctcatggacttacctctgctttattatgctatgatacaaatgagaaaaaaagattctcatgtttttcttgcctgctagatttcttgaaggcaaatctatgttgtgttttgtgtcagtatgaactgtctaatgcttaatacgtgtctgattagcagacttgggataaaaaagactgttcagttactgagcatttggtatgcaataggcgcagtccttggtccactgcagtccatttcgcacaaacaacagagcatgcttccattcagaatgactgcagtgaagttggcatgctggccttcattagaatccgttgttgctatggctagcaggaggtagtgcagccaagtagttaagtactcagactttgaaatatacataattggattagaatactgttttatcagttgctaattctgtgaccttaggcaagacactgtataaaaccccaggttccccattgggataaccaccttcccttgctcttttcaggactatatgaatattgttaaatgaccatgtgtattccagaaagacaagattccttgtggttttgatttatttccataaaagaagagcagctggcacatacagaagcgagacttcccaatgcatggtaactcttgaaactagcacaccagacgcaggtagaagcacttgcctccctcaagggagctatttgatcagttggactttcaggattaaattctgtcatttcagatggactctacttttcatatatccattggcacatctttgtgtgctatgtattaaacagataaaatgtttgagttaacatcttagagaaaaattactggatttaatggtgtttctaaatcttatgtaagatccattgttacctagcatctttgatactttccccgattttgttagtggatgtttgtattccagggtttcactctgggaccttcccatttccagcagttgtttggtttcagataacccagggctcactaaaaaaggtattgttgggagctttttcagttttgccagcttacacacatctctccatattattttcctacctgagctgaaaaggaatctgcattcaatttgtactttatgaacttcactggtaaatttggggccatattctgtaggcatcaaggctgaggtgaaatctgagataccatccctaggttctgctcagaatgggtcatctgcagactgacagactgcctccacagtctatgaagtagaaggcactgggatcctgggagatactgagatactgctgaggaaatttttaaaaagcagtaaggatatttgtttgccaagtgaaaaataaaactcagcccaatgtatcttggcaacacttgctacacgacataaactcagacagagaggacaatgactttctctctattgttcttccttctttggcctcctatcacctcaggagatgttcaagggggctagttcattctcaagattgacaagctaaccctataagaaatagagtgggcagcaagagttggtgggtcccttgagttaattattcatttttctgtagaatttcattctcatttcccccacgttttcctgaaagagacactgcccaccaaagtgagaatgctgactccatgctggggatgtgcttagcaggcagcatgcattcctgcaggtagcagacccgaatcccttcttgcttgcccaccagggaactgaaagggaaagagaagttgggaaggaaaagagagtgtgacaccatctctcttctcagaaaaggtctaatgagaccttcgaccagcttctcgtgttacctgctagggagagagatttagggtggctgccttggtgatcacataactaaagatagagtctgggctggattccccagactgctggttcaaaatgcttctctgacctagccactctcttatttatgcatccagttagcattgattggtaataacagtgcaagtacttgtgatttcaaagatgaattaggtgaattattcatatccaaggtctgtatgctgcccatcggctgcttaggatctcccagaggttctgagttgccttaagtttttgagtccacatcaacaaaggctttctaccctggctgggttagagagccactaatggctaagcagagtctatttccagaagccacatgtacatctcacagatgatctaccttctatttcttttaacacttctgctggaggtcttgttaatgaatactaatcatcaatgattattgatctgaataccaggctattaactgtcaaggggcttcattttctccatgtttaaaaaaagagaaagagaagagcaatgaaatcatgtgtgtgtgcacatgtatatacatgaggtttggctgtctgagatacccaaggaaaagcacatatatgcacatccgtagactacagtaaaagctacagatatatccagacttcacacagctatgacgttcacaagactacccatacgagataggcatatgtttagtaatttaagacacacttttttgagtgtgttaagaaccccactcttttgatgtatcccattcctgtaggaggttaaggccatggtcaactgagtcacaggttataatcttccagccacttatacacttttgcttttgtcgttcctgttctatttgatcccaaggtttacaaagatgagtgatattgtttctctgctctagaggaagaggctgaggcccagagagggttagactcttgttaagaccctcagtacagtgagcaatgggtcaacttagagtgtattcctagtcctttagccaggaggagaacagtgttgtttgtttgtttgtaactttttcttgattctttgtgaatttcccatcatgtacctcaatctcactaatctttctgtccctttgtatttgccctctgcccttgcaaccttccctttaaagaaaaaaaaaatctctggaagctgcagtgtataacaacagtataggtttttttgcacaaacaactttatttacaaacgtttatggcaatgagtcattggtctggtttgaggcctctggctttgctacaccatcagtactggatcctcactgggactcttttttggatatcctgttgttgccctgtgtctcagacatcctacagctttggatctgcagatatggtcccttccctccagccattcttagatggggtgggtgttggggtgggccaactcagagccctgaatctgggatcagcccaccagctttcttgtgcctgagtcactgtgaccaactttcctgcttagccctggcaaggggtggggccagctgtctggctctcacaccctcaggtccagcacacctacctgcttcaggtggctggttgtgggacctttcccctgtgtgccaccacaaggcatatgaggggcagggtcatctttcctgagtgctattggtctctggtttttattttaattaagtaaaagaaaaaaaaagtgcctgaccttaatttttttttagaaatgttagaaatagaagatggtttctcctttttttccttttctttcttgctctcttcattcctaaacttccttttttaatttcctcccttattttcttcctgcctttatttcccttttcctcttttccttttctctttccttgtttcttcttttctttcttcctttcttctttctatggctctagggaatcaactttgagcctctgcacactaggcaaaccattgagctgcctcctcagcctaagagaaacacattttcttgcaaccacataaatttggtataatatagcaataacaatggcatgaaagcacttcatgtcataattaagccataaatctgccctctagcttttcttccttgtgctatgattcaactcttttccaaaatggaaggtttgagagttccacccatttgagttacatggatccttttcctgcatgattgctgctggccttctgttgttaggtgatgagtttgtgtttggaatgatgtgtggaacatggtcactggacttttataatgagacaaacttccaaggcttggagcttactgctcagcctacccattgccaagacagcagacactatcccataatccagagttttgcatttcccaattgcagtatggtaggaggagtgaggttaatggctttcaagttgcagtacacagcccacattggtttctggaaggcttgagaaagactgaaagctgaaccattggatatagacacaggagatgttggaagtacatggcaaatccacaacgagcatgactccctagctgggccagctcataagactctccctgcacctgtttccccatttgccaaataaaacacaaccaataagagatttcccagtttgataagtttccccactggtcaacttactgttatctgttggagagacaccatgcatgggttgtactatgtggtctaggagaatctcaaaactggtcttacagctcctgatcatctttggatttactgtcagcagatgctattaaaattagcttgcattagctgactaaatctggacaggcaacaggcatcggggaatggaaacagggagtgccctgggtggtggccggaattagaaaaataatcccttgtatttaggaggctgcagagcactttcccacacattgtttcactgagcccctacaaagccctgctgggggtattcttagcatcatctgacacatgagaaatgtgatgtttcaaaaggtgaagggactggccagggtttggcaatatagaaagcagagtaaaagccaaaggtcttgcttccttgtgcaacacaccagaggctcattagaatctttggtaatacctggctcttcagaattagcagagcctctgcagcttagttcctcctgggccttcatacctgctcttcttgtggctcccatcctccagcttcattaaccttgtaactcctcagtgtctcacttggcaatcacttccacccccaaaagagctggggctttattagagacatcatcctatgggcttccatgatacccaaagatcatcccctgttgttgccagttcaattcagttgtccttgttggaaatgaccctacgtaggcaccaagactgtttattaataagtcaatctccagttgttgatgttttacctgtgcaactccaataccaaccatagtgggatatggataatttggttttaagtacatgcttttaattaactgtagccaagggagcattttccattcatatcacccttaagtgtaggagatgattgaaagttcccctcacgccactcccagctttattaaagtgtaatgaacaaaatgaaaactgtatgtattttgatatacattatatatataattgccacatgcttcatagtcttacctatattgtatggttagaacatttgtgatctctcagtaattttgaagtttacgacacattgttattaattatagtcacgatgctgtacaatagacctccagagagtgcacctcaatctatcgaaatgttatactgtttaaccaaacttctaaaacatgaccatatccagatgggggctggctgaacaccaaatgcaagtcctttgcctaagatatgagacagttcccagaagtaggtcttaaagttgcaagaatggaggtttctgtttgggtaaccacatggggaaaggtagaaacagatatttttggagtccctggagaacatagctgtgacccaaggtctactcatgtgtctgggactattgctgggaatcagacttcacatcaaacccctgcctgtccgatatcactttcaggaaggcgtttggacttgctaatgtggttatttataactgctttcccacttggaaccagttgaagggcctacagcaccacctgtgtatgttatgtgaatcatgtactagctacagtaaatattgtatatgagaggcaagactaagactcagaaatcatgtggaaatgatgtccttcattgaatctcatatttaaacatgaaaactccttgtaagtggttaagagttaagaagtacaaggtcatcattataatatgtattagctcaactcatgaaatgacttagtccaatacgtcagcaaagtcattctatgacacagaatcttgagaaacacagacgtcttggccaggaacactcactataaagatggtatcaacttttagaaaaaaaacaaacaaacaaactttcagctacagtatgtacctccacaaatgatccaagactgagtgccaatgggcctttgataaaagtcacagactgtgtctgatataccatttctgaaccctggtataagcaattgcttctaattctcatatttactattctatttccttgcaaaagtcttccctgtactctccattctcccagtagctgagtatgtgtctggtctgatgagaacagtgctcacactccctgcaacactatgctctttttcctcagttcacattcctctcacatctctctatatagatgatgtcttttcttcacgatttctcccatcaggtcccatccaccctctatgcaaggtggggggcgggggtcatgacagctctgaggagcatttgactctaagcagcatttgcctcctctactaacatctccatacccagtaagaggtgagagaggaggtgacatacagtttgacagttctccccagcttatccagacacttcagttcctatcctcttccaaccattcctttagaacattaatataattccacttatgcctagaaatctctttgtctatagtagttcacattcagttttctttctttgaacatcagtttgcaatggtcacaacatttatttatagcactgaccatatttgttgattaattaaggtttgcctggacagggcattgttcgggttgcagagggcgatacagctgtgagtttgatacagtcctttctggagatggaagagatacaaaaaaaatatgcccaatagaataaagtactttcagatggtccaaatacaattggaggaacctgtcttgtgctacagaacagagacttggaggcaaagagtggatgagggcaccaccatctcctccctcattccctgaaatgtggttaaacacagcatcatacatatgaagactagagatgattattaatagccctctttatccaagtatccaaataaaatacagcatgcctaaatttgagtttcagatgaatagaggtattttggtataaacggacacaacagactataatgctaacattaaaattaaatatcacattgtttatctacaacttaaatgcaattggcatcctggaactttttgtttgcttgcttgtttttgatgaactataacgactgtacattttagaagaaagtgacccagagtgtgatgggccataatgtcactagactctgtagagtttctctggaacaaaaacctgaaagcagaagccactgggcttggcttgatgaggtgtgtcagttgtcacagatgtttcccagcattcttgctggataatgtacttaattggccatttttaaggacacgctttatttatttgtcattattgtgtagatgcatgtgagacatacctgcaaaagtgtgggcacgtacatgccttggtatgcacttggagatcaaggaacacaattccatagtcagttttctccactgtgggatcctgggatagaactcataatcaaggtcacatggccagcaattatacccactaggcatgccaacggctttttaaaacctcatgtaagtgcaatgctttgcttttaacccattcctgtgttccccttcaatggtagtcttctactgacactctactaagtacaaaggtggcatagcttctgccctcaagctaaggagagtaagtttaaatcagcctatagcatgatgaagggtcacagccaaagtgaaaaatgttcttgtttttgcagtggagagaaatgatgtctagtcatggaaatgaaggaaacattgaactaacatccaaccacagcccttgagtacctgcaagatgtccataaggattctcagagaacattgtccagggaaaactattcaaagaagtgaatataatgtcacacttaaagcatgagctgtcaataaaaatatagaagataagagaagaatgggatagattatcagcaaatgagatattgattattcctaaacactgcataatagaattttgtagccagagaatttatcacagtgatgcccagtcctttgtttcacatgaatgaaaatccagaaaataaatgcttgcttgttatcagtgagctaatgacttgggaaatcagtgtcttgttttttctgtaggaaacactttcctccaaccacatgtcttgtgattccatttttatggtaagctgaagtgcttggttggaaatatagacattttggtattttgatgacatgtaagcatcacaggtctgagacatctaagtgacaataacatcagaaaggagagtagggtagagagatacaacttatgtaagtcaaacttggagcaagtggaaaagagcaagctacaattgaatattgagaacataaagtttataaatatttacatgagaggctagaaaggaaggagaaacaacctgaaatagcttgcctggaaggtggcaatcaatggagagggataggatgtgatagaagcagggcaatagggagacttttaggttgagctggatgaaagagcacaagtgtgcttgcaggtcaaagagccaggtcaaagagaaatgggacatatgaggaagaacacacaagcaattagcaagaacaacacaaagactggaggagccagggaagtagggttgagaaaggccttcatttaggcatgaagagggaagtagaagggatttaaaggacctttgccttctccgggacatctttccttggataaagtaagaagtccaaagtgggggtggaagtttgtgaacactgtaaatgttttgataataactgttgagaaacagtggctagatgacgaaactgtgtgtcaaatcctgccgaggttaaaggagttcatctgtgagaaagtttgattggccctccagtccttaatgcttttccattatggaaagaaaaaagaatgaggggaaatggcaggggttctcaaaaattcttaaattgatgagggttctttgtagaaattttgggtacttaggacaaaatacctcataggaccttttatcttaggacataattctgcggggttcactctaaggctgctgggccccacacatttgatattgtgacatgaggtatgctcaaggatgctatttccaccacagtggatgtcaatcatagagacaggaaaatcaagaaggggcaagagtatgctactaccctaaggactcattggctgcttccattaacctggacccatctcccagtaatgccatccattgattggcctctctccagtgacaaacatcctcctgcaaaaccacaccttccaaatggcactcccaactgggaaccaagtatgcacatgtcagatactatgggggacatcgccgacacatccggagttgtgcttcactaatctaccaggcagttcttaatccaatcaagttaactatcccaattagctgtcacaaatgccctcccttcttcaacttgaatacaaaacacatacatagatttgagccctaacattaaagctttcttgtttgtttgtatgccttttagttactgttaaaaatctagtggaattcatactagataatgagctaaacagactgagtgaatgtgtagggaaggtgttgagaaaatgaagtcatactaggaccaagatgatgtttatatgaggcattcttctgacctttcaccatatcatttcatttaatattgccccagtattataggtagggacactcaaattcaaaatgaatgatgcttacttggagacactcacactgtaaatgacagaacatcctctttggaacacaatcttattttcaacagccatgaataataggaaaaattagataatgaaattgaaatttagtggaaaatttaaaaatgagagatagaatatgcttcatttaaaaactccaatggataacagcagggacaggagaaaaaaattgacatgataatagtaacaaatgcaaaagcccaaggagccagaatagtttgtcttttcccataagctttctattgaaacaacactatgacagtctggtttccattgctataataaaatacccaccactgatcagtaggtatgggaaatagccttttatattcagcttacacgtttggggatagaaagtccaagcaacttggtgccatctataacaatggttctcttgtttttttccattaaatcaaaacagatggtattatggtgggtcgacattctctcttataataaccctgtcaatagaactagctgtgatacctacaggaatgccttctgaggacagtgcccttgttgacttactttcctccttctaagcctcacccaaagacttcactttggtgacatgaactctttgggccatattcaaaccacagtcaaaatatagtaaacgtgcagagagaacctcccagaagtcacagctgtagaagtcaggagttctattatttacgtacaatcacataatctgtaacttaactgacagctggagcacggcctgcccgatagaaaccttgactggttttgtttgcttatttgcttgcttaccaaccttaccaggctaatcactagttgactgttaatgtcatagctcagttttttttgcctcttcagaacattgcaaaaattgaataatatagctttgccactcgttttagagtatggcttcttctgtcatacatttatgctctggcttatccctgttactgcacatggcaattgtgttgattaatttagtcacttccaagtagtggtcaccttctctaatagaaaaaataaagtaacccagtgaaaagcccccatccagtggggaagggtaggatggtctggggagcccccgtccagtgagagaaaaggtctgcaaccacaccttagacttagagcctcagaaactcagctctgtactctcagtaacggatactttaaagagtacaagagacagacaaaacggagggaaaaaaatcacacctgcagcagagggtggggaggtgctagaaaaagcctgtcctcttggcagaaaactggaacaagaagcatttttagaagtttgctggtgagtcagaggctcggggccacagacttcggtgaactatactagtggaaaactcagagaaactatctgctggaacaggactggcaaaatacctcaagacttcagggaaagaactgaatcaaagccacacagtgtttgggaaggtgggaatttatcagagccaaaatctgcagggcaacatggactcagagtctgagttgtgggccagacaaagcactgccttaaggtagggctggcatttgcaacatgatccctgaagaggagacgagtgacctctgaaacttggtctcacaaagcactatctaggggtgaaaacaacatttgcactggactcctgtagaactactcagagggctcatcatcacatccatggcctgacttttgaaggacagtctaccagtgaaaacagtgctcatggctaccctttgactttgtagacaacatctacaggcaacaataacttttgcaacacagacttcccaaaggtgtgaccagtagctgcaacttgattgcctaggagtgtcactgacacctggcagcccatgaaggaacgtccaaagagctaggctacattaatcaagcaagcaaggcctcctgaagactctctactctgcctactctctccttttcccccctgtagtttcttctttatttaacctagtgtcagttagcaggacaagctcagtcctgctctgctctgtcggtctctcttcttctctctcttcttctctatgtgtctctcttgctctctcttctctttcttattaaaattctattcttcccttttacaactgttaacccttttaatgggcttttccaaaaggcgtacaccagtgtatgtgggtttgtgggatcgctatgtctcagccccctgaggcctggactacgtgatggcattctctttccactctacctgaaattccctcctccccagtccctggtgtttcccacttctgtttacttttccctccctgatttttttctacccatcaatactaaccccaagtctaactctgtttcttctttcccactcataactcgtaagtagcatcttaatgtacagtgtactaccagcattcctttacaccctaaaaagattagcgtttaaggagtaactatttgttatttcattattattgtatgtttgtagaaaggcactctttgacagtgattgctaattttaaatctattgtctgtgcactcatgcattagcatgctatggactacatgtgggggtcagggaacaacttgtggaagtcagttcttgccttccctattcagtcaggatcttccttgtttctgccattctgcattcttcaggccagctgacccatgaatctttgagtgattctcctgtccccgactcccatctcagtataaagtgctatgatgatagatgcatatcaccctacctggattttcttttccttaaatgggctccacacagagtgcttttgaagacagtatgatgcactaaacttagcacaccaaacgtaagcgaagcagagaaaaatggtgtatcaatgctattacaagctaatctttcctgagaattcaaacactatcactgaaagaataagagcaaagaaaagacaacaaatagtgtgacctcgagtgcacaagtcatagcacaaaaacacaaagaacgtaaacaattaagacacgatggcgcctcaaaaaatgactaacaccacagccatatcttccaataagagtatattcgatgaaatgtcaaagaatttaaacaattattataattatatttaagaaaatcaagtaagctcccaaatgaatttcaagagaacacaataccaagcagcatacaaaggcagtgccctcagaataactgcggatttattgacagaaagtttaaaatccaggagggcttgcaatgatgtatttcaaactctgaaaggtaataattgccaactcaaactgctgttcacagcaaatgtatctgcaatcatttctagtatttttctgagcacaatggaataaaaccagaaactaagagcagcacatgcaactctgtggaggttgagcaacatactgttaaatgactaatcaagaaggaaataaaaatattcctagaaaagaattaagaaaacaagttcagccataattgctaaacacagaataggccgaagaacacacatagcaaacacatgccaacatcagaacaaaacataaagttctagaggcacatgcctggaaaaatcaaccaggatgatacaaataagttaaatggatctacaacaagcaataagattgaagccacttttaatttctcaacccaaagcccagtcccagaacgattctctgctgaatactatcaaaccttcaaaggagaactaacagaaatacttgtcaaactattccataaaatagggaagggagaaacatgcacagatagttttgagggccaggtatcaccctaataccaaaactagatagtaatataggaacacaagaaaattatagaccagacttcctagtgagcataggtataaaaattccaataaagtactcatatcataaattcaaaagcacagaaaaattcatttaccatgatcaagctagcttttattccataggaaaataaaagtaataaattatattagcaaatataaataaatggactaaaggacagaaatcatatgtcatctcaatagatgcagaaaactcttttgataaagtcaactgttctccattataaaagccccagagagactaagagtagaaggcacatatttcaacataataaaagctagatactacaaacctgtgctaacatcctatggagtggagaaaactcacagttttcccattaaatcaacagtaagacaaggatgtctgctccctttacctttattccactagtacttgaagttttatttagagctgtcaaacaagagaaagaaataaaagaattgcagagcaaaaggaaaagtcaaagcgtccttatgtgtggatgataggatgctatgcaaggagaccataaagactccacaaaaatccttagtgacaaatactttcaagaaaatgtcaggctataaaattaagaaacaaaaaaaaaatcactagactttctatagactaataacaaacgtgctgggaaagaaatcatggtaatgagcccaatcataacagcttaaaaataataaaataaaaccttcaaataaattagcctaggaaatgaaagactgttataatggggacttcaaaatgctgaagaaagagactgagaaacacactacaaaatggaaataccttcagtgcttatggagtagaaaatgaatactatagagatgaccaccttacataaaacaatggagagatgccatcttatatcaagcaatgtagagatggctaatttatattaaacagtgtagagatggtcaacttacattacacaatgtcaaagtttagtaaagtatccatcaaacaccaataccattcttcgcagaaaccattttaaattttatgtcagatatatatatatatatatatatatatatatatatatatatatacatatatatatatacacacacacacacagaattacccaaagcaatcgtgggccaagcatgcttctggaagtgtcactatacctgatttcaagttatactacataattataataaaacagcactggcacagaaacatgtagatcaatggaatagaatgatccatacaagtacataatttctgaaatagatgtcgagaatatactttggagaaaagacagtcttttcagatagagctcctgaactggatatcctgtaaaagatgaaattgccagtaagtaccgtagtctgtctatctatctatctatctatctatctatctatctatctatccatccatctattcattcaccatatatccagatcacagtcccactcccaatcccaccctaacaaacctgtctgttccttacctccttctcttctcttcagagaagaagaagcccccctgggtaccaacccacgctaacacatcaagtctcagcaggactaagcacattgtggcatgacttgataatactgagttttacaaatgaggaaacagacttgggaatgaaatgtattgtataaagccattgctaatagttttgaggtccaggagttggatttagatattttgtctctgaagccgttattcacaataatttactgctattaaataaattttggatgcacatcgtttctattggacatgctgctgtcattgtcccttttttactttgcctcacaggcactaacgctcagctccttaatgacatttcttttctcttcctctttggtaggttcttggcattgccatgcagaaaggttagttttggcctctgtcaatgaagtataatcctgaacaatttacatagctatacagatatcttattgtttatattctaaaataactatagattgcaagtttggttaatattagagataataaattatattttaagatttaataattaatgaaaaaaggatttccctttgtcctgttactccttgcaattctaaaaatactgtgtgtaaatttgcaataaaaattaaaatataaaaaatggaactgccattatctctcaccttgcacaaaagtcagctccaagtggatcaaagatcttgtttcaaaacccaaatctccaactgttagaaggaaatagggaaaacacttcacaacctagcagagcaaggacttcccgcataaaatcccagttgctcaggaaattcatttcaagaagctgacaaacaggacctcatgacgtttaaaaacttttgcacagcaagaaaatggtgaagggaagagatagcccgatatgggagagaaatctttgccagctatacctctgacacaggattagtgtctagaatatacaaaaggcaaaaaaatgtgaaacatgacattaaacaacccagtcaataaatgggataatgaacccataaaacgtagatgattaataaagacataaacaaacaaactgtgacctcacttgtcatcagagaaatgaacattaaaactgaattgatggaactggaaagaggctcagcggttaagatgcctagttgctcttccagaggacacaggttggattcccagcaaccacatggtgtccctcaattgtctacaactccagttccaggttgtccgacaccctcctctggcctctgtagggctccaggcacattcccctgccagaatggcagtcataaggaaaaaaataataataaatgctggtgaggatttatggactgctgatgtgaacataaacttcccaggctctatggacataagtctggaggctcctcacaaaaatgaaagctagatctgacttatgatacagcagaactgctcatggcaggcacatcccagagacacttgcatctcagtgtttactgtggcactcttcacaacagctaagttatggaaacaacctaggtgtccatccacacagaagtgaataaagaagatgtcctcaaatatacaatgggattttctcagttttttagagaacaaaattacaatgttttcagggacacagatgtaaccggagataatattaagtaagctaagctagtcttaggaagtcaaatattacacgttttctctcatatgtagttccaagatttcttgtagactaaaatcatgtacatattttcaatattaaagtataagccagcctatctaggaaggatgaagatgagaagaaggaacgttcctgagcagaggaacggcctagtggagggtaagggggagatatacttccatgagaatgtccttacctaatacaataccaaacagctaatatttaatgaaaatacttaattacagcttcttcattaaccccatcaaatactgtgcacaagctccacacgatgtacactatgatactataactgctatggctttacagtcagaaaagatggcacaaaatctagcaccgttcatgtaccagcttcaaactcaggaaagggttcaaggtgctctgtcattttaaaaaaagaaaactattatcacgaagatacaggaccttaggattcaccatactattcttagttgtttggaaattgtgtgcacagagtcccgggggaaagttttaaggaaacaacagctgctgttctgtatatctgtccgggaaggccctcagctagccatcttgcaatagaaatataaataactgaatatccttaaagacacaagacaaaatgttcaggaaaatgatgtccctgggtggttggaaatctagacaagtgtgtgattagtagagtgaggggggtttcaaagcctctaagttatagcctccccagatgctatttcatcttctgtgagactgagttcacactcagcttcactatccaggctgctaggagaatcggatgacgtgatgtgagcaagcactttgcaaattgtacagtgagaataaatgtgagttcccccggctgtgcatctttgtcagatgttcacctcaggtcaacgtgtgggtaaagcaccacaggccccatggagcctagcaagggagaagggactgtgccttttgggtccaccaaacctgagtaggaaaacaggctcgcccacgctgtggctgtgggactccaggagttatttagcctcctgtagccacaggttctttggagaagggagataattacactccttccgtttgccaagaggagtaggtaattgtgagcagagggggaaagcctccctcatggcacaccaccccatacatagaattatcctaataaatagtgttggttcctgtaagtcataatgctacgaacagcaccccagcttcaagcagccatttagtgctgcagatgcaagcctctgacaatttcccggagaactggccaagctccttccagcattaggtgatttcattacttagagatccatttccagactagtgagagagggcagatctggaacatgacagcatgtggcatgtgacaattaggcatatacagggcttgagggttgaaaggacttcaggtggcagagtttctgaagagacaaggtgacctcatctctccaccactctccagaggtgagccctgagctttcccacacttcttggacaaatgaaggaataatggagtgtcagagagttctatgaattgccttctatgaatacagcttagaaacagacctcactagtatgaactagtgatagagcgagggagcagctgtcccaactctcaggcaagacctctttccccaggagaggattcagccttatccacccagggcaaatagagcaacactgcctctttaggaacagatctcaaatgttcatcctcatggcatccctggccagtgttttgcagccaatttgttcaagaaaaaatacttgcaagtggaatttctaagccacctcatttttaaaattcaatgtttaaaccaaagaccaacctccaagaacatcttcatatgaccaggatatttctctgtgtggtggcaaccttcagtcaatcatctctttctggctccctccttgtgctggtggtgcctatagcaaggtaccatgctaagcatggaggatcttggatggagagaaaatgagatcattgataattcatactggtcacttcgtattctaaaggttcccctggttgcaaaatggagaacacagtacctacttcatcagatgttagacatgaaggtcttaataatatccttgtcagaggaggcatttaatcaatctctaaatttcaatgttttgtcacattttatagattggcagatctgtctcttccactgaaattttatcttgtttcagttactagaactttggatggtgttaatttagtatggagaagatatctgagttttcagaagtgatggaggaaaacaagaggggtgtggcaatgagctatggttcagtttcatccagagaaactgaagacctgggctcatgacccagttgtcccttggactagctatacaattgtaacctctgtggatttctcagtctgtagaatacatttttttttaaaatcaggctcacaaggactcacttcagagcactgctgtctgggtgatttgagataacacagcatatacatttgagaaatttgtcaaattatcacatcatgacttgttttacctaataggtactttgtcactcttgactgtccatccaaggaggataaggtcctttgtttggtgctcagaggcagtctttgattttattatgctttccgtgtgtcaaggatacaccacagtgtctgcctgaagccatcaccaatgacttgagagaagatccagaaaaggccattaaccccagtggcctccacaatgagtggcagctgcagcagcagccactgcctcagaagccattccctaagatcaggtatgggtggcacctgttcccattcgcctgctgatgtccttgtcaaacatcaacagtattcagtcatcatttctctccaacatactcaaaagcaacaaataacactgaccatgaaaaaaaatagggccatggcatgacagggtgcagcgaaaggcctaaggctagtgggttagggagtgaggaccagttactggcagctggctgcacactctgagatttgcggggggagcatgtgttccaactttgcacttcactgttgtacccagagcccctaggagctttgtatgtggagctctgcactgcagagcttcttagactgtggtacctatggagactttcatttgaggaaggtctcacactcggaacaccctgctttccctgtctccagtctctagcctgctctgcttgaaataatggttgaaggggtgtagaaatgtacccttcactgtgggggtttgggttgctcagaaggtccagaaggtgttgttccttttctgtcactgaagtagcatgacacagtgagggtgaattgaagcatcgcacaccaaggtttcagccaagccgtgctctttcctagagagtctgagagaacactcaggttctcgtgttcgcatcttctagagaatgcacacactctagctcctagttatttcctatcccagagtcagcaaatcaaacctttctcaaatcatatcactgagatcccaactcttgtaattctcccatctccttcctcactctagagagagctgtgactgcattggtccacctaggtcatctcccagtgatctccttgcttaaactaaggttggtccaggcacagcagagactctgttgtctttcctcctttgcccatggctttgcatctaacaggctttaggggagagaaactgcaagctcaagctcagtatgcccaaatctttgggaggccacagccttgcttcccccaggcaggacagaaacctcaggcactcaaaccacctgaagcagtcagccacctgcttttacagccggttttacaggacacagccacacacttgtgcgttacttgtggggcttccacactaacaccgcagctgacaatttgcaagaggtcaacagctaccccaaaagcctaaaaacgaaggttccccaaacctctcttttgtggcaccctatacacctctggttctgactttaactgtttacaacaacatcacaccatagaaatgacttcttcatgtttgctttagttcacaacttcctgatccccacctttgtaaatcccagcagaattctgcctccctctccagctattctacaccatcttcagttgccccaagactattcaaccctcacagcaactctaagcaccactgagtgtccatctttagtcctggccacacatactaccaatgtgcatcctcctccagaaaacttccctcaaccatttcacttaaggaaagcaatcagtccctctgaaagagtctctagggactacaaatacctcagaggtagtaactgctatgtttacttttggtatatgcaagcctctatagagaaactggtttcttctgttctgtagacagaatggttgtacttttggtggatgttaggtctcttctctgggtctgggtattaccatctgggaagcaaagagttggataaaatatggctgtcttctaagggtcatttggttttactagtcttttgcaccagggaggactggtgtggttgcttatggattcagagaagagaggaacctcccatattaagtgtgtgccctgaagagttggaaatcaccacacatgttatcactcctagttttgttctcagtgtgcgaccacaggagactgacgaaatgcagagagagcaagagatgctgagatcatctgtaaatacttgttgctgacgtttctccaggagccaatcagaaggcagtgaatgtgtccggacgtgcaggactcctctgtggcaatccatgcctgagttcggtccattccctgaagactcaccctcaaccctgtggttacatgggaatcaggccatgtcacgttgtctgggcatctttccactggtcactcacctccctttcatctcttgtgttccccatctcttataaagatctttttttaccccttccaaacatggctttgatcataactgttttctttttccctagaatcagcacctctactacccgcctgcttctcaccctgggcctctgcaggagggtctcatagaactgctaaaacctgctacttcccagtgagagccccttaaatatgctcactgttccaattgccccggctttcctcctccccacacctccctacacctccctttatccaggagcatgaagtcccggcaccaaatccagtcagctcggctcatttcagaatctgcccctgccctgtttttcttcaacactaagtcctgtgtgcaatctgtctgctccctgctttttcatttcatgtgagccctgcccttctgcctgtgggtacctctacctggcttgttattatgccctgactatttatgttctgtgctcctttctgtgcccctcccaggccacataatcctcgagggcagccaggacagagtcctttgcccactaaagcatttgctctccccattgtaatccactgtgaggtccttatactcaggccgtcctttcctgtcccattcaccatttcttgtccacctacctgtcattcacaaaataatgacaataaatctaccttagcacattgttttacaggttttttccattgaggataaacattaccacctcagctgatggttatatataaatgtcaccctttttatagtacctcagtctttggcgcataggcttttaacatttagaattagaggaagccacaaatggattcattaccagtagacatagacattgattttgcccataaatctagaaaaatcctatactcagctctacaaattgcattatgttaatgcatctccttgcatctatctgtacatgaggaaagcgttcattaagtgcctactacctactagacactcctcaaggccctagcaatttcagtggcctttcttacagatgatgagtcattgaatcatctccagctcaaatccatattccctccccaaggaaaggtgcagtatgggagtcatgagagtcacagtgtaagaagagggctgggctgggctgggctgcctccatctcatccttctgtgatcttctgggctacaaggtatcatctagggctgatgtttggctgactggctaagctaagcagttcctaatagacactacaactacttacagatcgttcagagtgcagccacaactcattcagtcaagaaatccagccaatgaagaaactgaattcagtaaaagtttgcaagaatgaagctgtaactcagaaaagctgactcaacctcaaaatgtccactgtttctgtggggtgtgtaacactggagtatgagctatttaaaaaatgattagcattctaagtttactgctatgtcaaataactcaatttgttcctcattcaagggagccttttaaatcagataatgtggcagtgtttgacaagtgccagaagaaacaccgtgaaaaaaaaaaatgactaacactggccaatgagaaaaaactgcatttaaacaatttagcattgcattatttagatttttctgttttaagggctgttttaaaacagtgttcagttgcaaaatgtgtgaaactgaccaaaaaataaaaaataaaaaaataaaaaataaaaaaaggccaaaatggcagaagtggcctgccaaaatccaaaatacccactaagtccttgtccatctgtctgtctgtgttccggggagattgatttaagcccgtattttctacctagcctgcacatttacattggctaggttttactggtaaatattggtttaaagcaaacactgaaatctttaatcacattggaacagacctggcattattctgcagcagaccctgcattagaacggaggaaacagagaaggagcaggcacagctgacagctacagactcgaagagtcaactgggaaaaccagaacgaaatttctttggagggagaaaggccaggaaaaccactgctgagatacaaaattttgtttttcttaaagtctggagctgtgttcagtgaagtgacgttgcttacggtccgggagaactcagggcaggaacggaaggaagcactgctaaataaggagaaggtagcccaaggagagccagctagctgtgacatagccagcattggcttcctctgactctcaaactattcttgtttgctattgtgacaagttgggttgccatgagacctaggccctaattttacatctccttgcaagttctgaatttgtcacaaagtaactgtttgtctatgcacagaggctgtgaaaggcatgctggtaacctttccccaatactcagtcatacaaaactcccgtttgtgcttggcttgtcctgtccacattcgcatctgggagttctacacgnnnnnnnnnnnnnnnnnnnnacctcgagagtccaaatttcctgctgggtgttccttctttgcatctaccacctcagccccacctccaccccccacatagacacaaatcctaggtgcttagatgttagctgaggaagtcttcaagaggaccgactgttttatctctaaaatctatgattacctctgcctaatggaaacattacacaccccgtgctggggtggatgatgggatctgagggcagggatgtggtggagatgaatagccagctcttactgaaactacttgacacaaagagtgggggttttggttgattggttggcttggcttatctgagacagggtctccctatgaattgttaactggtctgggtcttgttgtgtatatcagactggaactaactcacatagatctacctgcctctgcctctttggtgctgggactgaaggtgtgtgctaccatgcccagtttcttttctgttgttaaaaaaatagaattaaatttcattagcccccccaccaagagaactgccagaaaaatggtctagaatggtcagctcagatgagagtcttacagtaattttgaaaacacagaagccagtctgagagaagagtcactcactggaatttagcctcagaatgaccccaaaggggctgtcatgcaattcataaactggtacagtgctgagcaccagccctggattcaggctagactagaaagtggattccagcctgtgcttactgaacaaactctgtcgcctttctgagctacagtttgtttgttcagtatgaaagatggataattactatttactaggggttgtcacagatattagatgagttgatatgtacaatttctcaagcgttgcttgacttgcgataggaaaaacaagatctccttgggatttgcccagcacggagccatgagaccctccatgattcctcgggggcagtcctaggaaggtgaaagtgcagctctgctctgactgtgaccttgagaaagttactgaatttccctgtttcttgtctataaaataaaattatcggttacataggtctatggtaatatctagcccatcaaattatgataaatagtaaattggctagtggatataaagtgcctaggaactgactgactgttgttagctacaatccttactgttattagcactactttgaagcatttatggtgggatgaatgtaggccttggagtattctggttttagctacagtcttaggctctagaacagtataacccaatagtattttaactttatgtatatgagtgttttcctggatgtctgttcgtgtatcatttgtatccctggcactctaggaggtcaaagtggggttttagatcccctggagttgaagttacagtttgtgagacaccatgtgggtgctagcaacgtagcctaggtattctgcaagaatgtcaagtgttcttgagcactgaaccatctctcaagctttcagaaacaattaattttaacatttaacttgtcatatctaaaatactattgtttcaccctgtgatgaaatataaccagctacagtctttaatttttttgtacaaaaatgaaatgttatatctccagcatgtcttacatcagactggccgcatttcagtaacccagtagctacccatggctgctagcgtatactggatggcacaggaatcccagattctaaacagtatgagaacatttctctcctttgcagtacatggatggacaaatgcaaagccattctcaggtgacctgcctaaagtcacccaagatagctctgtgtacagactcttgcctagagccagatgaaagattttagtcaataatgttctgtgagatcagaaaactactagtttcctctccattaaccacctttgaactcaacaaggcacatccggcttcttctatctattgtcccttgatatttcttttcttctaaaaataaagtctggggcctggagagatggctcaggggtaagagcatgtacggttaggtgtgcagtttggttcccagcacccataacgggaggctcacaaacacttgtaaccccagctccacggtgtcacataccctcttctgcactctaaagtgcacacaagtgtgtaagtacacacacacacacacacacacacacacacacacttaagaataaaataaatctttttaaaaacaaaaataaagctaaaattaagatataaataaccttcacactccatattgaacaccctaatatcaggctacggtatttcttaagcacctgtcttttgcttaaaacagtaatctccgataacggtctacctcatatatatcctttgttgtgttgcataactcttacaagctgctagagtcaaggcaacaactcctcctcttatcggggcattacatatagaaacccagaacactttggagccagacagcctagaattaagcctctgggttcgatgcttactgtttatgggatgtatggtgaaacactgaaaccgtccaagctttagtctctttctttatgatacagggacaactcaagcgctctgctaaggtgtgatgaggattaaaaagatgacgcatggacagtaatccataacagcaaagcactaggcagctataaagtggattaagagatttataaaacacgttcacacaccattctttttgttgcacacttttcaatggctccacattgcctgccaagtaaacgcacattccttggtctagcataaaacattctcctgggcgagctccatctgccactatatcacccccgcagctttgtccaacttcggacaaagccaattgttgtagtgaaggaacgctggcctctctgctgctccaaatgggacatggtggtgtggctcaattctgacgccagacccttcttcctgtgctcccttccttggttcattgttctggctttccaaatcccacccattcttcaccatcttcaaatatatcccccaccttgctgtcttggtccctgagctctaactctgctcctccttctgaattttgctcacatcttttttttttttttttttaagacaattaaaaatgccacttgggattctagtaacatttggcgcatggaaatttacaaataatttactgaacataactgtttgagagagttaaaaaatctccaagtgatttagtagaagttctatggacagacagagtgcccctcagttttaacctagccacttctagaaacctaggcaagaacgtgaaagaaacccagagcgcatcactttttgtaccattgaataaatcactgaggaagaacacagcttatttgtagattagttttatttaaaaaaaaaaaaaagaggggagggaaacaaggaagaattattaatgctgtgtcttcaatactactcattagcaaaggtccctctccctttagtaatgggtagcctaatattttcttatttgggtcatgtcaacaagtccaccaatgtcctcctctcttaaagagttagcatctagaaggatgatatgagaagaaacattgagtaaaatatagccagttgagaacagtggccagcatgaattgtgagagtttaaaggaagggacttcaattcaacctagaatgcttagaaaatcatgaagagatggcttcaggccaaatctcaaaaagataactatgcactggccaggtggacaagggtgggaaagccactgcaggtgggtgcaaaagctggggcctagacaactacagcatcttttagcaataaggctggagacatcaagcttgaagaaagaagtctttcaaagcacttgcctatctgctctgtcagttttatgcttaccaagtgatcttatgaatatgatttggagacgagatgactaggaaggtattaaaagcctttcataaaatgatttttttctacatatattaatgcattagcctctgacttgtcattagattcttatgcttagaactagttttaagttgaaggaacccagaacattttgataaaagtcatgtttctggacctgaaaatctgcagagatgctgcattttaaatatcaaccaaacaccgccacactggagatcaggagggttgccctcttagatgtctcaaatccacttatctctctccaccaccaatactgctccacagtgctagccaccaccatcccttgcaaagcagctgcaattaaaaagtgaagacatgttagtttgtaccaattgctagaaccaaatatttgaactgggtattagacttttatctctcccaatttaggaaactgaagcccaagatcaatgtcccagctagtttactgtctaggaagagctattctctgctttaatataacatcttatagcaacgaagtcctcttcaagggtcgacaaaagtgtcctccccggggaagcaggaacagaagacctaggttccttcagccctttagtgaagtcaccaatcctattcaggagggctttacatatataacatatttaagtccgaaatgtcctagctctcagttctactgcacgtaattaagattcatcaggtaaacagatgctattgttcttattgtgtaggagaggaaaccaaatgggcatacagagctcaagaaatttctctaaggttaattgtaagagaggagtctagaccatagctccaaggaccaagttataaaccattaccaatgattaagttccttttatttctcccaatttaggaggctgaaacccaagatcaatgttccagctagtttattgtcctttaacttcagaagtacatgtttgtttgtgtgtttgttgattggacaaatacaaatgttcattagcaatcaaatgccccagtcagactcaccccaagagcagatttgtcagttaggatagtggctgtaaagggggtgggaaaagaaccaaggagggcagagctaccaactggcatagcagggacctagcttttctttctctgtgtgcctccaaggaactttgatggtgaccctgtgtttataacagggcttgtggcttattaaaaataaaatcacagacctttgaggtaaagaactgaagttcacgttctccatctcctccctctacccctccttcccccacaccaccccgctcccgtctcaatgcttggagtgaactgtgggacaagcctcagtcctctcatgtgcatcacggaaactacacatcatcattgttattctgtcccatggggtttatttttcaaggaaaaaatgaggcatgcaagagaaagtggctggtaaactgtcaagttctatacacaaaagctagttgcaattggagatttgtaacttggcatctcgaggagttgctaaagacggcggcatcaaaatgacctactttctactgttatttcccttgagggctgtgaagctctccagcgaatccacccagggtgaagtccctgtcataagcaattgcaatattccatatttataaagacacatgaaccaggtccagcctacagaaagcccacctagggcttataaactgtgcctttggaagagttgccttgcagagcatgtaaacgttctcttgtggctgcactttgttctaggagtattctacttaaggttcaaaacacatgcttttctgagatgttgcataccaacatgagtacgtttcattaactattcttcaaaattaaatgcacagctttgagcaccacagcttgataggaaaaaaaaaaaaagatgctgttaactctaagggacaaaatcataaagaagagcaccaaataaataggacaatagcaccaacctatttaaatgacaagctttatcttcatgtaggtgaagctatattccatattaacaaatagttattatactgtggagaggaacatcaaaatgaaataagcaagctcattttgaggtacttagcatctttcaaggcacccagactaaggacatctacaaagctagatgcttgtgcataaaattagggtcataagctgaatgcaaagatctaacaaatgtatacttcttcagcacggtggaaaagatgctggtaagacatctaagttcatacgcttagcattaggagattagcaagggggattcttatcattcaacaccaagaacagtctggttcctgagtaagtggggcttactcagtgttaaagtcagcatggcacccagcagcaggcctggcacatagtaggtgttcagtgtacttctgataaatgagtgaatgaatgaatgaatgaattaattaattaatgaacagtttactgcttaattctctgtatctgataggccattgctctggtatgtcggtaggatttggtggaaagccaataaagagaataccaagaaggcattttcctgaagtaacccagcacaaagggacatttgtggcacctcttacctgtgttcctttccctggagccaaactgtttctctacgtgattttagctatgaagcatgtcactgtatcctcactcaggaaggtaaagactaaaaagaagaaggaaaaaaatagaaaaagttctcaaggtgtttttggcatgtgttgtttgcttaatcctcaacaattcgttgaagcccccaaataaggtagaagaaaatggagctgctgtagggggagggggtagtcttttgtctcagaacacatggcttgctagtggttcaggtaggattcagatgaggcacagcccattgccaatgagtactgcctaagtctgagttactaagagcatcccagtgtcccgcatgaaagcacaccgcttgcctgacatcactcagctgtgagagacctccagaagccccagttcagatggttccttttaagaaatcctgctcttgttttgtatttgggtggggtggttacgtttgttctggactagactgtctctaaatggaactttgttgaaagaaacttacacagaatgtcaaaaagaaacaaatcatgaaagaagacataaactttcctaatatgatcagattcacgtagccagcaagtagacacgcttgatccattgtgacaccatagtcccataaaagaagtcatttctgatcactgccgtggccccaccccaccaagatgatcatcatttacctcttgatccataggttcatttatgctccttgctttaccacattatgtaaattggatcatactttatttcaggtttttggtaactgtttttttttcttagccatatatatgaaatttgccctccatgtcatatgtggtaattgctctaattgatttgacccatagcaataactatgccaacagttgccaccatttcataagaagacaattcaactatatgagacttacaagggaaagatatttacatttcttttctctgtgctgtatgtgacaaacagggagagacttaacagacatgttcctgatataaatgaagctgggctaaagcagcatttagataacatttaatttgaagggaagtttatatttgaggtatcctgtgatgttttcacttcccaatcatatgtatttgtgggggcagaacacttacctctctgaactccaacttcctcatttgtatccagcagaaagtctccattgttgggggagcttctgtccccctcctccatgaaatcaggaggtaaaaagatcacaccgagctttgtacactacagagctagattttagcgagctgaggtctgctgccagtcaggtcaccagctgcgttaagtgttggtgtctattacgtgtgttctgactgggaggagctggctgtcagagaccactcagagctttctaattaccctttcccaccgaccctcttctgggtcatcctacttgactcaccccctcagtacacctcccccaccacacacacattgcttctggatcagaatgaaaagactgggaaatttagactatgatcccaaataatagacaagctgaaaatttataaaaataggggaaaggggggaagagcattggctgaacaatagaaggttattcagaaatctgtgcattgtatacattgtgattttatttaatttatatacatttgtatgtaagtaccaatacataagtgggaaagtttgtactatgatgtgaataatgggggccaaccaccgagacctgtatcgtgtcaagttttcctcctctaccatttcctaattttctgtaataatcctgcacccccatctgtaataagaaggagatatctgcaaaacacatatgataattaaaggcattttacctgttctacattcccaccaagtgcagggtagttcatttgacatcactttacatgtttcacagaccttgggtaattggcttgaggtcagccactgcagcaagatgaatgtgaacatcataccaggccttctgaggaagtattgcacagcctccttctgctaagagctacgttagaaggaccaaaaagggaagaggagacttaggactgacagcatttaggaaaacaattatgcaattttaaggagaaaagacctggtcaggtgtttcttgaaatgcagcattttcaggcaaaagggtgcctctctgctctaagctgaatcctctttagcataaagaaaatacaatcccgccaggaatctggaaggttactattgtctttgatgatttaacctctgacttcttccttggctctagccttaataaaatcaatcataccctcttgtctgtctgtcaagcaaagatgttgcaaggattaacgaatattgtggggctccattgagaaaagagcgatttgaatacaacatatcacaagattaatattaattataacttctgcctattcatcaaatgcaatgcttgccgtcctattgaaggaaggaaagcttcctcagccactcttgcaggaacaacaggaaagaaggtggcctttccctgtggcttctctttgaatgctaggcttcatgataccaccattcatgtttgcattccctgttcttagccctgcccctcccccagacttgcttctacaatgatagcattacttccttcagaaccaccttatgcacaacaggaacagagacagctctctggaaatataacccgtgtagttcatagagccccctacacagcccatatttgctgcctcaaagctcatactttatcttggaacttgggttttgccatttgctaatttagtcaaaggcatcaaaataatgtaagatgttagcaaggagaaaagtaagaggcaagaatggaggcacgctaggatctttgaaacttttctgtgcgtctaacagtattttgaaataagaacttcagggtaggggaagggcagagaatgcagaaggaaggaaaacaccatgctttaccctttggctgtttttgttttttgtttttcccccccccagaagcctgacacttccattttgccccaggccctgcaaaatgctacatatctttgctgaaaaacctcccgcttaaagtacagttctgctctctcttcctcttcctcctcccacccttgtagtccacgctggacctttgggtttctttgcttgctagtactaagtgctgctcctccctgctcacctccctgctgagcactggcctctctcataagcacggtctcccagcctcttatctgttctcttcctaacgtgaacactcatatctccttttacagttaggacatagaagtctaggatcacacagtgagtgttcagagagaaagctggtctgcctggtccttgcttcagcaatggtgtttcctcaccacattgcattgtaagctgccctgcctccaggtgccaagactctgcaaacagcttgggcaggcatttttaatctccatttgtaaaggtgtcatctgagtgtctcctggggtctcaccactggctattatggttccagggctccaaagctacaaggtggaggctggtgccaagctagttataacccttaggagcaagtgttagtgctgagctggttccagccttgagaaacaagtgtgaggacatccctccctctcacttgtatttgtgccctctgccttagttatgacaagcagggtatggagtcttgactgtaggatgagaatttggaaaatacatgtatggagacaacgtgtgaaattacaaaaggattaataaaaatattttaatacacaataaacagctattatgaggggaaaagaatttggaaagtgaccaattcaatggaatttttaaatggagcagtctgcttaaaaaaatattgtggttggcctgggccccgaagagaaaaagacaaagatacagggtctgttatccaggcacaaacacccaaggatgcacctacctaccacagtaccaacactgcacacaccccgcttgcagagaccaggtactgtggtatagctctgaagaggctggcattttgaagtgcttctgctggtaggattctctaattcctgtgcaaagctggagtggaaatcagatcccttcttccacttcgtggagaaatgcgccccgtgctgttttatcttacagtcattttgcatatctgctgattccaacagctttgagcaaactcctccccttctggctggccggctgaaagtctggtcccagttacagaggctgcaggtggtgatggcaaaaggcaccaaggcagtgaagcccaagcaggctgggaagtggttggactttttcttttattagaggcagggagtagggtgggaaggccctgtcccttcaggcaaagctttcttgaagaagtgttcttaggaaacaggggaggaagggtgctctaggagagagagagagagagagagagagagagagagagagagagagagagagagagagagagaagaatcttggagttgagacagcgttacaaaggtgaagaggaagagaggcaaggtatgtgcaagcctggcttgaaatgagttttattgaaaacacctaaattcatgtttatgcattgaggagcgtggaaaagaaggcggaggaagccacctccggggtttctgtgggttttcaagtttgacatacaggatgttgagtttttaacccctcttttaccctgaagtgtgtgcatactgcagggataaacaaagtcctgattctgtaaagtgtgcatccgtggacaggcctttctgtttccctggaatcccacttcatttcttcctctttctgtgtcaggtatttgatgccacacacacaaaagtcttcgtctgataagaaaggctgtgtggtttcactgaggcctctctgtaaacacggttgaaaccaccgaataagcatgctaaagcccgcaggactgctatatcttatcagtggctgnnnnnnnnnnnnnnnnnnnnnnnnnnnnnnnnnnnnnnnnnnnnnnnnnnnnnnntgtttattaacctaggtcttaagtcaataccctgaggtatttattgagacccacaaacggttggctatggagtgacttgtcctgagaagtgaaaaatagctttccaatcacagctagatatatgatcttgaatgcactgggttttttttgggggggggtgtttgtttgtttgtttgtttgtttattcatttggttggtttttgtgggagttttgttttgtatggaacactttgagaatttcccagaaagcaataaataaaggagaccccctagcatcagtgcaaagcctgacatctggctccacctgaaagtccagttcagagtttccctgtgaccctggcacgaccagaagggaagtcttggctttgtttattataacaagagccacaagactcccaggccaataaacatgttcacgtaaaactccagacagcttctctagactggagtcttatcatgggagacctcattttacctctaggttaagggagagaagtctatgcctcgggcttgtccgggtcagtgctgctgagagttcacagtgacccacctgaagcatttttccccagaatgaatgactgtcctgcctgagaacagcacagcccaacatttgcccccacatggccgtagcgagcaggtttcatttagaagaaaagcaaagagggggaaagcctccctcatttctcctcaggactgcaaacactcagaaatgacatcacacaccccacagagccctggcatgactaaggcagaagtagcctgagaaaactctgctctgccctgagttttagggcacagttatgcagatgagcgtctgggcgcaggttcccgccttcttcctctgaggaagtttcttggtagatcactgacacctcatcccggcgagggggtgaaaacttggcacccgccaccccacccccctgtcccgggcagagcaccagaaagagcttggaagcaaggagtcggcaagcaaacaatgaaggagcaagggggcaccgtcagtggcgccgcgagcagccgaggtggaggagactcggctatggccagcctgcagccactgcagcctaactacctgtctgtgtgtttgtttccagaagaatcatatcagaaactagcaatggagacgctggaggaactagactggtgcctagaccagctagagaccatccagacctaccgctctgtcagcgagatggcttcaaacaaggtaaggacacctctttcactaactacaactggagcgccaggcagcagcctgtctgttgacttggtcgaagtgcggcagcactttctttgctcgtaccttgctaccacagtaagctgaaatttcttagtcggtgttaatgcccagaaacacgtttccgaatttgtgcgttatcgaatataagttagaggtatctgcgttgcttccagatcgttttacgaatgtaagtgccttttaaaatatataatggtttgtagaaaactaaagtctgtctgagtcttgccacagtttaatccgttcagtagacacgtgtttgacgagaaagtagatccatcgctttttttttttttaaatgagaacacaaatttccttcaagtctgacaatttcttgctgggaataagggcatttgggggtttataacacgtcctttgtgatgctgacatggtctgagacttagaaaaagaagaaagaaggatacaatatacttgttcttctaccacaggaagttgggttttgtttttcctaattttaaaggtgaaaatcatttaaaactaaaatacacctatactaaagaaagaaaaaagaaaaaaaaacaccaccctgattttatttacaatattcagaaaaacaaaagcaaacttggttttggggagctttaattatctatcattatcccatttgtttaattaacatctggacagagtgctaatttatatagtgagggttgttgctagttgttttctgcttgtttacacgttttcatgcagattttaactgtatggatgtgtgtgtgtgtgtgtgtgtgtgtgtgtgtgtgtgtgtgtgtgtagaagggtgtacaagtgtatgtgtgtctgtgtgcaggggtgtgtgtctgtgtgtgtctctgtgtgtgtgtggtagaaattgtgcagttatatatttatctacatctacataggtgtacttgaagggaaaggcttgcttctactgcacccctctgagtataccttcaaagctccctacaactcaagcttaaggtattgtcctattgtcctacatttctgaggctggaagaggctttgtaccccacctaccctgtcagcccaaggtgcattcctgattgaacttttcctcccttctttcctgggggaaaagcatctctttggaacagagcttgctggctcctcttcaaagcaccatgacagaggaaacagggcatccttagatgctggtgtgtgtatggtggcagtagggtccttcttactctgaaactctctcatggactgatcagtaacagagcagaagtgagcccgctctaaaatgttagctcagagttcacctcggtggggagtaaagagagaagccgccctggggttttaactaatattttctgacttctctcaagctgggactttccaggttgatgtaacacccagccgcttccccatgttgggggcttcactgcgtaacttctccaaatcactctgggatttacagagaatattctgcagtggctttgcctgcctcacagcgtcagcagctgttgtgtggtcccttattttgtgatatttgatgcaacctgcggatctaaaactctgtggtgatattttctctaggaaagccatgaatctctagagtcaccaagatgaaaccagggactaaccagaagagaacaagagcagacaatctttacattcccgttggtttgcatgccatgtgtgtgtgtgtgtgtgtgtgtgtgtgtgtgtgtgtgtgtgtctagagtgctggccttgtccactgcctaacttgcaaagttattaaaaatgtatcaatgaatgaaaggaggcgtgcattgagacccagaaattctcagtccctcaagcttccagtccttgctgatggttgtctgaggcaggaagcaatgaaagttgaatagagttaacactgaagagccacgcaggtttagctgaagcagaaactactagctgcctcacttgctagcaaggtccctagtgggaaggtggcagggcaaagcagttatgcagggggtaaatgagaggataccattttttaaagaagatctctccactaaactgttttcttcactgttggtcagatgaatgtcttgggcgacgctgagcacagtggcaggggtgtgatgtatactataacagcccaatgagaatgtgttgtgaccaccagagaaaaggctcatcagaattatctgggaaagtgagactaagttatgcacaatgacatttttaccttacattaaaaatttcagtgttgaaatgatctgagtgttctgtgtagttggaaaggtcctctttgctatcactaagtagccaaatttggtcacatttggcttacttttatggaacaaaggagcctcagcaaaactgaattccagagctgaaagggagcataaatgtaacgccttacagagggtggaagactgcgaagaagagctttggaactggaggcgcatggttccaattctgccagtctcacttgctagtctttttacttaactgcccagagattcagttttacagtatagaggtgggtctcatctcaccaggtttagtatccccaaagcgcttaagaaagcgcctgccaggaagcaggaatcctgtgagcgatcccttactaacacctacttcatggttgcaaaaccaaatctgtgtccctacttgtgtttcagagctgacccaaaggcttttatttacaaagtctgaacttgacttcagagcacagatggcagagcctctgtcctgtgaagtgagtgttatttggtaacataggtgccagtctgtggagaaggtgaagaaaggcctgtctggtagggggaaagcaaatggcctttagggtttcttacacctggaccgggcagtgcttccttgtttgtttatgtttttccttgacctacctgtggcctaaagaaatggaaggattcataagtgtagctgattttccctgcgcttcttagggcaggtggacaggaactgctactgtacctaacaaaaacagtcttggtctttgcctcagttttcttgacccttaaatattagcaataggccaagaggaatttcaaaattttagagacacttgcagccaggtgaattagtgttaaagaacattttctttttcaaacttaaaaaaaaaagtaaaactggtaagaagacggagcaggggaacgggagcttgaaggacaggggcatggtttctggtgtcaggaagaatgcctggacccctcagtgaccagtccaagttaaaggttaggcatgtatgccagccggctggcccctcttagatttgtacattaattgttgttttgagttttgccagctctccttacctggaagaattgtcttccccttcagcaaaaaatgcgttagagcatgagttcatctgccaaaaaacagcctgctgttttgaaaacaggatgcctgagctctgcccctccaaaaaaagaggaacggaaagagaaacagtatagaaaggaagaaagcaaacagccccacagggatccccaggccaagtgcggcacaaatagtgacctctctttccgaccttctctatggctcagttcctgagctcctgtcaccaaagccaacccacgtcatcagagcaggataggaggaatggcacagctgctgtgagggtgactagaatttcctgtcgccttcctgaccaacgcagtcagagaagtacagggttgcaacaacagtggctgaggaaggatgggcccagaacaatcccggggaggtggggcgggactgggaagggatgggaggtgttccttcccactctggacagagaagcatagtcgttcatccaggattttcaggtgaaaagcatcaaaaggcttattagtacctggtatagtggatatagaaagatgaacatactgtatcttcaactgcagctacattcaaatgattagtcacagccccagataccctccaaacaccctgcggtgggacgttgttttctttctctatcagctttgcctgggacaggtttggacccagatgatgaaattggacgttctgaaattggaaagtccagtctcggataccaaagcttcctttggactaaggagctggagtagagtccttgagtcaacgtttgctgcggcacttcaccagctgggagtgggggataaatggcactttcttgaggcatcctgaaatcccatacagacaccattactggaaaagtgagtcctcctggctgtgcaggcttagttctccagctccactctgagaacttgtaccagcctgggctccttggacggaagggactaactaaagtcactcaattctaccagcctggaggcactaggaaacctgaatgtgtaattctgggaggtgatcatgaccgaggcaagacaagcgttctaaagttgaagggagtcattttctgtacccctgaacaatcaatcagtaactatgggaaacacggtgcctaacggaattgaaaggaaatagatctcattggccagtagatgcatctcagaactctcccaggagaagggatgcaggttgttgaaggattaatcgatgatgatggtgagaaaggagtttcccttaacacagaggggccttttattgctccctgggtttgaaggaagccttagtatggtttcttccagctgtgcagaagggcttcatcagaccaaaaaaaaaaaaaaatgggtttcctactagaccttactgtgcctcttgccagactcctcattccctgcccaaatggcttttacccttcttccaagggcctctatgtgggtgtgcttccacacaggtacacacgcagaggccccaggcacagccatgtagcagcaacacgggactggggagaaggtatgtgggctgtggcagaggctcacacgagcttacctgggaggtcctgagtggtgaaacagggagagagtaggatgtagtccaagttaatggaggctaagctctagttgacctcctagactatgatggactatctgtgaagttagcagtttaggagatagcttaagtgacgttcttaagcatttaggcttgtagaatgcaccctgacagatgttggggatgatcttgctctaaagaataaagcgagcattggttctgaccagcaggaggggaggtgtgcattccttgacccagttttctctctttgctagctcagcctaaagtgagaaaatctgagtataagccacgagtttaagttctagctctacctttactggggatatttttcagagcaattgaataattttttaaaaatctttttatttccttattataaaacaaagtagttggaatagattatttttgcggtttacttcaggtctccaattttttgttggtagacagcccgtgtctcacacgggtagatgactgcatgctaactcctttaccctcattcgtctgtgaatatacagactctttgagataggcactatctatgggtggttaaagtgggatttagctgaaataacttgataagcatgaataaaatcaccatgcctggaaatgtagctcattagtagagtgcttgtaaccattcagggggctttgagatccaaccctaattataacacaaatgtgcatatgtgcatgtgcacgcttgcatgcacacacacacacacatacacacgcacatgcacgcacactcatacacacaagaggttttaattccaggtgctggggctatggcccagtggtagtatgcttggctaacacacatgaagctttagacttgatggggttgggagagcatcagaaatcctggtctggatcccaatgagacaaataaatggaagggaagtgtagtggggcttagtgatccttcaccgtgaattggtggtgtttggttggaggtcttatcctgtttggttaggtttggttccgatttctagtgtgcagttacattgttcttgtagcctagccattaatttcagactctgcttggctggaaagtagtccttctaacacaggtaagggggaaaactgtgatagttctagaaaggagtggatgaccactcatgaaaatggaattgtcagacatgtctgtcagtgtcagactcatcccttacattttgtggattagtgtgcaaagctgcagttctctttgttttccctaattttgcttaagataaaacagtaaacatttcttggaagatgtggtccacttccaaattcctttgtacacttgactagccacctcttccctccgtcccccgcatgaaagatcttgattttactgtcatctaggaggatgtccttccaaatgcatgcagactggccataaactagaacattcatatgccttacagagctacctgggctgagggactcgcagtttgagagggctttcttaggtcattcctttcagagatgaaagagaatatttagcgcatcagtctttatttagtgtttttaaaatcattctttctgtgacagaatatagttgtactcttgagtgtgattcagtatcagaagtgtggcacaggaaagagttgcaggcctatactttgtaataaatgtgattagtagtatttttgcttaatctaaatatctctacatcagtttgtgtatatagaagcgagttcctttactgaattctgacccagttcagccaggcttttggttaactcacttgcaagttccataagtgagcaaatatctcaatcagaacttccccaccgtgtctctctgaccagtgacagaacgcgatagccggggagtcgactataaacctaaaatagcagctttgaaatattgcattgcagcaagttaatggagttagcatttggtttccacgttttatacttccctgcctttgcatgtttgatctttaagaataactcccaaacgccccgccccaccaagtccctcgccattgttatctatggaagtaaagccaggggtgagactcattcttacgcaattcttctaaaatatttaacttctaggtgaaatgggttcagcgggtaaggatcactcactattatgaaaaccaaaataccctaccagaagacgccagggcgcacccatgctggtccgtgggggtgcgctcctgtcggcaccatgtgctgtcctgtacagactcgccttagctcttttcggggacctaccggcctctttctgtcttgccccctggcatgtgatgtttccctcagctggtgccaagccatttagtctttaggagattgggctgtagcttcctttgtttgatttactttaaagtagccaaatgctccacaaagaaaggactgttaagtccacttaaaagtgaagaagatagtgaatcttcggttcctgagttcccggttttttggagagcaccgataatcttctcttctttacagagtagggaatagtgtttaaagccagaagccatgcatgtccgctcagcaatcacaatgtgctccccccccccccaaaaaaaaggagaaaaacaacctcagcgttaggactgagggcagtggtgactgagggcgatggcgactgagggcggtggtagcctccacccccccacccccggattgaagtacagaaggtttatgaaggtaaaactcaccttcagggtggattcattatagtcttctaattttttcatttaaaacatagtaaatttaaattttgctcacaagaccacattgtcctttctttgtttgtagtatactgtattctattataaccttgagcaaagataaaatcagagtacccttacctagaaggtcttaaaataaggtcaaaccaatattttttaaaaagatttcagacacgaagtattggcatctaataccttaacgacagcaacaataaagttaattactaagtgaaaacatctttccaattgaattagattagctgtgctatacagaggagcaagtcaactaagtgttgacctgacaactagtgtccttggtcattataaatggtgacatttgatagataatttccagttatagtttcacacaggcgtactaggcacaatcctgcaactttcagtccagaggggaactttaaaagtcctatttttatatttccctgaagaataaatatctaatataataaaaaattaaaaatacaaggtataatctcaccgaaaagtagttttattgtggcatgatttctccagagtcaggggatcatgggaagattatagtactaagatagaggtctcatttcaaatcctatggtaatcctccttgtttcttcctttcctctgttgagaactgaagatggcaaattagagagtttacatactggtgaaatagtcaccaggttgtggactcttccagccacttagcagagtgactggcccagcaaattgagatgaaggtgtgaatcccaggttaacctcttctggccccgcaatgtctctttttagtgaatgtctcaatgtgaagctctcctggattaaccgagttgcccattcttgagtcctattacctaaaccacggtagcattagttcaactcttttggaagctactcacagataaacagtgccaatgcttgtaagcattttgagtcagatcgctctcactcagagaatacaggcttatttttgctgcaaactgtccactgtggctcaagatgggttcattgcttattaaaatttagaatactgaggtaaatannnnnnnnnnnnnnnnnnnnatacagtgacttggagaactaattgtgttggtataatgtttattaaggagaggtatcccatggttaaaagattcttagcgtgctaacttccactcttttgatatctacccattgccagccattatttacactatataatggggcagagtaaggtgaaactccttagcctatagtatgtaagaaatgaaaagaaaaattacaaagcctcaagtgactaaaaacatttgatatttagactgctggaaaaaagaggaagacttgaactgaaagctaaaatatgtaaaaggagattacactggaaggaagtttgataaaagacccaaatattcattttggcataggagaaaaatggagacaagttacaaagggcacactaaagttttactaacttggacaacaggtggctttcaaacttcctttttacccttaacatcagagcatttgttaaaactgtggcttgagagcagcagggctttatcacttgcgaatgagtaaacacattttgtaagcttctctgtcatttcattacacagaagatgccccccttccgttctcacatagtcaggccctgtgatatgaacctctcctgctatatggacagtcttgcctgtatttctgcagaccagcctcttaacatcctgtcagttaacgtcacagctagacctgggatttgatatatttccagcgtagcttcacatgtccacttgactctgtggagctaggaaccttctgatagttctgaaagtaagtgtaaacctctcctctggataacttggttaacttgtagtctgaaacttaacaggcctgacatgccacaaaagaaccccctaccctgccagctccaaggccttcctctgcccactgtgacgactgttattggttccattctgacccagatgattgagatacagccatggtgacagatgcactggctatatttttttttggtcaggcaaatacattatttgtgttcttgacagattgtgcaccactgactttttccctgctgtgttttaacactcaggatctggttgcacaaagcttactcacctctttcttagcgttacatggatgtgtccttgagactgtttcaacaagggctatcagtattatattttaaatgtttaataatcagactcattttatttctgagaatttgtggggtttttttaactcgttaaagatatttttgtaatattttatatggttaaaatactttttatataattacaatctggataggtgtattgtctagtggtatgtaatatgactaacagagtaaaatttcaagctgaaaaggccatacgttgcttttcaaggaaagttccagagggtgtgtacggtctgtgtaccttggtatatctgagtgtgctcagtaatgagtgtgcacgtggagtctggaggtcaataccaaatgtcttccttcattgtttacaccatatgttttttacttttgtttttttaaacacacacacacacacacacacacacacacacacacacacacacacggtttgtcattgagccaaagtggcaagccaataaatcccagggttcaccctacaccttccccctcaaaccacactagagctacacttgcactgccacacccggcctttctgcaaggaatccaaagtcaggtcctcaggtttggacagaaagcagtctacacactgagccatctccccagcccactgaaagcccccaacacagaaaaccaagatgctgaaatagaacaacctagccaaagagtatgaacccctggggagaaacagatctttttttttcagtatggtaaatgtatttggttagaatgaataaagcctgagtccttcccgtgtagacatttgataggagtaactcagaaaacaggcttcgctcttttcttccatgcttttcatatcttatctcatgacccagaactacgatgcccagaaaactctcaaagaacaccagctacacggaagcttaggcttcgaaagcccatttcttctcttaaggcttagatagactctcagaactcgggtgccacggtgcagcagtaaatgtgagatgttgtgtgtggggatgtgtaaatgtacctttcctgtgagcagaaatgggcagcttgctgtgggtgatttggaagctggctggtcagtctggcactccttggtttaccattctctcaaatggactgcacccatctggacatgaatctaagccttcagaacctcgtgatggctgctgtttcacactccttgtatctggggcagtggtgtgtcaatcagccctgtctgtctgctgcatggcaccagactgctttgccattattggactataatcttcaagctggcattttcttgatgccagtagtatattcttattccagtagcatattcaactaattcatatgtaactagattgacttaagctctacaaatctgagcaaatacgtatacaacacagatattcttaggtcagacaggctgtctgtggttatgccaagctttggtcaatacctggagaagtctgaagtctcctaattagaagatattgcctaaattaaagaatcatcaatccatagtcttactaaaatcctgacttttccaaacagatttttttaattctgtagcttcaatataagcccatttctaattatggttttcataataaataagaaaattaatgtttcatttatctttctggcaattctggtttacactccttaggctgataaattttctaaatggcaatgagcaagcctgcacctgtatgagtagctcgtgtgtcatgtgacctgcatgacatggtgctgcatcacgcatattgtgggaattttgcagttagttatgcaagctactctcaataacaaaaagagatttgttgctaaagagccacaagaaacttccatgaagctgtgaacccaaagcctgagattaaaatcagaaataaagcctagcttcaagcatgaattccacggcttagagcgcccactaggtcacatacatatgtccttcctagtcgtcccactttaaaggtggacgtccttggtctctcgagggcgcaataacttgcatagtttcctagactaggctacagcataagtgtttatttccagatttgagagaacactcagctgtctctgtatcatgtgttatagaggctactaacttctctgattgggcttccttggtgctattgaagtccactagcagggcagcctaaaatgaatattccctcttttcatgtaaaagttagatgtctatctctgaaattgtctctatcccaacagagctgtacatcttaggaatacattgtggtgaaagtgtgcatccatctggcctaaagtattgcagctatcccagaacaatatacaggatatatctgtctcttctaatgggatacaaattatccgagacatgtgttttcatcctttagagtttacaaataggtccaagccttcaatttgtggcagatttccctcaattcggatgtgtatagtccaacatgaggcatgccaaaatactaaaagggacaagatgcatgcttccaggagagaaaaggatagacctgtgtaactcagggtttcgatttccttggtaggccccagagttgactttgaaacgtgacagactgctgggctgtcacagtcctgagaaacgttaattcagaagaagtgattcgtaaagcagctttgaaacctcccatgtctcatgtatcagggactatagaagaaacactagctgaaaacaatataactaatgtcaaatacattatagactctaggaaagacaaggagtaatcgttaggaaagtagaggagtaatctcaaaaataagttatggcagatttgcatagccacagaaatagtagacattttaagaaagggggatttacaataactcaagcaattttggagtctgaaagtgggaatccattcttaaaaggaactgtactgttgggtgtggtggtacacacaagccatgaatttatgaggtagaggcaagaacttcctaggcaatgttgcaaaaccctatcttaaaaaaccggggtcttcagatgtagttcagtggtcagatgtctgccatgactcatatttatagactaagaatgtttcggtgatgtcccccttgttctgtgtagttgtctccagggagctggaggtcgccaaccattgattttgttttccactggagaggattcaagacttaatgatccatgcatctgattcaatgtttctatttttttaaaaaatattataagatgtagggtttctagctgagaaacattttaaaaaaggttttagtcaccaattttaaaatcatatgaaaatcttgagactttgggggcgtaaaagaatagcaatactaaactttgattccttaattcttttttttcatttgctgcaatgattttcgtcatctgttgattaaggtggttagctggatttggcaaaatatccttacagattaaaagcaagaaggcagaacgtaaatgttccaagggtggttagtgtggtgagttgtctttcatttctcaaaagaaggaaagatctttatctaagaactaaaatttggatatttttaattagctaaaagcttgcataggtttccatcctgaaaacaaatgtataactttgaatcttcttgtgagatatttggatatgtaatatctgaactatacatatacttgaaaaagttttatgtttaaaagagaatcttatttttttaatccatcaaacctagcatttttttgttgcagaagcataaatatatataatgcatcatataatataataaacattatacataatttagaaatagtatgttgtataaaatgctgtgactgtgttagctctgagaaattacttgcagtattttctttttgtctatttaatcatgtcactgtagcaatttggaaggaaatgtgggtcatgagaagtttctgtaaaggttcttatgggaattactgcaaggttaggaagggtcacttctcagcattcaaataatgtgtatcatattttctctcaaaaagatttcagaaactgtaaaaagaaaaatccttggagagtgaagggactaagtatggagaaacacctaaggattcggagagctacataaagcccagtgtcactgtgcaaaagagctgtatcctgcacccctcccctccccctttccacttctctgtatgcatgcactaatgtgttgtccctacttggcctttcatatgtcacttgagcaaacactcatcttccggctggtgaatagaactggctttgttcatcagaaatgacagcactttgttgcaaaattgtgatgacaagattcacacttgctacctcgtatcactgtgtccctgggcatgtaggaagagaaatgactccatcctcaagccattgcagaagcgagtctctctagtgtggccctggagtgatgaatattacctaaccttgtgcccccctcccccaggccagaatttgctcccagtagaacctgttggcaggcacaacactccccctctctccccaccccaccccctctggactgtgctctctggctcagctactctggcaaaggaggcatggccatgggctccttcttccactcagttattaattcacccagtgctattccacttgcctttcaaataagacaaacatgtcgttaaagaaacagggctcagtgttttaaaggaatgggaagcagcacagtgcccgagctattaacaacagtggaaattgtgagtttcacaagaggattttttaaagaactacaccatatccttgctccagacttttctcctgttttattttaaattcagattaaaaaataaaaataaaaaaaattagggactttaaaattaaccatctcactcaactaaagaaacagagacccaagaagtcagttcattttatctgaggtcacatattgcttgtagtcctctctcactaacctgtgtcaccgtctctccctctctgtcaccctgagcgtctcagacatgatctcaagagggattttcagcccctctgctttcctgattcttgggaattcttataactttatgactaacaagagtataaaatatgagtcaaaagtcagtccccaaaagtcattgtgactttaatgagttcggcagttgtttcaaactgcaaaaacaggaaaatcctacacaataaggcgcctgtctcacagctgggctcctacgtagatggccacccacaggagcaatgactagggctgtcttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcatagtaaacaacccccatacattgccttacttatcattagtaatactgggaacaaaaaaattaaattaaaaaaaaaaccacagatgattttttaaaaagaatattctagaaaagtagtattaattcattttaaagtaataactcttttctttctaaagcctaaatgtaatttctcagtagtgcttgtagatctagtgttgggcagacccaactttagggaggtgtggggaagtgtgtgttctaagggttcattcacaaactttgtttgtctgtgttgaaaagggaatttggccatttcctctggggacattatttctaggtagactctaacagggctttcttgtgaggacagattattaaagaaaaaataagatatgtgtacaggagacacgggaactcatttatctttgaaatagcaccttccaatttgtggattctccactgcatttgatgaagtaaataaatccattcccttccaactccacaagtccttgggccatagtttcactctggatccattttaccttcatattgagacaactaactgggtaagtccacaggaaggctccaagcgactcaggctgtggaggtctgagttacgactaatatgtgtctccttagccagtggtttattcttgcacacagaggcatctccagttccctctctgcttacctcagcagtacagaaagagttttcttttccgagaggagctagttgctagtaaatactgcacccaaactgtaggaggctgccctagaatctaccacacaatcatgagaggttggggcagagaggtgggttagaagtcctgtctcattcctgtttcacagaagaaagatggggtgatgtcccaaggccagctctaaagactgataatccatgttgaggcttgattgctgtgtcatggctacctataacttgccagattcagattctgaaaacccatctatcctgagttcctcaactgtccatcagctggcaccttaacatatcaattccagtccttggctagtccaggcaccagggctagccctacctttactaatcagactttgtcttgttagaaggccacatctgcctttcttagtctttcagagcccccaaacaagtgggcccttcataatttttttttaaatgagagcaatgattgccctagtcagtgtggtggggccctcccttgctgaggaaaaccagtggtggttgctaagcaacatttagaaggtctagattggtttctgatcctggatgacctccatttgtgtacttcgccatgtgtattttatggctacctttggatgactttggacaactttgtttttggtatgcattggcctgcccttagtaataggatcacaggagaattcatttaggcgtggatataagggagatggtattcctctgtttacttgcatgagcacactgaccccttctgtaaagatacagaaggtgtgtagtttacttagccccatggctaaaaaccaccatcctctaccacacagactgatgaaccgcgaatcccaacaggtttctatgacaaagaaaagttatatgaaggacagaggggaaacaaagtatcttgccatatatgattcatttttggcctgctctcgtctcctgaacagagcagccaaccaaaccactaaatagtcctccttaccctcttcagactgttaaatgaggattagtgggtggatcctagtaggtctgactcttcttctagaatgaaagttgattgaaaccctaagagaacttgtgtttgctcttttgcttgctttttccccaactgctttgcatggccatttgaggtgtcccattggtgtttgttgaaaacatgacagaatggtttgattgaggtgggacagtcctagtggactccaaaatgtttgcaagtatttcagagatatcaaagaaaccaaaatgcctggctattatatctattatatttggctaaattttgtgcagggggtggggtggaggattagatacgagatcattagtctctaagcttttatgtaagatatgtttactgtagtttaaagtttgttactttgcaaaacactagcagaccaatcagtactcattaagctgtctttcccaacttcccagtcttcagtaagagctagtttcatggcttggagaggccatagtgacagggttatatcttaacacataacttggaatttatgcaattcacctggagttcaaaattgcactgaggttcaacatgtagtctaaaagcagaaatgattgacccagaggtgtcgggctacacttgaaaacatacacacatacacaagcaggaatacccagaaagacagtggttgtatctctgaggacagtgggaggtacagtgagccaacaggcagagactcaggttcagcctcgcttcacctcaaaaggcatctctctggggaagcaatggtttgacctgagtcttagatgcctgaagtgaagctattgtcagaggcaggatgctcatttggaaagggaattgcctcacaggaaagagagccaattacaagttcgggctgttgccatggtgctttgctgatccttcaacatgcaatacaggaactccgaggaaggctaggaaataggatgtaggggaggtggggagaaatgaagtcagctagggcaaggcatcccactgcctgcactgtaatgctgacaagaagaggctggcaggggagccaggaaaagaatgtcattttcagcatgtcctgggttgctaaaatgaaactaaaataatttaactctgagacatttctagcatgaattataagacgtaacagccgtaaaatatcaaataagcataacgccagataaatcgttgttcatgcagcaaatgctatctcagattttctagcgtactccggaccctacacggaaaggttatgaatttaatccatttgcagaatatgatgtaataagcatattaatgaacttactgagtgcagaaaattgcacactgcatatgaagtactttttgaaccaaataaattaattccatccccattcagtccacggggaaaagagactaatgcatcggcacccagttggtgggcaaataatgtaccaaaagctggtaggaaagaaattctcctaccctggaagccaagtcagaaagcagttacagttctaaccttttccaatttaaaaaaaaaaaattaaaagcaaagctcggcgtcaattaatcaaatgtaccatcacttggaagcaattagaagagctgagtgctgctgtgtcaggctgcatctgcagagggctgtctgcagaggaagagagggttaaagaacacctagctggaacgggggagggtaggacctcaggtttacttaaatattcatggggcttcctccattttaatcttctcctttttaaaagatggctgtttcccagtcagacagctcccgaggggaaagagattccctgctccctggcagagttggactaacctagggtggaaacccctccgggcaccaggactgttcctaactgaagaagtgcttcaaaccggccagctgaatacaggctcttgctcctccttcgtacaattccgggtttcattactctcttctgcctggaaataagcagggagggagggagcgagcgcataggcttcttgcaaggatggggtgtgaatgaagaccagcttgctgtggattagggagtaccacccgtctggaaggctttgtcttttctaagttttggttctttatccactggaactgcagaggtttcctgatccccctggagaccgctctcttagaactgaattctttcaaagggatctgtggattgtggcaagaagagcttccaaaatgcctgaggcaaactatttattatctgtttcttggggttatatcaaggtgggttaatctgattgtgttctgtgtctctgatagaatgtgattgttttatgtccctctgtatttcatggagtggacggcatgagcagtggtttaatttgtatgtacggttagcccacaggtgcttcttaaaatgaaataagacatgttttcttgccttgtattttaatgtactgtaatgtgtttcaattctggttcttctcaactctgttttaaaagaatgctttctgctcttcttttcattttttcttaaacttttcatttaatctgttttcactgaatacgttatcacatcaaactatatttttgggattatccccagttttcctaattcaagtgacattattttggcctttattaaaatttcttttcctgagtttgccacttcaaaaatcaaccagaaaacaattttaagagattttaacaactatttttttttcctacagtgacattgggatgctttcaaattgaggggacattgtgatttctattgtagccctcattaacctaatgaagttggctgatgatacagtctcttggttcctagaaagtgaagttggaagtacagcaatccagcaatcgtttgctctttcccagacacttaatgcattttcttttctttataaacagttcaaaaggatgctgaaccgggagctgacacacctctcagagatgagcagatcagggaaccaggtgtctgagtacatttcaaacacgttcttaggtaagatgctaacagaaaaacccactgagcttctgcagggtgaatttttacagtctaccaagggcatccctgtgaatttggagtgaggttaaatgcagaaaaaaatccatccaaaaaatgagctaaagtcattttctataggaaaacaataagcaagaagatatttctgaaatgaaaataccctttgaacctcaggctatggtgggctgcttgcatttatatggtttctcattactgccccggtcctgcagggacctctagagcagctgaaggtctgcaaccttacccagcaacactagcatctctttaaaaaaaaaatcttcttgtaactggtttaagacaagaagctttccttttaggtgtttgtaagggtcatgcatgcagagtcccagagagcatattctggaaaaaattgactgtcgctttggtggattatttcttaaagatgaatgcatgtgtgtagggggtagggctggtgtctgagaggccttgttttctctaagctgtaccgttgtcttctcattctgatggttttctgctctctgcagttatgtggacgggacttcacacagagcactggccataggtttgcaggggtggtcctcagttcctcccagggtcttgtttgacccttgggaatttcttacattttcttaaggggaacttttgtatcatgaacccattctgcctgttttaatgagaactgcagaactggtctatctgtacctcaaaatgcatgagaaaccctgacatttggattcttcctgctctgaactatacttgcttacgcagctccttatttgattcccccaaggaagtgacccattcttccagctgagcatccctgctttctttttggcacagccccttagtaaatgagtgtttgccttggtgtcttatggagcgcagtctgtctgcagctctgtttttaaaaaatctatcttttcctccaaagcagttagttcctcctaacaggatatcaactggctttctcagcagccacccatgcggtaatgctcagcacagccttactgtgcagccctcatcttccaacgaactgcagattagcaggcagagaccatcctacccccttcttgccatgtgtgggtgtcctccagcacctgctgttcccagctgcagttgcaacaatgtttcccagagaacaaaggagaggaatttttacacatactcatggtccagtggtggctggaatataaacaaagagaaggcataatcacaatccttttcgtctcttggctttccccattatctctgaacacaggactcttcctcacactgtctcagatacataccttggttcatgaaacatgcaattatttttcctaagctgggaactgttttcaggacacttgatactgacaacaggcgtaaaatcagcactaacttccctcagtgttagtattagaagggtggtgtgtgtatagatgtgtgtatatgcccttgaatgtgtacatggctaggtgggcaaagaggcaggttcttaaacacaggaaaaaaagatgcagacacacaagaggcatcaagtgcttcatttgaaatgtgggaacctggggagagatgcagcccttcagctccttcaactgtgccattctgtgagtctgtcacgggcacagttactcagcagcttccctgagacacacttgacccccctgtaatatgcatcagccttacaatttgtatagacaatcaaagcttgcttctgaactacaaatgcagagcaggggactcttaaccctgtcttgggggagaggggctgtccctggaggaccttgaggcctcctcataaactgtcatatctgtagtggactttaagggcctcatgacacaatttcctcattatacagaaaacagagctgaagttgtgaagaatgaaggaataaccaatctaaagtcacttgactaatattttttttctgagccagaactattaactctttaggctgttagaaataaatgccagataccatcctttatcgaaattcatgaaagcacaaggaatagaatcccctctaagggtgtgatgtggattactattttggattttttttctgtagaaatcaggatggttggaaatacaaaggaagggttaataattccttggtatataaaagactttgttctgaaaataacaatcattgcagaacacatggagaagacaatatctcagcaagagtgggagagtgttcaatcctgcccgagagaaagaaagggtgtatctcctaagccagtcgtctatgaaacttgtgggttttcccatctgaaaggacaatgtttaggtagggacacagagagccaggcaataaaccatgggccagccgaggcacttgctaatgctattatatggtagtggatttcatgctgctgggaaaagtggactttggagtacctagtctcaggagaagtaaaaaggctgtaggagcagaccacaaatataaaacaagcttttaacctgttatattgaaagctagtcggtatttttacgggtaaagaaaattttctttttaaacgtactcagcatccaacctcgaaagctagaatttttaaggtttgagggaaagagccttagaattgtcatggtcacaggatctagcaagcaaaacccttcaaattgtaccactaacagtgtttgattaagaccagttctcataggtgcttttttgtttgtttacatgcttgctttgaagtagcccgcggtgtctccaccattattctgacaactaaaaatgctaatctactgagggttttttttttttttttttttttttttttggagtctgtgattcaggttgtttccataggaatctggttaattgcttaccagaggaaattccaagtagggaagccttgtgcttgttccagtgattgcgtaggggaacacccatgaatgtcactggtcccacggtgtataatgctcttcttcattgctgtgttccaggcacaacagttgttctgctcagttactgactggtacagggaacctttaattaacccaaaccagaaaagctgctggtcccaccagagatgcttaaatctgcagaggcactggggaatccaacaacattttataccaaatgtgaagagcagtagttggggaaagcacaggctttcgttctagcagaatgtggtagttattagccatggagtgacagaaaaaaagggagcttcaaaagtaaaataacatacactttccacaccagagactggaaaaagatttttaacaggaaccctaaggcctgggctctgggctattaaattgctatgtacaaagtaattgcagaataaatatgtgttaactaggtcatcctttgagtttgggcaaattgctgacttcatctgagaaatgagtgtggggttgttatttgttcccaaatctagtgccgatcatccagacagcaaggggaatttagatagatagatagatagatagatagatagatagatagcagatagatttgggtgtggcctatacatttgtggattgttttaatttcctcagtgccatttgacaccaaatactttcaaaacctctaaattaattgaagtgactaaaattctctaatcaaaagttacagacttgtgagctagctcctcaaggcctttcaggggtgctggctcccccaacagccaggtggtaggctgagcatgaagctggccctatcttgctgtacttgctttgctttgacagagtgtctccagggcttgtgagcaggcagatgtgccccccaggaggacacatgggtatgccatcatctgcaggagtctgaaagcaagtcagccctatcccagcatgtcacctggacgcatgccattctcaaatggggaggctgctgctgtactgattttcactgtgacaagcaaagataaatgtgcgcacttctgagagccacattaactatttcagctatgggtatcatttagtccgaggaaggattgggtcagcaatggaaccaatcactacctttgtgcccctacaggtgtccctgtagcaagacatcacaagcactcagaattccctgcaaagggaaatacaggttttgatagttaataggtaatagtgatatacaggagagcttttacaggcatctagatattcatttatattaatactagctctgtttttaccttgtaaatttaaaagaaaactaactgagattatcaatagttaataaccataaacatattaggaactaaaatgcctattatgaataagaggccttattatttattagaaaattaataggcacaagacatgaagaaaatcaaattataaccttccccaaaacctcaaatggtaatgaaccaaagcttttaaagaattatttgaaggttatgaagccatttatttttctaacattattttcttatttaaactgagcctaaataaattcatatgcatttttacataaaaaggaataaaaatataataaaatgggcttttgttaaatggggcttgtcttttacaatgaattttttggtgctgtttgttttaagctgagtcccatgtagcctaggctagcctcaaattcattatgtaagtctgtgaacccttgtcctcctgcctcagcctccccagtacaggaccacaaacccacgccactgtgtccactaatgaacattttatacacaaaaacacgtcagtcactttaacaaaaactttctatataaatattggtactccatgttgaaaatgtgattgtaattctggttacactgaacatagaagaagatggggtttgggtctgacctgtgccacttcttatttatgttacttgctcctctggatctcagtttactttggcagtaccatggaacaactcatgtgtctcccacctgcttcacaggcccatctgcaggtcaagtaaggccatgctacaagggttctttacgaaatttcaagcccattacaaagggttcaagttgttctgaatgctattgcatgcacgctggcacatatgtgctgaaaagcatgttcactcttctgttgcagacaagcagaacgatgtggaaatcccatctcccacgcagaaggacagggagaagaagaagaagcagcagctcatgacccagataagtggagtgaagaaactgatgcacagctcaagcctgaacaacacaagcatctcacgcttcggagtcaacacggaaaatgaggatcatctagccaaggtaagtatgagctgggcacatgtgtgtgtagctctccactacacactcacacacacacacacacacacacagactctcagacatgcacatacacacacatatgcatacacccacacacagggacacccagggacacacacacacatacacacacacacacagaggtgcacacatggacacacacacacaccatccaacatttataaaagaagacggatcacatattctttttcattgagttttatgatgcagaagctgatgtagcctctctgttaactgctggagcacctaaccaaggtccttctatacaaaaagactgttcctttgtcctgaatataggctcagtctcagtaacgcagagttctttgtggacagaacatcctgctggggaggatgcagagaaagctggcaggctgggctgcattcgcccagaggacaaagatggaaagtattctgggcaccagggagaaagtctgccctgataggcagggctagggataacatgaagagcctgtgacaatgctgaccactaaagcccaaacccagtagcggaggaagggactgaaaatgttctttactcctgtaggaggctgcacagacactggctgctaagtttcttgcagcctggtcaaaggatgaagtgagcttccttggaggaaatcttcttccatgaggtcttctgaaaactgccatcagagaaaagtggactaaacattgagccaagcctctggccagctattcaaattgaaataagttactcccctcagcagataatctttggaataataccacagcaaatgtctaaatgatgtttcttccatgtctgtgggtggtccataaactctaagctattacccataccaggcagtcttcataacctattaatactgagttaggattgagttctactcactcctctggcagctgagcccccttgatttgacttcagggataattagcaaaggctggaaagtttcccccagctatcgctatagagcaagggagagacagggcaaaggagcagaagcctgtgtgcagttgacctgcctttgaaagtagcatcaggtgaagatggggtgttgccaagtataggtcagcaactcaagctacaaacgcaaacatacttgggtgtttctcaacaaaagaatgtgcagaaacttgtagttatcatgaagaggagatacagccagcccaccattctcagattcttatacgaacagaactctaaacaaatgcatgaaagagttggtagctaatttctcccaaataaaattttataaaatattttacaccattaaaaaaaaaaagcttattcttaaatgtctctcatttggatttgcaggagctggaagacctgaacaaatggggccttaacatcttcaatgtggctgggtactcacataatcggccccttacgtgcatcatgtatgcaatattccaggtgagacagatggagcaaacaccgattatcttggaacagagctctttatattttatactccgtgttacttttatgacaactttttctctggtttggacatctacttattcatacctgaatccattttcctacataggaaagagaccttctgaagacgtttaaaatctcatctgacacctttgtaacctacatgatgactttagaagaccattaccattctgatgtggcatatcacaacagcctgcatgctgctgacgtggcccagtcaactcacgttctcctttctacgccggcactggatgtgagtagttacggtctgttttgcatacccacccatcctagttttttttttttaagtatcataaatgtgcaatgcctttatagaaatgatgctcttgaatgcccctgggtacttgaactacttctttggtagctatggcattcagcaatttgggttgcttaggaaaatagataacacttctgctttcctcattttccagtatcagtgtaatgtccctttttttcatctttgccatctgaaagttatttaattatgagacaatgaattagacccatgatttattttcatcatatttctagtgagagatacactgtattctcaaggcatcttctttagtatctgtcatacagtacatatatactgtaccaaatcatctgaattgcccaatatgtactcatcccaggtcctgaggagaatataatgtatatgttacatgcaatgttctgtatagtctctattagggataaacatctatagagttattttcctaggaattcaaagtagtaactgaaaatcaaaagcagacagaagttaagaaaagctgctccctaaaacctctgtggagatggctatgactctttcccttgtagttcaagctttctcatgagctaccataattagtaatgtgcccggccaagccacctctgggcagatggcaatagtgagtaactaggtacatccaaaatgtactgtctgctgccagaaaagactggccatgccttatccagccaccttggcagacccagtttgggagttagagaaagactaaactgattgcttgacattcttataatctgagacaagtaatctaagacaacttgctaatgtgagatggaggtaagggtatttaacccccaatggaaaaaaaatcagtatttacattcatgaagtcaggtagcactattcacctagtgttatacataactattgtttggctctaaattggctgagtgttacagacttagaaaagggagtttagaatgcttgatatgtaatagtgttgctctttcagggaagaggtagaaagacagttaacatttgaatgaacagaagagttttgtcttcaaagaggcttaagaaccagcagcattgtgtgcctaacaagaacaagattgaaatcactgtacatggggaaggaagaggacagagagggaggtcttcatgacagtgtgaacgtgcgaagcagtatgacattaggttttgtttgttagaaatgttatcaactgtggcctacaataagcatgcagtgggcatgcaggtgaattactaaatatatgacagcctgtaacctcactataaaataaacgttggtgaacattttatcatttacctcccaaggctagagtttagcctattccacccctagttacttagcctgcctgggtatgaaggttactgtctgccatgttccccaagcagtatgccttgcttctttgactggcacaggctgcagtccataagcatcatttatggactgccataaatcaaagccaacaactacagccatccacacgcaccatcaacattgtgcgaatgacttacccaaccctcagcccatggactcaatatgagatgagctctggccgtcatccttctcacatgagagagtttatgttgatatacagagccttgtgcttaattcagtcaacatcctgagctctcataaaattcagcagtgcctctcccaactagagtaaaatgtggttggtacttgaacgagatgaaactgaagagtgagacaggtgcgttggatgcagagttaatgggctcctttgaacccacaggctgtcttcacagacctggaaatcctggctgccatttttgcagctgccatccatgatgtcgatcatcctggagtctccaatcagtttctcatcaatacaagtgagttccccactacacagttaatccggattactctgtgattcactgcagccttttcctcctaatgttttcattatgggtaataacaagggcaataatgaggtaatccttccattccatggaaatcgctcaggcttttcctggatactgtgtccagcttgtcaacacagtgtgttgaggtgcatggagaacttggagcgggtcagaggcaagccataaaaacagagctccaaagtttggaaaaatacaatatggaaagaaagagtaaaagatttggagtggccgggcaagataagagaaagcttgtgtatgtgagagtgactctcagtcttttgtgcagctaatagacataacatagcaaaccataagtgtccctctatccaggatgataggcagagatactcggtctgagcattccagcctagaataatattcctcaaggaacactgggaataggtccctatagttcaagaggaaatgtcattaaaggtctacacatttccttccaactgcctggctttgactgcagacagtggagaagcaagggaaggacctattttgaccagcctcaggatctgaagctatcccagggctttatcatactcaaaccatttgattttcatgctattcagaattcattcattgtctcagttaatgctccatttctacgtacagtttcttttgataatatgagttatctcattatgatcatgattgacatctagtgctggcagttttctaaaagtactgtctgagcttcttgctagaagaggccttctgttgtttgtccttgtctttatcttcaaaatatctgcatatactaagcttggggaacactggttttcttctttcaattttaatatcttgttcttgtcttttaaaaacatcaacaacataaacttcgggtacctgcctctttgtatgggttagttttgtcaatttaacaatttaacattctgatagtttgtttctcaagggaaatatagctacttacactactgagaaatataaagcacatttgtaaatcagtgcccttggctagaaggttaacagaacaagggagtttaaattacttcagagaaagctatgatcttagagagagagagagagagagagcactattgtatagtaggcacatactatatcagttggttgttattcttagttaagattaaacatatcttaatgagtttgatgaccatacacttgggtacaaagctgtgtcagacaaaatatagataaagcagagggacgttatagtttgggtgcctagccattgcagtttctggtatagaaacctaaaaagggaaaatctaatatcaacattgttttaaaaaatattcatgctcaattgtcatatttatagaaacctccaaaagctacattattgagttagttgaagatctaaactcacaattgtcagaggttggggagtgtatatgaaagtgagcatagttttaaattcttaatacatttgataacgcatctgtgttttcatttcattctttttcaaaacacagaatttacaaagacttaaaggaaattgtaagctgagatgaaaatacagtttatcaaatgttaaattcttcatctcatatgaaagagaattcatattgtaatatctccaggaatcattttttgctctgcttctctagtatgtaatgacctatggatgatgactcttgaaataatttaaaataaactagatcaaatttcacatttgaagtgatgccagtgtttacattatacaattttattacatttttatgatcatcatttttctttattagattctgaacttgctttgatgtataatgatgaatctgttctggaaaaccatcaccttgctgtgggattcaaattgctacaagaggaacactgcgacatctttcagaatcttaccaagaagcaacgccagacactcaggaaaatggtgattgacatggtaagatgccagcctgcatcccttgcctacatttgccattttctcatatagactgacttaattgaaagttttaattctgtctttgctcaaggtgttggcaactgatatgtccaaacacatgagcctcctggcagaccttaaaacaatggtagaaaccaagaaggtgacaagctccggtgttctcctcctggacaactatactgaccggatacaggtatctgatatctaacacaaagctaaactaaacaaaagcaagcagtatttagaaagcaaaaatagaaatttggttaacttcatgacctaggttactacttaacctttgggcatatctttaaaacaagttaagaaaataaagtttatcatttcatttatggggtaaacaatactgtattcattgaattgtttagttctaaaattgagttgcagtgtctatttataataaggtatatgtgaatattggtcctcaaagctcacatttgaacacaaaccccaccaactgcaactttgttagatctgattttgctaaacaaattgccatcgactgttctttttccacacgtggaaaaatctagaagtaacaactttgggtcattctttgcattctttccaaactaaggaaagaaatgctaacagaatttgacatctaatacaccctccagtttttaaactcaacaaccgtcaatctaggaaaatatacatacttcccttttgagactctctagtggtaaataaccaactctggccaggaccattgaaatactgctcttttgatggtagaattgtaactatagtcaactaaaatgttcttggtatgaagtgtcctgagatgagagggataagatgttctggtggcattgatgcttagttttatgggattttccaaaacttgaccatttcaggttcttcgcaacatggtacactgtgcagacctgagcaaccccaccaagtccttggaattgtatcggcaatggaccgatcgtatcatggaggagtttttccagcagggagacaaagaacgggagaggggaatggagattagcccaatgtgtgataagcacacagcttctgtggaaaaatcccaggtatctacactgagacttttttcaatgtttttaatgagctctaccaattgttcctttctttaagcctctgtgtgtgtgtctatgaaatgataaaaaatgattgaatgatacatttaattccatcatatgtatcattcctttgctttctccacgcatgggctctcaagtgaggtattaagcaaagtttccagttatctaagacctcatcagatttggtggacacatgagcacctgtactctccatctcccatgcctagatttctcctcatcccttctccatctaggagctcaacaccttattggtgctccccacacatctgtttcaatccttaatcaagcatgatgtcaccatttcagatgagaaaaagacccacctttacaatgtggccaaagtatcttcccagtgtaaggcaaggcaagcaaacaaacaaatacataaacagctgtcctcttggtccagtttgtcaacttcttagtgacccagttgtcctttctgtcatgtagataggtctcccaagtgtcctgatgtcttcatccacactgctgtttaattcatgggctctgctgaacatcctatgcttgatctggaaagaaagcttctaactagaagttctaagtatttggggttttctcatcccacgtcctagggaataaacaactacaacgatcttccatgaacggctgaagtgtttcttactaaaagcaaagcaagtggagaaattaaatgactgtgatgtgttatgttacgcatgtttgtctgttgctgtgggcttctttctagtccctggaaagcactttgaaaatggtctctaaaatcctgcaaactgtatataaagagataagcgaaaaaaatgagtgggtgggaacaaagtcatatctgaatcatccagccaaattcttgtaactagggcatctcacagctgccctgactttagtatgagtcttgctcattaagttggaaaagaatcattaaaagtcataatatgtgcatacatgggcacatctccccccaacacacacaaacacacatatatagacacataaccatgacacatgcacatggacatgcacatatggggtgaggtaggacagaatctcacatatgaccaaagttcttgtatatataatttggatatattaaatgactggccatataccagaatactgatagagaaaggtttccagcagagtgaaaagataaaacataaggtcccgaaagaccctagctcatctcccccccccccctttgattccaacaaagcatctctccctccggccccacccaaccctgacaggggaattccattccctcattcactgctgcctattctctttacctgccccagtccccaaggtttcctgtttgtctgacagggaggaggtcagtttaaggccgctcagctagctcctgcaggatgcatggcccctgtgtaaaccacagcagagtcacagccttgatttatgctcttgcacacaagcaaaaggaaatgctaagttgtttttattttccttctttctcctgatagaaaagactgcatgcactatgaatcctaaacagtagcagcagtagtcacactggaaagattagtttgcttaagttttgacttgtttttaggtattttattattattttgaatagtcctctacaaggcaaagacttgagaacttccagaatggtggcgggccagctcctgtcatcttggcgcggtgacatatttaatagtttatcagggagagaatattgaatcagaacacttcagacttggggcttccttcagagaatgactcacagaatccatgtagtgacaaagttattcccagttacatccagaccctgctggcagatgtgaaaggagagactgttgcagtgagatgagcacaggctttggagccagacgaagcagagactaaggcccaagtctaccacttccaagctaacctctgtaccatgtttggtctccacaattctcggtttcttcctttgtaaacagcaggcaacaatacttagcaggattgagaggtgtttgcacatatggtatacattccagggcctaccatatagcaagcaatcaaataaacaaatctcttactattggtccccttgggtctccttctctctttagatagaaaccaagacagggtgcctggctttcaagggcccatgcagtaacagatatgtggtcctctttttctccaggttggtttcattgactacattgtccatccactgtgggagacctgggcagacctggttcaaccggatgctcaagatattctggatacactagaagataacaggaactggtaccagagtatgataccccagagcccttccccgccactggatgagaggagcagggactgccaaggcctgatggagaagtttcagtttgaactgacccttgaggaagaggattctgagggaccggaaaaggagggagaaggccacagctatttcagcagcacaaagacgctttgtgtgattgatccagagaacagggattctctggaagagactgacatagacattgcaacagaagacaagtctccgatcgacacataatctctctccctctgtgtggagatgaacattccacccttgacgagcatgcccgctgagtggtagggtcaacctaccatggccaaggcctgcacaggacaaaggccacctggcctttccagttacttgagtttggagccagaatgccaggccgtgaagcaaatagcagttccatgctgtcttgccttgcctgcaagcttggcggagacccgcagctgtatgtggtagtagaggccagttcccatcaaagctaaatggcttgaaaacagaggacacaaagctgagagattgctctgcactaggtgttgggaagctgtcctgacagatgactgaactcactaacaacttcatctataaatctcaccacccaacccattgtctgccaacctgtgtgccttttttgtaaaatgttttcgcgtctttgaaatgcctgttgaatatctagagtttagtaccaacttctacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataatgtacatattgtaatgttttgtaagttattaatttatatatctaaccattgcctgccaatggtggtgttaaatttgtgtagaaaactctgcctaagagttcccaacctttttcttgtaatgttttgtattgtgtattatatatcccagacattgcttaagagaaacatggagccccatcagcagttaaggacaggaatggtcattgttccaagggtctgccctttccttgtcttgagtccctagttctgcccaaccctttgatgagctggttttgcaaacaggattatcatattcgatactaaatggtttatactgaagttttattttatatagtttggtaggggctaggagcactgggatgtcgtttttttcacccatgttctatccaagtctctggatgcatgagttgagtttgtcactgggctctgctctaattgtggctttcgttttaaaaaaataaacaacactacatttgatcacagatgatactgagtatccccaaactactgacttggaagagctagtctccatactgctcacgagcagtggagccatgttcaaattcatcaaaggcaacaagaagacaatgtgaatttttatcgtagaatgtgaactgatgtcgtaaatgacgcaatgtgaagcttctgataacacttgtcaggcctcttcctggtgtcagtttcagtttgtaaaatacgtgtcatgcttcagttcagcattgtgacaatagttaaagaaaatggcacaaaatgtgcatgaccaatgggttcgtacgtctgtaacactgcattgttccaggtggacgttatattgttttcaaaagtttctcacaatgtatgttataatattattactattatatattgtgctcaaatgcattcttaagagacttttatatgagctgaataaacaaaagcatgaataaattagattgtagccccattcatttcaaggtcaactcaaatatattaaagcagggttgttttcttcttcttcttcttcttcttcttcttcttcttcttcttcttcttcttcttctccttctcctcctccttcttcttcttcttcttcttcttcttcttcttcttcttcttcttcttctccttcttctccttcttctccttcttctccttcttctccttcttctccttcttcttcctcttcttcttcctcttcctctttaccgtacttcacaaaaaagcaagccactttgctcatccaaatcacaactgaagttttgtattctctgtgtccaaaaagtcccatggctcagagcattttgttttcttctcagcagattattcacccagctcctcagtacaggaaggagggtggtgaagactaacaagcaaaaccactttgttcatcttgaaccatttccttctacctctttagaattctgaagagtttaatctcttaggtaaataagaggcatctttagctgggctgtgtaggctaccacagtgactcacagaattgaatcctagtacattagctcaatgtagagaaacctgttgattcatttggcatacaaggagtctgaaatctaaaagagtcacctagaccacaaccttcagagcacataaaaatattcgtggacaccccagccgactgtctgtgcctttgctagtaggttatactgttctagaaagaactaaatgttatcaagtgttaaagtcatcatcttaaaataagtcatcccgagtgcgtgtgtgcttgcgtaggaggtgacaaagactcagtgagtagctcttactaacttagccacagagaagtaagtggcctgtggcgaggagagagtctgctctagaggaattcctcggtaagaggaaattgctgaatttctttagaaaatcaaaagcttgcctgttagttctagccaggacttccctaccatccagtttctgactggacattgttatctgatacaatggcaaaacggaattggttacagtttgtataaaaagtatagctgatgattatgcctaagaatgttctctgttctgttttctactaaagtgtccttagcatggaaaatgtgcatgtttgttaatgctatttgggttctagtttgctccagagccctacctgaagtggctcttcctagaggcctacacaccagacttttaattctccccagctgacagtaatgtagggaaagagtagtgaccccactggttctgtctccaaggcatgcaggcctgaagccttcggtagtcactgtgaaccccatgacctcagcatggcatgctctgtgggatggttttccagcaatgagtttgggccttgcttagttttattcttcccactgacttctcctttaatttctgctcgttttaaaacttatttatctaaattttatgagtatgggtgttttgtctgcatgtatgtctatgctctagatgcacatctggtgcccaccgaggccagaagagggcaggcatcgggtagtctgggactggagctacagacagctatgagccattatgtatgtatcctagtttaatatctcctgccaataagacactttgacaaagacagctgaggaaaaaagggggtttaattggcacaaaattccaagtttcagtctttaccatgggaaaatcagaatagaaagaccttgaaatagctagtcacatccccaggttctcttatcctgagtcatcaagcctccactggacctaggggcccccctcccagtgatgccagataaggcaatcaatgctctgctacatatccagctggagccatgagtaccccctggtactctttagttggtggtttagtccctagaagctttggatggtctagctggttgatactgttgttctttttatgaggttgcaagcccctttagctcctacagtccttgccctaacttcctaattggggtccctgcgctcagtccaatgtttggctatgtatttcctttagacaggagcaattctgggttgaaattttgcagataggtggatggccccatccctcaaccagggggccatgcctaacttctggatatggtttcaacaggttctccctcccctatgtggggtatttcagctaatgtcatccccatggggtcctgggagctcttgctcttctagcatctgggactttctggttgctaccccaagatccccattccacactgctacacacctctgttcaacttcctgaccctccatctcctcccatacctgattcttcccctcttttcccctcccccctcttctcttcctcccaagtccctcccaccctctacttccctccattattttgttcccccttctaagtaggactgaagcatccactctttggtcttccttcctcttgagcttcatgtggtctgtgagttgtactgtgggtattctatgctctttgcctactatccacttattagtgagtacataccatgtgtgttcttttgtgactgagttactcactcagaacaatattttctagatccatccatatctctgcggatttcatgaagtcattgtttttaatagctgagtattactctattgtgtaaatacaccacattttctgtatcctttcctctgttgaaagacatctgggttgtttccagtttctggctattataaatatggcttctatgaacatagtggatcacatgtccttattacgtgttggaccatctttatgcccagtagtggtatagctgtgtcctcaggtaatactatgtccaattttctgaggaactgccatactgatttccggcgtggttgtaccagcttgcaatcccaccagcagtggaggagtgttcctctttctccacatcctcgccagcatcagctgtcacctgagtttttgttcttagccattctgactggtgtgaggtagaatctcagggtcattttgatttgcatttccctgatgactaaggatgttgaacatttctttaggtgcttctcagctattcgagtttcctccgttgagaattctctgcttagctctgttccccatgtttaggggaatgctaggctgctgaggcaggagaggggagcaggttgaggagtaccctcatagaggcatggtgagggaggagggaacaagggaattgtgtgtgtgtgtgtgaaacagtaggggaataacatttgaaatataaatttaaaatatatacaatatgaaaaaagagcagaaggaaaatgcatgcatgtatacttatactatgttcatctccatcttttcacgttgttctggatccacaccaaagaactggtgacctcctctttaagactgagccttcatagcaattaacataaacaagacatgtatgcaggccaacctgatctagacaatcccttactgcagctctctttccaggagattctacatgtgtcaagttgacaaataaaaccaaccatcacattatgtaagtcttattccaaatttgtgttcaagctgaaaatagagccagaccctccatgtcagtctttgggaactgctctgggtccttgtacctcagtatccccatcagtaaaacaagagttaataatgtcattgttatgtgattatcaagagaaacaaatgatagaatggtgtctgattcactgtcaatttcaagtaaggagaggtggcatgctttctatgcggtggtttttgcaaccatttttcatgtgacttatcttggcaattctgatagagtcaccctgggcttatctacacagacaggatcagagttccagacccaagaatgtattctgttcattgaagaggagtagtgtgactcttggccatctttgttgctagcactgtctcatggttgagactctgatcatttgggagacctccatgactcctctgggagattcccaaggggacacacagacagccaaagtattccacaccttgtcccatgatctaaaccttctctacccttctacaactgagtttctgaacgttgttgcaaaatttatacttccctgatgcatttcttctaaaaatccaccatgaattcttgctctagtaccaactttgtgagtttaggaaaagtcctcatctggtggatcttcagttttcttttctataaaaggaatccatgcaatctatagtaaaagattatttagaatggcaggccattttagccaagcttctgaaagattccgagcatgaagcaaataaactaatattaatggcatgttatcatggctaaataagataacatacatagaaaagcatcttcatactaaaaacttatttatttattttagcctaaaaattattttggattgtgattctgataattcagataccacaccctccttagcacttgccagctttttctttgacaattaagttaatatcttcatatacattgagattaaaaatgatgatcaggacaggacaaggaatggagttgttacctctgtcttccagatcagcaatgctctcttaagcaatgctccataggcaacagaattgaggggagtgtaagttaaaccaacctcaccatcactaggctgacctgaccaacagcatattaggaaatactttactgaaatgcagttataccatgtccagagcacccactccttggtgctatccactaacctaacaagagacaagagaccacattgcatgcaaacttctgttagttacttccctcccaaactacatgttcataatctcttcagaatgtatcatgtggctgatgccatgcttggggatctctattgcttggctttggagggtagggtagtgtttgactattaaacactcatcgggttatagtttacaatgtattctttctcattctcaaagattcctaattacgatttaaaaaaaatattgtcaaatccttttcataaatcatgtgactgtagacatgaaatcacttatacaacagaggggttctccactttttgctctgtttagctcatccaacaggtaaacacattcttaggtaagggcttagatccattgtactgaggcaactgtcctcttccatcaagtatgtagcttcatagaagttacaatagagcagggaaggggtgttgaagaacatctctaccagttctcatagatcttcatcagctgttttctgagtccaagcaggtctctaacattcttttaggtgctatgctaagacacattgcctcatgtgcatctcgtgcactagaagacatggaaaattagatgtacaagcgaaaaaattagtgacagtacaagaagtgctaaagtagaggaccatgtgaaagcacctaactctttagggcttggaaagccatgctcagagagcattcttcttagcaagtcatatggagcctttgcagtagtatgagaagggaccagagagatgactcagcagtttagcacaattcttgctcctataaaggacccagagtcaattcccacacccacatggagactcacagccatcagtaactccaattcttgagacgccgaagctctcttctggccaccttcagcaccattagatactgatgcaattgaggagacaaatgctagtaccaattttaaaagttaggtttttaggtcctgatactaattctctgaaggagaagcaaccttggccaacctgtgtgaaaaggggaatagaaacattttatggctacaaaagcagccgatagctaaagtgctgtagtgggaggcagcagagttccaaggacgaggagaacgaagccccgaagccccgtgtgacgcacagtgtagagcaataaaacaatgttgctttgtgaggtatcgccaatcaatcccatgtgacccattggcacatgataagacttttgttcttctttaaacacagtgggactccatcaacattgttaagtagaaaagtgttataatcacacttccatttggaatgactctcctaattatagtgtgtagacacatttggagagggtaataaagaatgtggaagatgagattataagccataaccaaaccatgagaaaatggtaaccaaaatggtagagtagaaagaggctgtggggataaagagaaatgaatgcatagggagttatgtagaaactgcatttacaaatcttgggagtgggctaagtcaaggaggaaaagacttgagaataaatgtcaggttttttgacttatggaaaagtggtaagtcttgctcagaaacaagaaatacaagggaagttccattttgcagggaaggcatgtgttgatggttttggggaggagggctgtgtttgtgacaaggagggggccaggtggatgaggtaactgaacatggcagtctgaacacaaagaattccagtctagaatttatcatacatgtgtttgcaacaatacacacacacacacacacacacacacacacacacacacattattggccatacaagtgaagaagtgtgtaattgggaaaagggttagggaataagactgaccaatgagttttactggtatttttgtgaacaaatacattgaagtctgctgatcttttacctatggaacaacctttatgtcttatgagattctctgatttcctctactataaaaagaggtgggtgttctactactgtgcttcatatgtgcatttctgtagcacttcttgtaatgttacaaagcatcctagggtgatatcctagggagagacagtatagtgagaagaaggataagagacaggactaatctttgaggtactctgtaatatataatataatgtttactacaaagataaatgtcttcaaaagagagagaagccatactactgggaaatttacaggaaaactttgtgtctgaggaggctggatagcctggaactcactctgtagaacatgttggccttgaacacagagatcctcctacccctgcctcccacatgctggaattaaaggtgtgaaccctcactgaaagatgactactttaagaaagaaattgatcacaatggtatacctgagtgcataaccaaggaagggaaatctccctgaggatcgctggtgacaagacagcattttcagtcaagtgatggttcagtagtgagttctcagagagtgaagaggttagcagaggtaagaggctaagcaccgggtggaggaagcactatgaagagagtggaatggagagacacccggaggaagcaatttaacatataagaactgtttaagcatgttctaataaaaagttgacattatcctaccactgctagggagaaagaaaactaaaaacaccagagagaaccctgaacaccaatgacctcagcctggaaaggtggaagagcagtagtagagcacactgatggggaaactaagcttcaaagtcatttaataagggcagagagattcttttggagggtgtagacactagtaggttaaccacaggccagtagctaatcccccaccaaggagtacacatggtcagcagaattggattatgtgtgcgtggttttttgtttgtttgtttgtttgtttgtttgaagaggacatgaaagtgggagggttggaaaagtggagggtggatgtcagaaggaaccatgggaggactgaggtgtgaacatgatacagaatatgaaatcctcaaagaattaatagaaatatgtatgcttggcaagtcagtttttccaatgaagcagaagagtggggaggtgtgttgtatgagacttttcccaaggaggagatacatcacacacacacacacacacacacacacacacacacacacacacacatcacaccaacacaacaattctaccaatgtacaatttggcaaagctgtaagtttcttggggagacttacaggatttataggccataggatcctgaacagctcaacggtatctatatcacagaaaagcccactccagcaggaagctgcaagcctggagctctctgcatgacttgcaggcagttcaccagatggagactctattctcttaggctattgtttattgagtctataactttggctgaggatctgtgaatcttgttagttcgggatttcctggacttgtgaggtgtatttcctgagtctcatgagcctatacgtcaaggtctgagtaggtttgtaggtcccctcaagggaagataaaggagggtcttccaactgatagctaattcaggccttcaaaaaagaatattggtgaactggtgccagggcagagcagggactccctcccatacccagggatggggaaggtcacctcatgctcatcaaagaaaaaaatccacccagatgaactctcagttctgaacatctatgcctcaaatgcaagggcacccacatttgtaaaagaaacattgctaaggttcaaaacgcatgtttatcctcacacaataatagagg

SEQ ID NO: 1628 - DNA, 2847 bp, Mus musculus
aaaggcagcctgataaagctccttgtgacaggctgtcttgccagtctcccagtatgctcctcttgctctgaagtgctccaggattgaaaccacagcttcccaaattagcctgggaagagtgtgcggacccagcagccttttaacccgcgtcagtgcctttgctatgttcaagactgctgttttggatggtgaatgctagctagcactccatacgagacatgacagcaaaaaattctccaaaagaatttactgcttcggaatctgaggtttgcataaagactttcaaggagcagatgcgcttggaacttgagcttccaaagctaccaggaaacagacctacatctcccaaaatttctccacgcagttcaccaaggaattcaccatgctttttcagaaagttgctggtgaataaaagcatccgacagcggcgtcgcttcacggtggcttctaagctttgatgtggaaaatggcccttctccaggtcggagcccactggaccctcaagccggctcttcgtcgggactggtacttcatgccgcctttcctgggcacagccagcgcagggagtcgttcctctacagatctgacagcgactatgacttgtcaccaaaagcgatgtccaggaactcatcacttcccagtgagcaacacggcgatgacctgattgtcactccttttgcccaggttcttgccagcttgcgaagtgtaagaaacaacttcaccctgctgacgaaccttcatggagcgccgaacaagaggtcaccagcggctagtcaggctccagtctccagagtcagcctgcaagaagaatcatatcagaaactagcaatggagacgctggaggaactagactggtgcctagaccagctagagaccatccagacctaccgctctgtcagcgagatggcttcaaacaagttcaaaaggatgctgaaccgggagctgacacacctctcagagatgagcagatcagggaaccaggtgtctgagtacatttcaaacacgttcttagacaagcagaacgatgtggaaatcccatctcccacgcagaaggacagggagaagaagaagaagcagcagctcatgacccagataagtggagtgaagaaactgatgcacagctcaagcctgaacaacacaagcatctcacgcttcggagtcaacacggaaaatgaggatcatctagccaaggagctggaagacctgaacaaatggggccttaacatcttcaatgtggctgggtactcacataatcggccccttacgtgcatcatgtatgcaatattccaggaaagagaccttctgaagacgtttaaaatctcatctgacacctttgtaacctacatgatgactttagaagaccattaccattctgatgtggcatatcacaacagcctgcatgctgctgacgtggcccagtcaactcacgttctcctttctacgccggcactggatgctgtcttcacagacctggaaatcctggctgccatttttgcagctgccatccatgatgtcgatcatcctggagtctccaatcagtttctcatcaatacaaattctgaacttgctttgatgtataatgatgaatctgttctggaaaaccatcaccttgctgtgggattcaaattgctacaagaggaacactgcgacatctttcagaatcttaccaagaagcaacgccagacactcaggaaaatggtgattgacatggtgttggcaactgatatgtccaaacacatgagcctcctggcagaccttaaaacaatggtagaaaccaagaaggtgacaagctccggtgttctcctcctggacaactatactgaccggatacaggttcttcgcaacatggtacactgtgcagacctgagcaaccccaccaagtccttggaattgtatcggcaatggaccgatcgtatcatggaggagtttttccagcagggagacaaagaacgggagaggggaatggagattagcccaatgtgtgataagcacacagcttctgtggaaaaatcccaggttggtttcattgactacattgtccatccactgtgggagacctgggcagacctggttcaaccggatgctcaagatattctggatacactagaagataacaggaactggtaccagagtatgataccccagagcccttccccgccactggatgagaggagcagggactgccaaggcctgatggagaagtttcagtttgaactgacccttgaggaagaggattctgagggaccggaaaaggagggagaaggccacagctatttcagcagcacaaagacgctttgtgtgattgatccagagaacagggattctctggaagagactgacatagacattgcaacagaagacaagtctccgatcgacacataatctctctccctctgtgtggagatgaacattccacccttgacgagcatgcccgctgagtggtagggtcaacctaccatggccaaggcctgcacaggacaaaggccacctggcctttccagttacttgagtttggagccagaatgccaggccgtgaagcaaatagcagttccatgctgtcttgccttgcctgcaagcttggcggagacccgcagctgtatgtggtagtagaggccagttcccatcaaagctaaatggcttgaaaacagaggacacaaagctgagagattgctctgcactaggtgttgggaagctgtcctgacagatgactgaactcactaacaacttcatctataaatctcaccacccaacccattgtctgccaacctgtgtgccttttttgtaaaatgttttcgcgtctttgaaatgcctgttgaatatctagagtttagtaccaacttctacaaa

SEQ ID NO: 1629 - protein, 657 aa, Mus musculus
IKASDSGVASRWLLSFDVENGPSPGRSPLDPQAGSSSGLVLHAAFPGHSQRRESFLYRSDSDYDLSPKAMSRNSSLPSEQHGDDLIVTPFAQVLASLRSVRNNFTLLTNLHGAPNKRSPAASQAPVSRVSLQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFKISSDTFVTYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFQNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDERSRDCQGLMEKFQFELTLEEEDSEGPEKEGEGHSYFSSTKTLCVIDPENRDSLEETDIDIATEDKSPIDT

SEQ ID NO: 1630 - DNA, 401616 bp, Homo sapiens
  misc_feature (1)...(401616): n = A,T,C or G
gtgcctgtcccaccattgtattttcaaatcagataactcattgtctggatttataggtttccagatggagaagaactttgccgcaggatgaatcatacttcaagtttcacccataatcgatttggatgatttaaatgagatttgaggctcagagttgatgctggaacaattaagacttttggaggtgttgtgatggggtgaatgtattttgcatatgacagacaacgacatgaatttttggggtcagaggatggacgtttatgggtttgtgtcctccccaaatcatatgttgaaattctaacccccagtacctcagaaagtgacctattttggagaaaagatctttacagagattataaagttaaaataaggtcattaaggtggatcctaagccaacatgactggtatctttattaaaaacggtaattgcaacattgagacagcataaagggaaagccatgtgaagaggcatagggagaaggcagccatctataagccacggagaaaggcctgcaacatattcttccctcacaaccctcagaggagccgattctgctgacaccttgattttggaagtctagcttccagaacagtgagacaatacatttctgttatttaaaccacccactcaatttgtactttgttatggaagccctaataacgtaatatactattgtgtatgtcagaggttcagactgtattatcaaaaaggatctaatttatattgtataaggatagttgaacgagtatagttatttaggatggaagagaaaagtattaaagaaaatatctttgcagggctatatatgacccaggaatcctacatttgggtattttccatagaggaatgacagcttatattcacacaaaaacctgtacacggatgtttacagaagctctatttataattgagctcaaaactagaaacagcccaattgtccttcagtgggcaaataagtaaacaaactggtagagacttacaatggaatgctatttggcaataaaaattaatgaactattaataaatgtacatcttagctaaacttcaaggacattgtgctgaataaaaacttgatcttagcagtttaaacgctatatgattccatttatatgatatgattgaaaagacaaatcagtgatggagaacagatcacagattgccagggattagtggtggcaggaaggatgtgactataaaggtgtagcagagaaagttttctgagggtgacacaactattctatatcctgaacatattggtaattgcaagaatatctatgtgtgtcaactttcatagaaccctacaccaaaaaaggtgaattttatttcgtgataaattaaaaagtaaaacaaaagagacaaaaatagtaaccagggaagctttcaaaaaatatatgttcttgttcaagaccagcatggccaacatggcgaaatcccatctctaataaaaatagaaaaattagccaggcgtggtggtgggcgcatgtagtcccagctattcagacggctgaggcaggataattgcttaaacctgagaggtggaggttgcagtgagccgagatggtgccactgcacttccagcctgggtgacagagtgagattccatctcaaaaacaaacaaacaaacaaaatatatatatgttatctttaaaagtctttgctaaaactctcagcatgcttacatatcaaatgtctcaagcctttgattttacatatgtaatattgcagtgttttgattatatgaaatattatattgaagtaaatttgattaactctaaatttaattttaaatttaaatttaaattctaggactttatagcaagtcttgacaaataaaattctattttcttcgttatgaactaatgagccatcatcattaatgttactgaaatttttaaaaattctaatatgaacagatttaaaataaacagactatgtagtgaaaaacaaatcttgaaattaagtcagctgatcttgatctaacctaccattttggaagaattttctacattgatatgtattatgtacccttataaggctcatagtagtaaaatattaatttaggaaaatattgtctctgtgaaatagcttgtgaatgtccacttaaacacataatggatctctgcatattgttctttttttaagagcagtggagtggatttgatttaatattaatgtgtgctatactctatgatctctgtagtatcacagttaactggacttatataggcaattatttacatttaaaattttacagtgtagattaatactatgttatttttttcttatctatttcagacaagactactgacaaagtaggaaataataaaaagataaaagcttattttagagaaagaggttttcccaaatataactttgtttctaacagctatgtccctaatattttattcatttgaaatcacccttatagacaatttgctgacaggttaatattatctttgggaactggagtaccctcttttagtgtggtttttacaacatctaccatgggaacagcttccccttccatttaggtatctgactcatccttgctaatatatcttgatttaatgatgacctagggaagaaagagaggaactcccttagtatttttattctatgtaatctgccttctcagaatgtgccttgtgaaagaagcacctaattactctgctaaaaccagaaagcactgtgaggagaaagcctggcaagtttctcctaccagtctgccacctaatgaatagaaattgcaacacactggtattctgcttttgcactgcggcaggaatgtgaataataataattattattattaaaagaacaaagaaatgttagctaaaatggtaaacatagataaactgctgtgatttaagaagtttccatttggaatcctctgtaagctcaagtataaaaaggatattggctgtaatcactttcaagacagtaacaaaaatgcagggctaatagcagggcatgatttgacgtgccaaatttatttttctttcatatatttaactgctaaatattaatcaatcagaatacacaatgtcagcctctgaagatacaaaggtgaatacgatagtttatgtccttggagagctcatagattaggccaggagacaaatgaaaaaaagtaccataacatatcacaaaacattctgagggagacagccaatgctggtggagtacagatggatgaaacagctgactcttcttatggaagttgagaaaaaatttactgaagagttttcctttgaatttagccttaatggatgagacatgacatgcttgacaaagatgatagagaaataacacttcagacagtgaaaactgcacaaaataataaatatacaacattttgaaaatgctactgcttaatgccaatatagctcttactctaatttgagagaaatagcttattccattttgtttgatccctcctcctttgtcttattctgcaccaaggcgatcagttatttattcattcaatgaatatttgtttaaatacctactatgtagcaaacagtatttggggagctgagattacaggatcgaacaaacaaagctctgttccttatgaaagttaaatttcaggaggagtaaacagatgataacaaagtcgttaagtaatatcgactatgataaacaagtaattaatattatatgctgacaagtactatggagaaaaatgaatcagaataggggaggtcggtaggtttaaacagggtgattatgggggacttcatgaagcaagcgatatttgggcagatgctgaaggagatgagggaacaaaccatgcagatatactgggaaaaaggaaacttgaacaacattttctgtgaacaaaaaggaggccagtgtggctgaagaagaactagggggagagttgaagaagacgaaataagagaagtactgcagttggagatggggaaacctcatgtagggacctcaaggccactgtgtagactttgcttttactctaggtgatgaggtgtcattggagggctttgagtaagcaattctttcttgaatgggaccatctctaagaaacatgaaaccatgctcaagcatctaggatacaagcctcccacctaggattcaggtgactctatcaggtagtatgggctaaaactgatctttctgaagcaccattttcctaaagatgagtaattaaatagcatcatatggataaaagtgaggtattcacatcatcttataaagatatcatgctagataacttcagactcaaggatgttaagtatatgtgaagatgaacttctagcaatatgactggatcaccctgggagcatgaattccgtcttctgtcccataaggtatcctctgttataaaaagcttggatagcattggtgaagtataataaaatggacactatagttagagtggaaagacctggttttgagtattggatcaactgcttaaaagctatgcaattttattttttgatttatttatttttttttgagatggagtctcactgttgtctgcctgggctggagtgcaatggcacaatctctgctcaccacaacctccacttcctgggttccagtaattctcctgcctcagcctcccaagtagctgggattacaggcatgcgctgccacgcccagctaatttttgtattttttagtagaggcggggtttcaccatgttggccaggctagtcctgaaccccccacatcaggtgatccgcccgcattggcctcccaaagtgctggaattacaggtgtgagcaactgtacccggacttgcgtcttgatattcttatctgaaaatgggtataataatttacaaataatgtacatttggtctacaaatatttattgactgtctactctgtgccatagtctatcccaaattccagaaatacagtattgaacaagactcagcccagcccaaaaggattttatatttcaaacagggaatttcaacagtatttgtctgatatatttatgaggatcaaataaagtaatatattagaaatgcttactgccatatatggcactcagtaggaatgcaaaaaatgtaagttacatctctataattcttttaaagagttgccagttaattttctaagagagctagataaccatttttattcagttgaatattatcttcttttcaatcatgttagaataattctctagcttcgttttttaaaacaaaatataaaaattgggagaagttgcaatttgggggttgctgtagttatatataacagtatatttactgttatatactgttgtataacagcatacactgctggaagaggtatgttagttcattggtgctctgttaccttgtctttgactgaaggaagggatcttgtatagctttacttgaatagagtctaatggttgtgtgttgttttagaaaaaaggaaccagctagtgaaataaataaagacatgatcaataataattcaattttattaatattgatagtcttaaatctgttcctcttttaaagatttttttttaaaagcttctggattgtctttttaaaaaaagcttcttaattcattgtcttctcaaatatccagctttgtatttacaataagtgggaaccatgttattttgagtgccatgttgtgctaggtataatattattgtatacaaactgcagttttgtccatttaaaatacttttgttttataatagttgaaaagtagttactcgtagaaaatttattccaggtcaacttttaaagtttgaaggatattgaatataaaaagtatgtaattattttcatccaaaataattgtattacaaagatgttgaattttaaaaacattttaaaccaaagttatcatagtgtcactataaatttataatatttttggctgtaattaattgacctttcttttcaattcaatgaaaatcaaaatgtttccatttttccacaatatttataataagtaatgcattatttaattgttattgactatataactattcaaatcctttaatgatattttattatgataaattattgattcttattgctttgacaggatgtgaatatcagaaatttcattatttaaaactgagacaggctgggcacggtggcttgcacctgtaatactcagtacttgggaggctgaggcaggcagattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtgagcctagacagagccactgcactccagcctgggtgacacagcgagacactgtctaaaaaataaaataaaataaaatgtaattgagttataaaaaataaataaacctgagacatacctttaattggatttctcaaataattctcaagtatctgtacattgataaattaattgggaattactcatttctccttctgaggtgccaagggctaagggttatacatgaaccggaaggttttcattttattcattagttccttcctaggcacctgacagggcaaatagattctatttgccttttctcctgttctcctggctgtctctctcaaatagtatactttgctgaaatatagcataggatttatttttactgtgcttatgtttactttttcttagatagcattggctatttcctatcttgtaggctcatctttgatttcaatatttggcaaagtgtctcatttttttttttttttggcagtttggctctaaaaacaaactttcctcctcttgccttaaacattttttttttcagaaataagtaattcagactttcaaagagtccgattatcttttaaattttatatttcaattggctgtctttggtattcctatcttttttctagagtaggtagaattaacagactttacatatttttgtgaacatcacatcttagaatgattctcaaaatttctttacttgggaacttggctgtcatagtagggaaagtgaaaaaagtaatgtggaatcccacgtgatggcacataatttggcaataataattggaaagtaattataattgcactattgtactgctttaggtaagtttatgtcaacatttctttatctaaactccagttcacatatagctatatctgggttgtgaaatttgctgtaatatttttagaaagaaattcctaaaatgcttactatattttggcagttttgaaaagtaaatatgagaagtatcttttgtaacttcaaattgctggggttttttttgccaatacatcactatgaataatggcaaaatcacatattttcatgtcccagttttaaatcatattattgctggaggaaagtcccagctttgttttcataattcagcaaataataggtagcttatagccatattttctcctgtgacattactaatagtttgtcttctcaaatagggcagttaaaatatctttagatattaaaacatgcattagagcctacttgaacaaaattacaattttgtaattgaattaaagatcattccattgggaatcaaaaaacctgggttttagttttagctctaacatcagcagctaatatgattttaggtaagttgcttaaattctctagctctgttaccttgtctttggaatgagaagctgaacaaggtgattactaggattcagtgcaaatctaaaattctataactgtgcttttgttcataatatattttagttaattattgaaatgttctgctttccagagtagtaccgtaaaccagtaatttaaacccttcctactatgtttcaaccactttcccaagggctggtatgggtcttacttgctcctacatgtaggagttagtctgctcttatttagtcctttagatatttagcacattttagcctgaatatctgacacagatgaatgatttttttttttttgagacaaaggcacactgtcaccaaggctggagtgcagtggcgtgatcttggctcactgcaacctccacctgcttggttcaagtgattctcgtgcctcatcctcctgagtagctgggattacaggtgtgtgccgtcaagcctgggtaatttttgtatttttttaaggagagacgaggtttccccatgttggccagactggtctcaaactcctggcctcaactgatccgcctgcctcggcctcccaaagtgttgggattacaggcatgagccaccacgctcagcccaaatgattttataagcgtagaagacatctctcacatcttagtgggagaattaaatgtctccctttttcactgaagtcttaccgagaatcatttcttttctgtcactcttgctgatcttgctgatgagccctagttctgctttgtcaaacttatttgagatcaggctggcccttgtgacagtcattgccggtatagacttttcataacatccagaaacttcaagcaccactatattgtttctacttcctcatatgccttttaaagtatagaagctgtattccaatatatatctacatgttaggttacagtgatctgcttttggacttgaggcattttttggactcgcctgtccgtaagtctcacttgcattctttgtgaacaaagaatacacccactctcaaatgtatatgcccacacacaagcatacagtatcttgtacacctatctgcacacacacaaacacatgcatagtgcttgactttggactctgtgctttaactgagagtattcatttttcctggttgttaccttcattccagttttgtgagctttgctgtcaaagtggctgtgcatctagcatagagtggctgctgttggcaacccatgaacaatgagcttaaacagaagaatgagggtaatgtttattgtaataaagattgggcattaaattccttgggggaatgaaccaaatccaatgttttcctgttcgctgacattttttatattgatgctgttttggatcttctggagaagggaggaaaaaaaaacttcagcaaatcagctctttcattcaaaaatggaattcagaaggctattttagctagctttttttgacaatcctggatttaatcagtttttactgtgatgaagacagttagcctcacaaattttgtggaaatctaaagcgatgaagggtgttgttaagggggaaacagagtgcaattgtttaaataatcctgggccaatagcatttggtaggtggagttactgttgtgtgcattacagagcaagataattctgaatgaagactttaaacattacacatgctggacggattctgggtctgctctttgtgcaaacaaaacaagtgactaggttttgcttactatccattagtgaatgcagcttgtttaataagattttttttaaaaaaatgcatgtaaaggatttatcaaaagcctttatgaatatttcatgagttgatatattcagctgaatgaattcagtgagtgtcagtgtgtagcttgcagacaaacctcatccacaaggaggctactgacattggaagcactttggcgcattttcagaggcaaagccagcctgataaagctccttgtgacagcctgacttgctattcttcgagtatgctgctcttgctctaagacgctcatacattggagtcacagcttcgtaaattaaactggaaatagtttgcagacttatcagtcttctgacctgcagcagtgtctctgctatgtttgagatttttgttttggatggtgaaagctagcactccttacaagacatgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttgctggtgaataaaagcattcggcagcgtcgtcgcttcactgtggctcatacatggtaagataagacttggaggtatctacagtgcttttcagattctcgcattagcaccagtgatctagcagtgtagaaaatggaacatttgagttttgttcctaaaacatactgcaagtgtgaaatgaatggagaccaggtcagatgaagagtacataaatgcactgtgtgctaaattgtcattgtgctactagctttttccagataaaatatgcttttaactgtagagtctttaaaattactgcttatcagaatacatagctaattctaggtaagtcgagtaataaatgaatttttaaagtcagttttttgtttcatatctgttgaggtggtaggtgacttttttgttttgtgattgttagtgattttaaaaaaataattttgggacatgaataagtgttttaatcttagttctaacttatttttaagataatgtataaagtctaacttaatgtattgtaccatcatgtttatagcatataaaccagtgagtttttgatttattgacttatctttacaatacttaaggaaagggaaaactaagttcccacttctgaaattgcatggtcagttactttaatttttgattccaaaatgctgttatctttaagagcttctttttttaaaaaaatggactttaaaatttatagctattttttaaatacccagcaaataaattcaagaaccctctgtaaaacttgcactgagcctgccacctttaatatacatgtttacaaggtatgtaaatatagtagggtaacgtccttaaacagtataatgatgaaatgtaaggaaaaaacacgatgaaattaaatcacttttactgtgaaagccaggccacttcagatttttttggaggctatattttctttcagattaaggtacctttaaaaattgagtagctgtaccttagttttttctagcagggaccatagcaatatagggagcatgtacattttaaaggcaattctaacacagtgattttgtgactacatgctgggttgccaatcaacattataaattgaggagatctgatttttaaaaattaatattcacttgaattattttctacttatctaaaatgtttgtctgcttaatctactgtatagtgcattggcaaattaaagttacgcctagaaatatatagcttgcctttgatagataccacatgcttagccaacacatactttgcctggcatatatgatgtgcttattcttgctttctgacaatggactgttcatataatggctttattgcagattttctttggtcatcttcttgatgtattacatcatgttgtttaattgtaatctcttatttgcagaatacacgtggttagtctttcaaagcctactaatgatggtaacattcgtataaagggaaggtttatgtataaggatgtactgacttgaagaagtcctctcttttgtgctttatcccacccctaacatgtatgtattttcttatagtttgctgagtagtataactgaatagggaagatattagttatgaaaataatatatacagaaaatacacaattaatagatgcacattttttcttgagttaatattaaattgctattttaaccaaaaggatatttaatcttagatagctaatttttagataatgataagtcttcttaaacccttggtaatatttttcttaatgtagagttttggttctgaacacaatagtgtgacctttctttttcttataatagatttttgatgtgctaagaacatagagctataaatactggagttttttacttttccaaagaaccccaattttaaaatgattaaagagctagttttactcatgcattatacaaattttctggcagcaaaaggaacaattaaatggtatctgaagttacctacgctaataagatgatattcttttagttgagttaaaacaaaatgttacaattgccaaaaaaaataggactttgatataatgctctataatatagattaaaataattcattaatcattaaacttgtgaaataactttagttttgactatgattcattttcacccttttttctttcaactcacacattccccttctgatgtttcttagtaaaacagtttcacagtttgttttcagctcatgactaagtctttatttatatttatttctattgttttatctgaatacatgcttaacatttttcaaatttattttcatacaacatgcaatgaaaatctctttctagaaaataggcatgtatcttacatatttttatgactttttcaaatcttaaaaattttgcctttcccggggaaccctgataaagtctctagcctaatgcttcatgctttccccttgcttcgcctttttgtctcttgagcaccctaatgtctttccaatgaatatagatggctctgtatggtctgctctacctcctgtctctaagactcgtgagaataataaacttttctttcttgagtttccaaaaaatttcatgtgcttttttacatagatgaaatggttatatgaggaaataagagcataagtactttatttttgcctctttgtcatagtgaaatgtaaccagcctttcacgatcaacgattggtatttttccaaaccatgcacttaagttagaaattccaagatatgcacttagaagtctctaaaaacatgttattactttacagtagacagtaggcttcttttaagaagattggattgttttgattccagcattgaaattaaagtaattttcatgatgaagctaaacaatgcagaggatgcagtttatatgcaaacccactaaacagtttttatttgtagatttcatatttcagtcagatggatgtgtagttctggctttaaaaacccaaattatgaactgtggactaatggcagaagatttaagaaatatttatgaaattctgactctgggctatttaaaaatatctgggggaaatgtggatattcaatgtgttatcactaatcagagtatttacaaaatcctaaatctggaaggaatttggatgattatctcattgcttccttttacccttgggcaggaccacaattactccatctttaacatatgggaatctgccctacttttaagactctagagaaaataattctaaaatctcacttagtatacaatcttactactttatagtccaggtactagaaaattatttgttatgatttatctatattatttatatattatatataatcttttttcccctcagtggatattattaataaaaaagatgcgtaagagcctgcatgaatctgaagatcattattaactggtgccagcgttttctttttcattcactcaacatatgtaattgagcactgctgtgagcaagaagagaaaaaaaatctgattcaacccacatgtattccaacacctactatattttaagttttttactagaatgtctgcatatgttatcccatttaagtttcatttggaatataagtatactccaaattcatgatcctttcaatattacctgctgcagatatcaaaagtattttgaattgctctagcttcttataggtgtttatactccattcatcattattttgactctgaatcactatctcaaatttcaaaatttttctttgaattttgaaacccaaaagtggataccatactctttgttagacgatatgagaaaatatagatatgaaacatgtaataagttgcaaagtgtcaatggaaccttcagaattactgaattggaaaattactgccagagttctcaggtcagcatagtatttatccccaatcccacatcagggatgacaacttatgaagcacagtgttatcctacttggcctgtatggcctgcctgtgcttgcctggtacttgtcacacagtgtccagcttttataaccttcccttctttgttgatatcccaacttcagtcgtcagttctctttcatcattagcaacttgatgctctctgaagaaagctactgcaatggtcttgaatatatcctgggcccactgcacccccctgacccacccccgccccccaccctgctgcattgctgctcctttttggagctctcttcttgtatttgtgaggactaccctctatctctctgtccatgcttgcacacaggaaacaatatttttgtaattagaagttagtaggagaaaagaggcttgtattccttcttctcgtttagttttacctgtatcttggaaatcttttctcgttttaacaaaggtttatgaagtctttacttgtctatctaatatttgaatacaaaagttttaaaagccatagttagtactctaaagggacttatatttggcaagacaacactggattaagtggagaataggaaaaaaaacagtgaatatggcatatgattgaccttagaactgccgacgtgcttgctgtattatacaacttagtcctagtttgttagctaactctactgaatctgtgctagtaatattgatcaattgccttgaattctatcctggtaatattggaaattttttgagagatgtctgtctttacatgtttattgattcaacatttgtttgaacaaaacagttgttaagagcctactatgcaccaggctctgatctgggcttaggagacacaaaatgagaaaaagcccttgtcttcaaagaactcctatactagctggaagacaaacttatgcaataataattaaccaatggtgtgggaataatgctactgaagcatgttgttcaacttgtcatgagggcacagaagaaataactaccactagagagtgagtcaatgtgttaagggaagtttcgagaagagatgacatttgtgtggggttgtgacaaatgaataggagttttctaggagaaaagtgggcaggaaaggtattttttggccaagggagcaataattaggaaatcctgttaacaaataataacaataatagctctaatatattcagcacttatataatgtgttggatattaattataaatgtatttactcatttaagcatataaaaccccctgagttatatactattatattattttcattttataggaaaaggaataaaggtcagacaggacaagtaatttgttcaagtttacacagaaaataaacagctgagttgggatttgactctgagcacgagtgaaaatacacatagttcactggggtttcagcctaaggatgcaaggtgggaaagctaggaagtaagactgtgccagcagattggagccatttgctagggcttccaatatcatgaacaagagttggagttttagcccatccattctcggtgaggagccacgacaggttatgagaaggggattgccatgtattatttttattttggaaaggtactttgcaggtcaggtagagaatggattagaggacaaggagcttaaaggtaactggaaaagggacaatgtgcatttgagagataatgacttctacttattttgtatatcccgtaacattgaaaactatgcatatgacatgttttatgacttaacaaattatggtttatggaaactgggaggaaagcatgtgaacttggtgtctcttgcatttatcacttacaccatgatgctgtagatagtactagctggtacaatacccccacatgcatcaaacaatcagcaaaggtgcataggaggatgtgtgtatctgaggaaaaccctattagctcagtcctaatttactagaggtgctttgtattttactttaagtgcagactcctagtgggttaaaaaaaaaaaaaaagcagatattatcttagtccacaatctgaatcaaatggcagtagaaatctatgcctcatagcctgagtctgttgctttaatcagagcaagcattttatcagtacatctataaatagtgttttcctggccttttagtgtcatcaagtcttcaatatattggatttttaaaatacttacagtaaaaagggctttgcaaagtaatggtgacaacccccaggacacatgccggaaggtggcccagcaagcttgccagctgcctttctgctaaaggctaaacccattttgctaaatcccacttgcgttctctttccattcctttctgttttgttatctctcagtttttctccttggatgtttatagtgcttccttctctaacatcactgtcaatgcacttgcaacattatgctagaagcatttaagcgatttcttagaaaaaaatctcaaacgcttaccatggttttcaggccctacattatctggccccaggctgcttccaacctcctctcctgttctccagccctgtgagcctgctttctgttgttcagcaaactaagcctgtattcacttctggcctttgcacttggttttcttctgcctggaagaaaagtacctggatgttaacacggtttctccttatgtccattcaggattctactatctccaggtatcactatccggagaggcctttgctgacctccctatctaaaatagcaccctttcgccttttacttccttgtctttttggtacttattattacctgaaaatacattatagacatgcttatttgttatattgtcttatcctttcatcatctgccatccctgctaaatttcatgagggcagtgattctgtcttgttttcagtatcctcagagcatacaagaaaggcagtcatttaacaaatacttgttgaagaaataaagaatgaatatggtttctgtttcctgctctttattctatgagcatttttcctatagcttgatatgatggaaatggaaaggaagctttgttgatacttactctataagcattcttctccaatcatctctcaatagctgtgctctctttctgtcagtagagctactgcagcttgcttcctatattgtattctatgatattgcaggtatagatttaattataatatctcactagagcctaaatgctttacatagtagcctatttaattaagtcaccatgtacaaatcatactacctagtctgtagtgctgtaaagtaaatatttgtctgtagcactgtacaattatttatttggtttttcttcatgcatcaagtagcatggttggtgcatcagctcaggaaagctctacatatctctcaccaaatgcctgaggagaagtgttgtatgggggaatctacttgttattttgccttcaaaatatttacatagtgtacattagaatgcttaattatctatatttttccactgatgcaacatttacaatattaactctagcagcagctacagcaatttgagcttttaataggatttccccagggaacttggaagtaagaagtctatgacttgcagagtgaggaaattgcaagttaataacccttgtactctagaaaagacgtcactgagagggaaactgttcacttggttctgcctcattttttctttcctgaactaggaggttggggacctctgtcactggtagtaatttgtttgacataaatatgtttgaataccactgtgtactttaggttgaaatgaaaaataactcaacttctcaggttgcttcttcctggaacttagggagaatgaggatgactgcttctcaaaacctttgtaaagagaatgcctatgagatgatgtgctcccttgacagaccaaggcttgtcctcctcttccaaactatacctctcaaaactcagctttattgcaaactatgcagattggaagtcaggggatggaggatagtgtagcttcaaagagtgcttctttcaaactgtattttctggaaaatcagtgatctaggaaccatttggagattcctcgaaaaagagggtggtgatgatctgtttcctggttctcggtcagaacaaagcaacatggatgattatatgcttggagaattttggaggattctcacacaaattctataatctccaagtacttgaaaaccaccagtttaagagttaaatgagtagagggagaaaagaaatctgtttagttgtgcttgataaagtcacagacatttccagataatttataatattaaaatcatcttcatctaatatgtccaggaatggcagcaggataaatgaggaggatgaaagcaactgtgggtcagggagacatcactggtagtgaacatttaaaatttcaaagttgaaagaatagtacaatgaacaccttttacctagatatactaattgttagtggtttctcttatttacctctttgtctctttctgtgtataaaatcatatatatgttttctttatgttgaagagagcacatttcgatggagagcaatagttttgggatcaaaagaaaaatattatttattttaaaacagtttccatgtatcaagcttgctgttattacaattcatccgtgtttttgcatttattagtaatttattcccttttattattaggtggtattcctttgtattgggtgtactacaacttgtttatctgttcaccaactggatcaaaatttggatttccagtcttttggctattatgaataaaggtgatataaacattcatgtatggttttctgggtaaacatatattctaatctttcttgggtaaatatcttagagtggcattgatgggttgtattgtgaagtatatgcttttttggttgttatttgtttttatttttttgacatggaatcttgctctgtcacccaggctggagtgcagtggcatgatcttggcttactgcaacctctgcctcatgggttcaaactagtcttgtgcctcagcctcctgagtagctgggactacaggcacgtgccaccacacccagctcatttttgtattttttgtagagataggttttcaccatgttgcccaggctggtctagacctcctgggctcaagcaatctgcctgcctcaacctcccaaaatgctgtgattacaggcatgagccaccgtgcctggcctatagtatatgctttactttataaaacactgccaaactgttttccatcatggatgtcccactttatagtcttactagctatatatgagagttcttattattctgtatgtgtgagggcattttgtattgtcaagttttttttaaattttcgtcattctaacagataagtagtggtaacttactgtgattttaatttgtgtttcccttatgactagtaataccgaacatcttttaatgtctttatttgctatccttatctctttggtaaaataaaattgtttatataagtcatgtatcaataaactttgcaaatattttaatttttaagagcacactgacatattggcaagttatgaatacatttgtagcaccggtttaaaaaagaaaactattaaaatatagtagagggctaaaggcatctatcataacatgatttttcttgctgataaattattggttttcatttcttaaaatggtttctaagagatgatgtctataagattcaaattttcttcctcaagaaggaagtttttttaaaaaaataaatctataataattttataatatatatgaaacactatataatgccttaatgtagtatactgtagaacttggggttctatcactgtataattttgacgttgtctggaatttatttttcatggtgaatctttgttttatgtgacttcatctggagttgagaatgctaggttgggtatcagtattttaccttgatttgctcttgaaactttagatcaatcctagaactaatttaattgtcctagacctcaattctttaactggcaaaatggagaaaagagttttatattcagatatttgcaaatgttaatttaatttaaaaaatatctacctagactgtgagttacctatttcttgagataatgtattaaagtacttagaacagtacttcaagcattataagttgtttaatagatgttactgtttaattatctgactaaatctctaaacatacacaaacattcatattattgtcagggttggttggtaaagcaggaactagtttttttttattttttgaaaagcatcagtatgtatggactgtgccaatttggaagagtcaaagtgcatgtgggttagtaaagaagtacatttataatatccacagtgtgacaattcagtatactaagaaacaaagtatcattcatttgctgtcatgtaataatcatatcctaatgaaccaagctaaattatactaaaatgcactaattatcagaagacccagtgtgaatagcttacattcccgataagaaattttattgtcttgttttgctctcatcaatacatttaaaaaaaaaaacatttatcatcttcactctgtgaaagagataggaagagaaccactttgaagtcattccatccacttgtaccaataagcttaaaagtaacaagacaaagcaaaacataagaagatgccttgtctatttcaggatccgcatattaaaagccaatataggattcagtgaacaaatgccttggaagaattccagtgtcatcaaacttatttatctcaaaacgtctccttccatcctttctgatcctctacaaaattaataagctgagactatttgttgcagcacagaggatctgagcatgcttctgtggcttatttctgctgtaattccctcagcagtttatacaggaattctttatctcaccatcaggattctttaggccagaagagaggtcagagaagactggacaaataaactatgggatctaagtctttcttgctaaggtcctaactgcccaagacttcctcctgagagtctactgttgaaattcatatgcaaatttcagtttcatgggattaaccctggctgttgtctttacctgtcagcctgctcagccaggtgtgagttcacccataaaacagtgtctttcacatgctcatttatcaaaacgacatagagactttaggatgccaggtgatatgatgcaaaaagcacagcatttggtttctaactgcatcttttaccatacactgtttttgggcaaaccattcaacctatcttagaaaaagtagaaaaattagaaaaattagaaaaactctacttgtatttcattaggcctttatgaagattaaatgaagtaatgtgtgtatgatggttagtataatccctggccaatggcaggtaataaaagcagtccttagttcactaatgtatcgagagcttatgattttgtgtaaaatttatataatatgtatcataatgtaaactacttaaagatctttataacatggtttaattaaatcagtttcattgagcaaatgtggtgcatcttaaatccattcttttagaccacttagatattacttagtttcataggatatgactttatcataaagcacatattaattatccttaccacaataaaataaaaagtaataaatccttatgtgttatggtgtgtaatcactctcattcatcacagagaccattccaaattgcagattttgaccatagaataatcttttttctttaaaattccagttaccttcttgaatttgatactttctccattagtgaaactattaatagataccaatgaagcactgttttttttaagttaacgtaaaaaacatttaatggtcttttcaaagtgccagaacatctctgaagttgttttccttagtgggatctaacctcctagtgacttgtttatatcagaaagtttattcatgagaggcagtggaaaagcacctagggatctagattgacagaatctagacatgtttcctggcaccaccacttacaaactgtttatttatttgtttatttatttatttattttttgagtggagaaggagtagttctttaacctttgggagcatcaacttcctcatcagtaaataagagataaaacaatatcactgatttctctacttatatgattttatatgattatataacatttacaaatattaattagtatggttgagaagcatgggaaaagaaagataaagattactttacagaaagtaagggtactccatcattaaaatataaaaatcaaagagcttgacttaagtgccgcaggtgtatttcggtatatgtaaagagcatcccattaataaatattatcaaataccatacacattgctccagatttattttataaaagggggaagagtttctgctttatgggaccatgtaagtgagagactggagacaggagacagactaagtggtaccttaagatctcatctaccccacgggtctttatatcacttttacgcttcctgcagaaagataataacaagctcatataaccaatatataatgaagtgaaagttgcctttattcagacaactttacagcatttaaatcaaattgctctttatttcttggtcatttcaaagaatatttaaggatgaaaacaaaaataaaggttattgcttctgctttgagaaagttttccttctcacataatctttgatcaggctattgtgtcacttggcaacttaaaggcaggaaaaagttatatctttaagtccagggattctatttaaatgaattgccattgaaaagtggttattcaaatcaactcacagcttagtaacattgaaaaataaagtaaactacttttgggtttcacaaggatcatgccaagtttctgggtctgtctaaattaataaaaataagacttaggaacctgtatggaaattgtagattaaattaagcaactgcttcatctgaataaagctttgcagagtctaatattatgaaggagctatcttcatgaatacagtgcttgcttgggattcaagggatttgagttttaatgccagctgaatccctaatgcccacggagcacatatgcattcatttgatgctggtagcttttctgtcaagtgggattaataattacctgctctaccacccttaccttatgtattatagtatgaatattcaataccagtgttcacggaatgctctgcctttctgcaaaataacatggcagaagcatttagaaaggaaaaaaagtttctaaaaaagttttatgcgtatcagattttcaaaaatgtgtctcagctttaaaatacattaatgaattttgtattttatatgaaccctaaaaatgctcttgccaagtacttagttatctgaaagctaagataattgttttgggtttcttacagcattgctgcatttgtgtatgttagtcctttgtcaatggataaacaccagattgacatcgcttagtgagttaactctgatgggtggctagtattttcgttttttattgattacaaccaacagatatttattgctggataatgcaaacatgaggcaccatgccatcaaggagctttaatctgggtaaggagagtatatagtcatttggcatgtcaaatgattaatttttcatagatacaagtgttaagagtatatcagtatagccaggcatggtggtttgcacctgtaattccaaccacttgggaggctgaggcgagaaaattgcttgaggccagaagtttgagacaagcctgggcaacatggtgagtgatatggtttggctgtatctccacccaaatctcatcttgaattatagttcccttaatcttcatgtgtcatgggagggacctggtgggaggtaattgaatcatggaggaggttcccccatgctgttctcatgatagtgggtgagttctcaacagatctgatgactttatgaggggcttttccctgctctgctctgcacttttccttcctgcaatcatgtgaaggaggacgtgtttgcttcctcttctgccatgattgtaagtttccccgaggcctctctcagctatgcgaaattgtgagtcaattaaacctctttcctttataaattacccagtctcaggtatttcctaacagcagtgtgagaatagactaatacagtgagactcccatctctacaaaaattaaaaaaataataaattagccaggcatagtggcaagtgcttgtagtgcaagctactcttgaggctgaggtgggaagatccttgagcccagcaattccaggctttagtgagccctgattgcatcactgcactctagcttgggcaacagagtgaaactttgactctgaaaaaaatatataaaagtataaaatacagggccaggcatggtggctcatgcctgtaatcccagcactttgggaggttgaggcagggggatcatttgaggtcaggcattcaagactagcctgaccaacatggtgaaaccccatctctaataaaatgcaaaaattagccaggtgtggtggcaggcacctgtaatttcagctacttgggaggctgaggcgggagaattgcttgaactctggaggtggagtttgcagtgagccgagatcatgccactgcacttcagcctgggtgacagaacaagaaaaacgaacaaaacaaccccccccaaccaaaaccaaacaaatgaaaaacaagtataaaatacaatgctctcccactgctaccaggtggaaatgatctaattatgaaactacaggtttgaagagcaatggttccacttctttttccaaatggctgtgagccttgagtctgcccctgttatggtgacatactgagcaattaatcagtagtgagctatacttgagaatctggtgtactagcaataggctaggtagtctgctgatgtgagcaggtaggaaatatctcctaagacagagggaaacaaattcgcattttaatttttttcacataaaaattaggcaatgatagaacaattacatcatatatttcttatatcatttagtcttcatctccatttgcagatgagaaagttgagactcaggaaggtcgattaattgataccaggtaaacaagctacaaagaaataaaccaagatttagtacatgtgttctgatttggagtaacacattttatatgctgacaaggtccatagatacagaggtatatcattacacaacccgccccatcccctttgcaacttccaactcccagctcctgtgggaaaatatccagggttactggattcacatgttcccttattaaaagcttcctcccaggaaggcttgtaaaattcatttgctcttacacataatggactcatggggtttaatttggggagaataaaccattaaactagaagaattaatttctacttacagaatttggcacattagagagaagagacaaaggggagtattttggaggacgaaaggttatgttccaggcatggaacatagacgatgggctgaatgtccaggcatgtcattgtatttgcaaaccattcattcactcattcattcattcattagcattgtcaaccacctgcttgattgtgcccatttcctgcctttcctgtttctatagatgaattatctgtgtacctggttaaggccaccccttactgtgcactgcattatatcagtactcacccacaagggctttgctcttgcacttgtccccgctgtctcctgtatcatcagttttccattctattaaatggtatccatttataaacatgctatttccctttaaaaagccctctttgacccgaggcactcctctatctattgctgtatttcatttctcccttataagcaaaactctcccaaataattgtactgctctactggtttcctctcctccagtcatcttctggaaacttctaaccaagttttctcctcacaattccactaaaagtgttcttcctgagattatgacattccatgtgccaaatataatgaccaattccttcacttggcctccagaacactgaatgtctttccttcctcatgggcttctctttctcggttggttcctcctcatgttcctcaagtctaaatattggaatgctccagagggttgtggacctcttcatttttgtcctataataactccctaggccaagtatctcaatctaaataacatccgtatgctgatgcttcccaaatttatatctctagccagacttttcctctgaactctagatctatgtctctctccagcagccttcttgacagccaaaacttagcacatccaaaatggacatcatggctttctcccccctacaccatgcccttgatgtaacatgttccaaatcttttccattgcagtaaaatgcaattcaatttttctaattactcaggtcagaaatcttggagtcttgcatgattcctgtttttctctgatatttcccatttcaaatgcatcagcaaatcctatcagctcaacattcacaaggaagcgagactgtcaccacttctcatcaccagctgtcgctgttctgatccaagtaaccattacctcaaacctggattatcaaattaacatcttactggatctcccttctttcattctttcccctttacaattaattcctcttgtagctgccacagtgatcctttatattatctgatcagttgtttcattcctctattcagaatcctttaacaacatcctatttcactcagagtatgggtcaatgtgcatgtaccatgcctacaaatctaccctggtctctacctattacttctccaactcctttccttcccctcacaccatcccagccacactgctgcacttggttctcaggctaagcaggatttcttatcaagacctcggccttttcttgttgtcaagaaaaaactttctccagatatctgtatgggcttttcttttcttatttcaggtggtgtcttgaattcatctaattggagaagactttttggccatctataaaaaatagcagtgcacatctttgcctttctaccatcattatccctgatttgggttctttatagcacctgatgtatatatctacatatatatgtatttttctatatctacatctatttcatatccatatgatctgtatctttatctatctgtctatctatctatctatctatctatctatcatctatctatctaatctttggtattgtctgtctcttttctctctccaattagaatataatctccatgaagacaaagaactttgtctattttattcatttctaaatcctcaaaactagaacacatggtagcacatggtaggtagttaatacatatttattgaatgaataagtgaataaatagacaaatgagttgcagactgtttgggtaccttccagttttaagcactgaggccccatgttgaatgggagagggaaatgtgaacagataatttaaaatattatgtgataaataaaatagtaaaaataactattgcctttcaaagtaattttatctggaaatataaattttaaaatttaaaaaatattatataaaatttaataagagattattttctttataaagagaaagaggggcatttggcaagtatactaaacttaatagcaagaaaacttaaattcatattgtgattacattgtttactagctgtagaatcttaggaaaataactcatctagtctcttcctcccattgtacctagtatactatctaatttattttatagttgtgaagatttagtcagataatatcatacataatgggcattaagtagatattatttttatttcctttcccatatctaatactatactttacattcataggttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagtgttcaccagttggaactcttagggcttgttatttttcagtgaaagacaatcttttaaggagtttatgtcctaaatattttctggttttgcagtagcatacatcagacatagtcattgtgtttggattgggattttcacttttaacatgttctcaaattctctaggcgtttaatgtttccatctggtcctcataaaaggtttcacatttgtaatgcagctcaggctcctactcagagagcatcattataattctatccatgactctagtttgatagagcagatacttttaaaactttggatttgttttttgcttttgtgttctgtcttaaacctaggaataacacttgagtttaatggttgtttctctctgaaaataatcatagtgtgcacaccatgacaacaggctcacaccccacttccttctgtgccgtttgaagctcctagggcagaaggagtaaccacattgtgagcccagtatgaggaaacttagcagtcgtcttactttctcttcattaaacaatctgttctcagtcatcacagatggagaggatattttcaaggacttgaacattttcttgaaatagccaaacaactaggaatctccttttgccatgttaaataataggttctagggcacaatttgagcaaagttcacagcttctagcaaggtctttttatgtagttaggtgtgcagtgcatgtggatttgtttagtgagtatgtacttaagtaacactatatgtcaggcaatgctctaactaaacttcacaaatagtaactcatttaatcctcacagtaactttatgaatacggtactattagtatccccatccaaggatgtagaaactgaggcataaggcaaaaagaccacagctagcaagtggaagagccagaattaaaacctaggtggtctggctcaagaatccatggtcttaactgtgaaactgtgctatgactgaatgtgttcagtgtcagattttcaaagatctattattatcttcccagaattgaattgcacactttgtgtaactctccccaacaccattcttgattcataattggtactcagtgaatgtttttttaccttaggatttaattaagagtgagtgaaatgataactgattttgccatcatttgaaaaaaaggcagaaccaaaggtgaatcataatggtagccagtggacaggcagtttttcattcagaagtgtcaatggatcccgttatccaaggataacctatatttaaggcccagatacttctaagatgatgctttggattctacattttcaaatctggaagaactatcttcatttcactaattgttctttactgatacagtttttttaaatttaagtgtggtgaaacacaacccaaaatttaccatcttcgctatttctaggtgtacagttcagtagtgttacgtaattcacattcttgtgcaaccagcctccagaactcttttcatctttcaaaactaaaagtctataccacttaagcaaccactcctcggtttttcttccctctaagctctcagaaaccaccactttttaaaaaaaaaataactcatccacctatggaaatttaggttgcttccaccttttggctattgtgaataatgctgttatgaacatggatgtaaaaatatctctttgagactctacttttatttctttggggtatatacccagaaatggaagtgctgagtcatatgataattctatttttaatttatttcccatacggttctccataatgactgtatcatttgacattcccaccaacagtgcataaaagttcactttctccacattctgaccaatatttattattttctgttatttttttctgatagaagttatcctaatgggtgttagatggcacatcatcttggctttgatttgtattttcctaatgattcgtgatgttgagcagcttttcacgtgattattggccatttatgtatcttctctggaaaatgtctgtttaagtcctttgtacattttaaaattggcttgctgtgttgttgttgagttgtaggaattctttatatattctaggtattagcccattgtcagatatatgatttgcaaatattgtctcccttctgtggactggcttttcaccatactcttgtgttctctgatgcacagaatttttacatttttatgtagcctaatttatctactttcacttttttgcctatgctttctggtgtcatagccaaaaaatcattatcaaatctagtgtcatgaaccttttcccctatgtttccttatagaagttttatagtttgggtcttgtgtttaggtttttgatccattttgagttgatttttgcatatcgtgtaagattagagtccaactgctttcttttgcagtatccagtatcttttgcagtatgttttgttggtacccagctctcccaacaccatttgttaaagaaaaaaaccatacagatttaagggaaactcagaccacatagctataaacctggagttcctctcatactttggtccaaaccataatagatttagaaagaatcacgactaaagttctcaactgggggctcttttctcctggcgagaacatttagcagtaggtggggacatttttggttgtcacatcttggggtgggagtgggggtagcagttgttactggaatctagtgagtagaggttacgaatgttgctaaataccctgcaataaacagctccctaaagcaaagaagtatctggcttcaaatgtcagtagtgctgaggttgaggaaccctggcctagagtatagggaagtacaggttatgttgtaggactggaaaattggggaatctcctttttttgccatttgagggcttgatgatcattgcacaggtgactacctaagtgtccaattattgactacttggtagttggttttttaaagatacctgaatttcatatacatccagttaggttttaacaacagaatgctattttgagcttaacttttgcctttaagactgttcttctcactttctttcaccataattttgtccatttatgcattcattttctcttttctgtaagaaaacaagtaaataattgtaggattgatcataagaattggagtcctattagactatacaataatcaaggattacagaaatgcctagagattgtcttggcctagctgctcctcctacttctgagctacttacaggagaaagatgcccaattgacaatataaacatgaaattaattactttataataaatagttaatttataacacccaggcttgtgtttaaaattccagagcttggctctctgctgaactgagctggagtacacgacttcagcccaaagtaattttatattgggtgtttatggtcagggaaacttcgttgcagaggtcatgcttgagctgagacctgactggctaaaagcctcaagccatgagaacatttggaagaagagtatttccacaagaaaaaaaaaacagaaaattaaagtgcaaagatcttaaggtaggaataaacttggcatgttcaagaaatagaaataaggccagtgaggctgatgctctgagttactgaggataacagaagtatgatgcaactgctgaaatcaaattaatatttctttttccagaggaaaaggtggggggtgtttgattagaacttctcctggtataaggggagattctctcaaccttggacacctgaagttggcaggtgggtaaagcattggttttgtattgcatggttggttcacgttatcaattactgtttaagtatttatttattcacttttcaaaaactgctaataattttctatattctaggcaccattatagggctaggcattggagaaattgagatgcataagacaaaatgcttatgtttaggagctcgtagtgtgcatttatggattggatagttggatagaactcttctaattattgactatgtgaccttgggaaagttattaaacctctctgtgtctgagtatctgcatctctaaaatgagatatttattgcagttacttcatggagttgttgtgaggattaagtgagttaatacctttaaagcagcacctgagacgtaataaccactcagtaacttagctattattgttgtggtggttttacagaagcacaggaagagactcattaattcagtctcaaaggttagagagaatttaaaagaaaaggtgaagtttgagttcattcattaactcatcatttgtttgataaatatatatcaagtgcctactgtattccacatactacttttctgctacggcacatacttctttcttgctgcctggattatctttgacaccattattcagctgtcaaactttaacctccacatcatcctcttcaatgtaaccttcttcagtttaaggaagagtatatattagagataaaaattgtacaaataataatttagttacaattgtcaaccatgatatcaagtgtaatccagtcagtgagaggaaaaatgcaaggaacatctaaaaagtgtgaaagataaggaaatgtcttagctaagagatgcaatatatgagagataagaaatgcaaaatatcataagaaaaaataatcataatcatcaactttgtaggtttcccaaacttcttatagtttatgtatttatcttctaattttctaagagttgagcacttataaccaaaagggcttcaatgcttgcttttgagtcagccataagtggataaggagcaaaaggatgcagcttgctttcaacgccaagtcagacttgtgttggaggaggtgtttagggatgggttttctaagggagaagaatatgtagggcacctactgaaggagaagagtatgggctctttggccattcttgcagagaaaacaacagagtgtgggtgggataaggagcagaactaggctagaatagggagcattaggttggaacaggagggctggagggtagttctctggaattttgattgtgcctatataagcaattctttgcctttttttggatttacatacttgatgtcttctttcagactgttgaatattagagcaaacatttgagagcagagaatttattgtatttgtgtaaccagtatctctcattctgctgcatatatataaggcctttagtaaatgtttgctgaatttccctatcaatttatatatcaattaatgagataataaaatgagattggaagaagaggatcatatccagtagacctagcctataatttgttcaatattgatgtgtttaaaaattaaaaaagctacctagataaaaggccaaaatataacatgtagttatgacagtcagggtttatttagcatttctataagccagtagcctttcaatttattctgcatgtattcagtggtggtggtagacaactggttttgagtcaaaattgcatataggatcacattttcttgctaattcaactttcttagttctaggttggtaaatattgtagaaaaagcaaaatgtttcccacatgtctacagattttcttgctttaatagcttcatttgtgattttgggaaccagaatatttttaaataaaacaagtcatttattcctggaataagtccctatgccatgcatgtcttgagattagaaactcagctgagagcaactagtgattattccctgactacaactatttgtgagatacagaaatcttaatgatgataatccagtattagtgagatttttaaaaaaaatatatatatatattcaagggtgctttccaagaacaatttatacctcaccaattatttactgagttgtatgtggaaattggaattaactggcaccatttatttcagttacattttgaaaccacttacagattgacacctgggtaactggctatattttatatagctctgcacggatcatagagttttagaggtagaagttagttttttcttttagtgttactcttgtaacaggatgtatttaactgtttcagcaaaaggaagacagacgtttccatctaaagagtatgtggttttaggccgggcacggtggctcacacctgtaatcccagcacttagggaggccaatgcgggcggatcacgaggtcaggaggtcgagaccatcttggctaacaccgtgaaaccccgtctctaccaaaaatacaaaaaattagccgggcatggtggtggcgggcgcctgtagtcccagctagtcgggaggctgaggtaggagaacggcgtgaacccaggaggcggagcttgcagtgagccgagatcgtgccactgcactccagcctgggcgacagggtgagactctgtctcacaaaaaataaacaaaataaaataaaaaaagagtatgtggttttgacttttataatacagtagattctgcttgaataaattttaagattaagtattttaatgtgctttgtgtagatacaacagaaatatcaaaggacaattccaatatgaggttaatattttaatatcttatatcaaaatatctgagcacctagaaactggcagtgacaattaacagcttaaatgattcttcaaataattcaatttaagggtaggatttggaaacaagtagcattatcagactgaaaataacaccattttataagaatgtctatggatacaatcttaagttagtggcgtatgccttttatatatttatccaaccattatcctctatgtgcaaagaatgtgatctaaagaatgtgttaaggcagataatacgtgtgtattataataattaaaaggttctgtgatacagactctgacctgaggataaagtacaagatataataactaccataattttatattttataatgataaaactacctatagaatgaaatacctcatatcttactttttgctgcttttgggttaattatgcacttaaataaatggatagagttcttacttaccgttttcacatttaaattcatcctgatatgatgacatatagttttaatgacctggttaatactgatgaaaactttcagtggcagtgcctggggccagtagtctgctgcatattttatttttatattattgcaataataacaaaagatattggtgcttcttttcacctacaaataatcaattaaggaactgaagcttaatttatttaaaaagcaatttttagaacaagtcgatagttcacatagagctatttaaatgtcccatgcaaattgatggaatgttctagcaaatattatttagaaaattattattattgttattcttttttttttttttttttgagatggagtcttgctctgtcacccaggctggagtgcagtggtgtgatcttggtttgctgcagcctctgcctcccaggttcaagcaattcatctgcctctgcctcctgagtagctgggactacaggtgtgcattgaaatgcctggctcatttttgtatttttagcaaagacagggtttcaccatgttgggcaggatggtcttgatctcctgaccttgtgatccgcccccttgacctcccaaagtgctgggattacaggcatgagccaccgtgcccagactagaaaattatttttaatagctcacattctttgcccagtcatttcacaccggtattccataagagttcccttgcagccagaaacagaaaggattagattttaatataatctaacaatattcttttgttgtttaatcacactttatagtgctaacccaaatctgatctggaaatctgttcagatccagtttgaggaactagttgagtagacaatactctcagagagctacaggaactaaatgtacatctcttgttcatttgtagacatcattcaagcctcaggcttggattcttcatttaggtctgccagtcaacaagaattcactgggtggttactcatgacagagacctgtatgagactgtgtacatagaagtcaaagaaaaatagttactatcgacaagcatatattgatacatataggcacaatttttctttcaaaagtttgcattactgttgaggaaagtagacatctatatttttataatgcctatttgaaatttgtccaggaaattctgttgctggtcaacagtgtagctaggcctggtataagaacaggtcaggtacagtaggattctgattaaggcaggtgtctggcataaaaatagtgaacgttaggaaggtaggattcctggtatatagcattacttaaagaacactttgaactcttttttttttaatatactttaagctctacggtacatgtgcacaacgtgcaggtttgttacatatgtatacatgtgccatgttggtgtgctgcacccgataactcgtcatttatattaggtatatctcctaatgctatccctcctccctccccccaccccatggacaggccctggtgtgtgatgttccccaacctgtgtccaagtgttctcattgttcaattcccacctatgagtcagaacatgtggtgtttggttttctgtccttgtgatagtttgctgagaatgatggtttccagcttcatccatgtccctacaaaggagatgaactcatccttttttatggctgcatagtattccatggtgtatatgtgccacattttcttaatccagtctatcattgatggacatttgggttggttccaagtctttgctattgtgaatagtgccacaataaacataagtgtgcatgtgtctttatagcagcatgatttataatcctttgggtatatgcccagtaacgggatggctgggtcaaatggtatttctagttctagatccttgaggaatcgccatactgtcttccacaatggttgaactagtttacagtctcaccaacagtgtaaaagcgttcctactcctccacatcctctccagcacctgttgtttcctgactttttaatgattgccattctaactggtgtgagatggtatctcattgtggttttgatttgcatttctctgatggccagtgatgttgagcattttttcatgtgtctgttggctgcataaatgtcttcttttgagaattgtctgtttatatcctttgcccactttttgatggggttgtttgattttttcttgtaaatttgtttaagttcattgtagattctggatattagccctttgtcagatgagtagattgcaaaaactttctcccattcaataagttgcctgttcactctgatggtagtttctttggctgtgcagatgctctttagtttaattagatcccgtttgtcaattttggcttttgttgccattgcttttggtgttttagtcatgaagtccttgcccatgcctatgtcctgaatggtattgcctaggttttcttctaggatttttatggctttaggtctaacgttcaagtctttaatccatcttgaattaatttttgtataagatataaggaagggatccagtttcagctttctatatatcgctaggcagttttcccagcaccatttattaaatagggaatcctttccccatttcttgtttttgtcaggtttgtcaaagatcagatggttgtagaggtattatttctgagggctctgttctgttccattgatctatatctctgttttggtaccagtaccatgctattttggttattgtagccttgtagtatagtttgaagtcaggtagcgtgatgcctccagctttgttcttttggcttaggattgtcttggcaatgcgggctcttttttggttccatatgaactttaaagtagttttttccaattctgtggagaaagtcattggtagcttgatggggatggcattgaatctataaattaccttgggcaatatggctattttcacagtattgatacttcctatccatgagcatggaatgtttttccatttgtttctgtcctcttttattttgttgagcagtggttagtagttctccttgaagaggtccttcacatcccttgtaagttgtattcctagatattttattgtctttgaagcaattgtgagtgggagttcactcgtgatttggctctctgtctgttattggtgtataggaatgcttgtgatttttgcacattgattttgtatcatgagactttgctgaagttgcttatcagcttaaggagattttgggctgagacgatggggttttctaaatatacaatcatgtcatctgcaaacagggacaatttgacttcctcttttcctaattgaataccctgtatttctttctcttgcctgattgccctggccagaacttccaacactgttgaataggagtggtgagagagggcatccctgtcttgtgccatgtttttaaagggaatgcttccagtttgtgcccattcagcatgatattggctgtgggtttgtcataaatggcttttattattttgagatatatgccatcagtacctaatttatttggagtttttagcttgtagggctgttgaattttgttgaaggccctttctgcatctattgtgataatcatgtggtttttgtctttgattctatttatatgctggattacatttattgatttgcatatgctgaactagccttgcatcccagggatgaaaccaacttgattttggtggataagctttttgatgtgctgctggattcggtttgccagtattttattgaggatttttgcatcgatgttcatcagggatattgatctaaaattctcttttttttgttgtgtctctgccaggctttggtatcaggatgatgctggcctcataaaatgaattagggaggattccctctttttctattgattggaataatttcagaaggaatggtaccagttcctctttgtacctctggtggatttcggctgtgaatctgtctggtcctggactttttttcttggtaggctattaattattgcctcaatttcagaacctgttattggtctattcagggattcaacttcttcctggtttagtcttggactcttaccattgattgcgtggggattgtaaatggtgacaatctgttggtaccttggagagctcccaatagcctctatctttgatttgttaaggtgctactgaggctttttgttgtcttagctttaggcatactttataagctctgtcatcctggtggatctaaaaggtagttaatgcagctgtacttcaatttgctgtgttaggctgtgtggtactcggacattatctacattctgttaaaaccttttggccttcacaccagatcttaggcaatatttttgggttcctcaaagtttcctatgcactaaggaggatagataggcttatcagttcacaatgttggcacactttgtctccaggggaaagagcattttttggcacagacaaaagaagtattgccaagaacaaggtagcatatgctcagatccaattagtggcagagacaataaacacagtaagagttcagagaaggaagttgtttctgagggctatggaacaagtgaaaagctccatgcaatagcaggccctatagtaatgaaagcattcaggtggaagagggaattccaggtgaaggaaatggttaagaacattctattgatttcaattgaagacaattacaaggcaaaatttttatttttaattagcctataatccacctgagggagaaaagaaccatgaaagcagaaaccaacattagatcaactaccatttatgtagtaaaaagagtaataagatatagtgtaaacttaataataatgtttaggagataaagccttaggaataaaggatctgtgttgggtagggttatttagggcactcttgatttcagttattattttgtttcttatattagtacttcattactatatgtgtctcaagtggagagttgaactcaggaaaacagcctcagaaagaaaaagaaaaaaaatactacatactgatctcagttatacatattttgataattaataatgtgaattgtttcaggcggtttattttttaccttttgtgctgcctacccactacttttcatattccagccagcctcttgactttggtgttctccattctgagagactgtccatacaagtatcctccattaatgtgaagtagagttgcttatacttacaaaaagtcctagaggatagaaaaacaatcaataatgggtgcaaataatagataaacactatttttgatagtattcagtaggtctcttaccaagttattttcagaatatctctaaaaaatattaatctagcatcacaataccttagagttggaagtgcttcagagttcatctcatttaccccttactcaatcagatagccatccaacttgcatcacttctgtgattactaggttctgtctgaacattttcagatatggaaagcttgctacccccaaggaagccattctgctgttgaccaacacttagaaaggtattgcattaaactagaatttgtccctatgactttaaatagatttttccagtttctttccaaagaagctacaccaactgtgtcaattcatacgtttattcaacaaaatgtacaggtcatataatatatgcaaggaattttctgagccctacaaatgataacttgataaacatggatataatactgtcttctatgagaaggcagattcttaatacatttttttggatcagtaaatagatggatagatgaatctttttcaccattaaataatggtaaactcttgatatataggtaaagttggtgtattccttggtaagtgaaggatgtggaatgagcattttaatatcctaatatcctctagaatggtgatgtattttatttcatagcctatcagtgtaaaaaagaggcaaatacaatatttatatatttattttcaaattataaatatgaattacttaactaaagtattatgtatatgaactaaatagatgtttttaaagatttaacataagtatatatagctatatattttaatagtttatacagtgccctatataacccacaagtatgatttatagctttgttaattatttaaatatactgcctttctagaaaaccagcattttagttgtccattacatcttagttgttttcctaactggagtcaagtgatcacaatatggtagcatttaagatttggcttaagaacatattagaactcaccaagtttttcaaaaaataggctttgagacaatattaagaaacagagtacttcaaggaaagatgtgatagaagtaatttatgaaaaacaatttatatgaaagctttgtactttcaatataaaagtactatagaagtaaaacactataaagatggataaaaaggagaagtttgaaactgtcaagtaagctaaattccttatctctttacaagcctaataacccagttggaataactcatagagtataaatctgggatctcattaaaaataaatattttccagtaacacaatgatgcagaggcaaaatgtatgaaatagaaaataaaagaaagaaaataatgacttcatactcttcttacctattgtctgctatgccagtttggattaccacaccacaggtttagcttgagactgaactcataatttcttcccagactaatgtttccatgtgagtttcctaattctgtgtatggtgtcaccattctctgggtgtcccaggcccccaactttaaacttaacccctgttccccatttcatgactaattgtttaccaagttattttgattctctgcaatatccagcaagcaaattatcccatgtacttaggtacagtaaaaatttaggaccgctaacaaccacagaggtttgtgctttaagtttagttgtgagctctgaaaaatgttagagtattaagtgtcaaacttaagatggcaagtccattttcataatttagtttttagtttcaattttgaagaatctcatcaaatgtatatgtctcagaatataaacctttaataatataattatttttctggtcagttacatgttttattgttttcttgatccttagacttacaacttcaaataaaaatgtaaatatctgcaacatttgggcaatattgctttataaatgaaactgtacatacaagttcagtttttcacttttacaaacctaggaaatgcccttgaagcatgaatgacagtgtttcctcaagaggttcacatcctattacagtagaaggcatggtcaggactcatgcctacactttcagctttgacccaccctggctttggatcttgggtaaatggttagtctcactcagaataaaacttatactagacttttcatgtcaatggtccctttctatgtctagctaacattgtgcctcatgtcctctattatccccatctggccctaattaggtgaggctgtatcatggcagcatagcttcgggattaagctctcaggcttgaagtcagattctttgggtatatgtccctgttctgctacctatggtaacaggacaaaagcatttaatctctatgttttgttgtctgatttgtaaaatgaggtaataataacacttaatttatgggtttgttgtgagaataccacaggttaatatataaaagttctgaggactagcacataataactactatgtggttgctattattgatattcatataaagcactcagcaatgtgcctggtatatagtgtgtgctcactaaatattaactgttattctcattgccagactccacttcaatttctgtaagctttatttcagactttggtcacaaaacaaaatagatgaaagtatatcctcataacacaaatgcgtgttcttcacctcaacaaaccaaccaattatggcgtcctgagggagggtgtgtgcgtcaccttgcaatgttgtaacatatgcctgcaaaggactattctacaatacatggctcagtaaacttatgtttttcttaacagctgcaaactaagatttgttttgaataatcctattagtttgtgccagtgttactgtgaaagtgcatattcaaattcttggcctttgttttacctgttagctttaatgtattttactttttaatattataatctactaaaatctaaaaatatgtgtattaatctgtttcatgctgctgataaagacatatctgagactgggaaggagaagaggtttaactggacttaccacatggctgcagaggcctcagaatcatggctggaggaaaaaggcacttcttacatggcagcaacaagagaaaaatgaggaagaagcaaaagcagaaacccccgataaacccatcagattttgtgaaacttattccctatcacaagagtagcacgggaaagactggcccccatgagtcaattacctccccctgggtccctcccacaacatgtggaaattctgggacatacaattcaaattgagatttggattcagacacagccaaaccatatcattctgtgcctggccccaccaaatctcatgtcctcacatttcaaaaccaaacatgccttcccaacaatcccctgaagtcttaactcgtgacagcattaacccaaaaatccacagtccaaagtctcacctgagacaaggcaagtcccttccacctatgagcctgtaaaatcaaaagcaagctagttacttcctagatacaatggaggtacaggcattgggtaaatatagccattccaaatgggagagattggccaaaacaaaggggttatggggcccatgcaagtccaaaatccaacggggcagtcaaattttaaagctccaaaacgatccctgactttatgtctcacatccaggtcacactgatgcaaggggtgggttcccatggtcttgggcagcttcacccctgtgactttgcagggtacagccctccctcctggctgctttcacaggtgggtgttgagtatctgcgacttttccaggcacatggtgcaagctatcggtggatctaccattctagtgtctggaggatggtggccctcttctcacagctccactagacagtgccccagtagggactctgtgtgggggctccaaccccacatttcccttctgcattgccctagcagaggttctccatgagggtgccgcctctgcagcaaacttttgcctgggcatgcgtgcattttcatacatcttctgaaatctaggcggaggttcacaaacctcagttcttgaattctgtgcatctctgggctcaacatcaagtggaagttgccaaagcttggggattccaccctctgaagccacagcctgagctgtttgttggctcctttcagccaaggctggagtggctgggacacagggcaccaagtacctaggctacacacagcatagggaacctgggcctagtccacaaaaccaccttttcttcctaagcctcaaggcctgtgatgggaggggctgctgtgaaggtctctgatgtggcctggagacattttctccatggttttggggattaacattagactccttgctacttatgcaaatttctgcagccagcttgaatttctccccagaaaatgggtttttcttttctattgcatagtcaggctgcaaattttccaaacttttatgctctgcttcccttataaaattgaatgcctttaacaacaccaaagtcacctcttgaacagtttgctgccttagaaatttcttccatcagataccctaaatcatcctttttaggttcaaagttccacaaatctctaggggaggggcaaaatgccaccagtctttttgttaaaacataacaagagtcacctttgctccagttcccaacaagttcctcatctccatctgagaccacctcagcctgaattttattgtccatattgctatcagcattttgggcaaagccattcaagaagtctctaggaagttccaaattttcccacattttcctgtcttcttctgagcctttcaaactgttccaacctctgcctgttacccagttccaaagtcacttccacattttcagatatcttttcagcaacgccccactctactggtaccaatttactgtattagtcctttttcacactgcttataaagacataaccaagactgggaaggaaaaaaagtttatttagacttacagttccacatggctgcagaggcctcagaatcatggtgggaggtgaaaggcacttcttacatagtggtggcaagagaaaaataaggaagaagcaaaagcagaaacccttaataaacccatcagatttcgtgagacatattcactatcacgagggtagcatgggtaagaccggctcctgtgattcaattacctctccctgagtccctcccacaacacatggaaattctaggagatacaattcaagctgagatttgggtggggacacagccaaaccatatctgtatgtgattagataggaagcttgctctaagttggtagaatgtaatttaatgcaagagagtttgagttgaaacagtttgagataaatatgatttatattacaaatattttacagcaaactttttcaatttgtcattattgaaaatgtttcagataaaaatgaaagatgaagagtctattgactcttttttcttaagctaaaatagacaataccaatattaatttatatatagtatgtatgaatgttacttttgctttttgatatgaaatataagtcatatgttactataataataagcactactgacaaagtttcttcttaattgtaatctttacagcataatgaattcatcttcctacatctagacatgcaataatgaaatattttaaatactgaatttaggatgaatttgattttatatatgcttaaatttgaaataaccactttcaaatttctcacccagtgattataacaataaatgatctttgctagatatacaaaggtactttcaagcaatattccttttgttgcttaccacaattatgaagtctaatttcagaaatctcagattaagtgggatagtcaagcatagtgacagaattggtatttaaacctggactgcttcaatgcctaatctgttgagggtttttttttttttttttatcatgaagggatgttggattttattgaaggctttttctgcatctattgggatgaccatatggtttttggttttgattctgtttatggggtgaatcacatttatttatttgcatatgttgaaccaaccttgcattccaggaataaagcctacttgattgtggtgaataaaccttttgatgtgctgctggacctggttttctagtattctgttgaggatttttgcatctatgttcatcagggatattgacctgaagttcccttttttcagtgtgtctttgccagattttggtatcaggaagatgctggatttgtaggatgagttagggagaagcccctcctccttgactttttgaaagggctttggtaggattaatatcagttctccttgcatgtctggtagaagttggctgtgaagccatctgttctggggcttcttttggttggtagtttttgtagttttttaaattactgattcaatttgtgaactttttattgttctgttcaggtttttgctttcttccttattcaatctactatttgactcagcaatccactactgggtatatacccaaagaaaaataattatataaaaagacatatacacccatatgttcatcgcagtgctattcacaatagcaaagacatggaatcaacctaggagcccatcagcagaggataggataaagaaaagtggtacatatacaacatggaatacgatgcagccttaaacaagaatgaaatcatgtcctctgcagccaacatggattcagctggagaccattatcataagtgacctaatgcaagaacagaaaaccaaaaactgcatgttctcacttataagtgggggctaaacatttaatactcatgaaagtaaatacaggaatgatagaccctggggaccactagaagagggagggagggaagagggcatgagctgaagaaccatctgttggatattatgctttctgcctgggtgacagggtcattgggaccacaagcctcaaccacaggcaatttacccatgtagcaaacctgcatgtatatcctttaatccataataaaagttgaaattaataaaaataaaataaatcgtacaaaaaaacccttggacttctaatgccaaagactacatttccaggtatttaaagtaaatagactaaaataattgattagagaattttaggtgagaggaaaacaccctttctctgtggattaataaaaacccaattaatattctttctttttattctcacctctcattcctttatagagaagagcaatggaaagaagaagggagcagggaaacatggtcaaggaaggaaagtgattctcaatcaggagaaaaggtagctctcactggtgaaaatttggtgcagtacaaccaaaatacaaaatccagtttacaaaaaatgaaatatttcagtgacccatatatttatttttctgtgtttttctgcatgggtttgggttttttccctattatttcagaattgggctgtagcctgcaagtaaattaaagaacacttgttttcatttttaattattgatcagctgtctctaaggttcatttactattaatgcagaggtagaattgtgttttttccatactctttagttcttgatgaaccccatatggttctggtgctcacagctcttcaataattcaagattatcatggaaaaataatcaagttttgaaaatctagatcagtggttttcaaagttttttctcctgtcaacaatagaaatattttttttctagttaaattatgatctggactcaaacttttaaactgtgtttaagtggagctgcttggcttttgtataagaaggaaggtttctccatgactcaattaactttccatcctctccggtgaccccagaggtagctctttcaaaggttggggctcctgttgaacagaatttgaagtacactgagatagatgaaaagcagttaggatgtagctcaggctgagttctgagatagagctgatctgggttcaaaccatgaacctcaccatcaactaggcttgttaccaacagcaggtagctgaacttctctaatatcagtttcctcctcagtataagtggggagaaaataatgcccacctcataaaactgttttgaggattgaaataatgcataagaagtatttggcatgtattgttacttgtgtcagttaataatctcttctgagacatattctatagtgatacaatgttggcagtatgatgaagccatagagataatgctactcagagtacagactgctttcttgatgacagacctgaatatttcaaattataatcctaggaggctatagtttatgcttttttccaactctaagatttgtataaagacacatataaagtgtatccattttgaataatacatttaaagggatactttatcccctaagatgctgcactggtgaaaatccctaggataatgtgtaatcttctttgacagtatgtgcacgtaaaatagtttcacaagtgcaagatggcaaatgtaatcttcccatgtgcaaatagactttattccattgagggtagagtctctacagctgagttttttaatgccatggtatcatttatctaattttttttttttttttttgagaaggagtctcgctctgtcagccaggctggagtgcagtggcgcgatctcagctcactgcaagctccgcctcccaggttcaagccattctcctgcctcagcctcttgagcagctggactacaggcgcctgccaccacgcccggctaattttttgtatttttagtggagacggggtttcaccgtgtcagccaggatggtctcgatcttctgaccttgtgatccacccgcctcagcctcccaaagtgctgggattacaggcgtgagccaccacgcccggcctcatttatctaattcttaataagcaatccattttgctttgtttcttctctccctcgcttccttctcttcttccttgcttctatttggtgccaaacaccgcgttttatttatgatattaaaaagtaaagtgagtgtgatggtggctggtcacccattgttttgaattaataacagaaaaaaagaaatattttagtggcccatatgtttatttttatgtgtttatgtatgtggttttggggttttttagtgccttctatccctagaagtcactttaatctcaagactgtccaaataaacttttcagcaaaagcatcaggtgagaagtctgggagaaaccatcctataaaacaatatgaacagaatggagcagtgaacacaatgctcccattctttctctgtcctccaagccatctttcttcttatagactccctgccatgtgttgcctggctcaggttctacatgttcatcctgccatattggcactggcttctttgaattctgctctagttctgagacggtggcgctttattcactactaactcccaggaccagtgcatgctattcttcaatttattgtgtagattaaaaggtatcttcttaaaaaatgatgcatgctgctgggaaatacagacactttaattttacttagaatcttacttggaatgtgttagtagccagataaacaagcaagactgactcaggaaagaagccagagaaagggtaagtgtgtcaagcaaaagtagacagcagcaccaaattgaaaaaaaaaaaaatgagaggaggagaagaggctaaaggtacatctccttttacttttctttctttctttctttcttttttgtaattttgctttaagctttccattcaaattatcttatgcttcttggactagctattaatattagacttatggttgattagcatttcaaagagatagaggcaatgtatgatgattctgagtcacctactccattgaatgacagcttgactaacccagtgacacatacaggtctcagccacacccctatcctgaacgtgtcttctcagaattctctcccttaatcttgatctttgtgttcttctttgactttccattttatgtctcttttgcctcttgtaatgaattctctgttttcctaatcttcctccttacctctttcaaagtctgtgtatttctttctccctctttgtgagtgagctttctctctctctttttctctaatattttgcatacccttaattcttatctgtacaagccatggattttgaattatatatttgaaatattaactgcagctatttaataaagatttacaactctaggtttctgttaaataacaagtagttgaaagttaaaaatttcacattttacaggagaggttttttgctatgtaagccacttcttctttggactttaggtcagaatatttaagtagaaaaagaactatcagttctaatttaagctgttattttaatgttatagacagtaaatttaaattattcatggcattatggaatattcctgggtttcctgatcctctagttttaggctacagtgtttcatgaactggcttaactacaaaaaccattatctaaaatccataccaaacattaaaagggcagaaaaggggagaaggcatacagacattgaaaaattctgcacaaacttcagcctgtaagtgctttgaactcacacacaacctttaatgttttccttgcattctttgaatgaacctcacttttctgttcagaaccctagcatgtctaggaacttacattgcatgtgcttaatcatggaagtgaccatatgttctttttatttctaactctatttggctctgtctgccctgactttttcctctctggtcataaagtttttatcttaccattcagtttctcccagaaagcctctgaaccagtccaactttgttatttctgtctgctccccgagtccttgatggaagtgtgggtgaggatgggggactgtttaaacttttcccttttaggttaccatcttatctccttgctctcccagtatcaatattctctctgctagagagcagcttctcaacctacttgggtcccttagggatgtctctgcatactaatctttcagtacttatctgcaatccattacttaccctcattaaatacagtttggatcatttcccagagtcaatggcaaaaataaaaaggaatttttagtttaattaaagactggcaccattttttaattaattttttgacaaatagtaattgtgtatatttatggggtataatgtgatgttttgacacatgtttagattgtggaatgatcaaatcagagtgattagcatatccattacctcaaatatttgttatttctctgtggtgagaacacctaaactcctctcttttagctattctgaaatatctgctacattattattaactatagtcatcttcctgtgcaatagaacaccagaacttattcctcctatctaactataactttgtacttattgaccaacatctcctcttttcctgttcacttcccaactcccagcctctggtaaccaccattctcctctctacttctatgagtttaacttttttagtttccacatataagtgagattatacagtgtttgtctctctgtgtgtggcttatttcacttaacataatgtcctccaggttcatccatgttgttgcaaatgacagaatttcctgtttttgtaaaggctgaaaagtattccattgtgtgtgtatatatatgtatatgtatatacacactttaaaattattcatcagtttatagacaaaagttatttccatatcttggctataatgaatattgctgcaatgaatatgggagtgtagacatctctttggcatactaattttaattcctttgtgtgtacacccagtagtggggattgctggataatagggtaattgtatttttacttttgtgaggaacttccatgctagtttccaaagtggctgtactaatttacagtagcatcaataatataaagtcttccccttttttccacatccttaacaacatttgttatctttcatcttgatagtagccaccgtaacagggtgaagtgatatgtcattgtggttttaatttgcattttactaatgactagagatgttaagcactgtgggcatttgtatgtcttcttttgagaaatgtttattcaaattccttgcccatttttaaagttatttttttccttgttattgagtagtttgagttccctgcatattttggatattagccccttatccagcatatgatttgcaaatattttctcctaatctgtgggttgtctctttactccctgaattgttttctttgctgtgcagagttttttggtttgatgcaatcccatttgtctatttttgcttttattgcctgtgcttttggggtcatatccaagaaatttctgcccagaccaatatgggtactctcccctaagtactttttagtagttttacagtttccagtcttatgtttaagtccttaatccattgtgagtttattcttgtattaggggtgagataagagtccattttggttcttctgtatgtggacttctgttttctcaacagcatttattgaagtgactgtctttttctcattgtgtgtccctagtgcccttgtcagaaatcaattgactattgatgtgtgggtttatttctgtgctctctgtcctataccattagttgaggtgtctgtttttacgccaatatcatgctgctttgctgttttgattactgtggctttgtatattattttgaaatcctgtagcatgacgactccaggtttgtcctttttggtcaacattgctttggctatttggagtcttttatgattccgtacaaattttataattgttttttctgggccaagtgtggtgtcttatgcctgtaatcccaacactttggggggccaacacaggcagatcatgaagtcaggagtttgagaccagcctgaccaacatggtgaaaccccgtctctactaaaaatacaaaaagttcgccgggcatggtggcgtgacctgtagtcccaactacttgggaggctgaggcaggagaatcacttgaacctgggaggtggaggttgcagtgagccaagatcacaccactgcactgggtgacagagtgagactctgcctcaaaaaaaaaaaaaaaaaaagaaataattgttttttctatttctgtaaagaatgacattgggattttgataaggattgcattgaaactgtaggtcactttgggtaatatggaccttttaaaaatattaattcttccagtctataaacatgggatatcttttcatttgtcatcaatgttttatagttttcagtgtagagatctttcactttattggttaaatgtagtcctaaatattttgattttttgatgctattataaataggattgttttcttatttctttttcagacactttgctgttagtgtgtagacataccactgatttttgtaagttgatttatgtatcctgtaactttactgaatttgtttttcagttctagtagttttttttggtggagtcattacgattttctttatataaggtcatgttgtcagcaaatgaagatgattttacttcatcatttcctattttgatgccttttatttctttctcttatctaattgttctggctagtacttcgagtgctatgttgaaaagaagtgatgagagtgggcatccttgtctttttcctgatcttaaaggaaaagtcttcagctttttaccattaaatatgatgttaggtgtgaatattggcatcattttcaacaataaaaatgtttttaaaattttgtgttgtggcaaaaattggctatgcaagatatttttatcattttataaaagattatggatcaaaaaatattaatgaaaataaaacaaaatatattaaagcttcctctattatctttattcaacttaggtttaaattgtatgataaattagaaatggaagatattaagaaaataaaaggctttatagaacttttgtagaaatttgaaagatttgcataatttgtatagagtaaaattggggacagttttccatgaggtcataagtacaggataggagggcattaaggtggtggaataaaattggtacatactggtatgggacataattacagcaaaatgtgtgcagggggtaggattcatttattcagtcagttggacagtcaattatatattttacaaattgtctagttagtgttattttgtgccagtcattatactaggttttgggatttcagtggtaaataaaaacagacaacatgaagtataactgtataagcattcattgagtaataacacaataatttaatgattatgtatgtgtttggcaggaagacaaccgaagccatagaaccacatagcagggggtcttgttatgcagagtgtagaatcagagatttccatgatgaaatgatattgaattaaatattaaagtgggagtgaagagaacatcctttctgttttattttgagattggcaaccctcggcattcttaaagttcaaggggaaggattcagtacctagggaatagtagaacatatggaggaaaaaaagatatctgcaagatatctgagatggtagaaataggaaatgaagttgtaggattttgtggtggggaagcgggtcacagtttagtgctttccttaagacaggaaaagatacttgtgattgttttgtaaatagactcttgaacagggaggaaactggtgaagctattgctttaagaatggtggcaatagattgttgagcgattggaatagcttaagagtgaaagaccaggtcaagtggaagatagctgcatctaagcagtcattgagtaataaggtcatgaatcgagatagcttaatgtccacgtgaaaattatcttctatgttttctgttttcgtgacatgttttcactcctattttttttaaaacaaaatgcagttgtgtgtatctcagaagtcctattcagtaaaaattttccctatactctcaggaagagttttattgcaactcccccagaatcccacagaatttgatttctacctcttagtgcacactctatgaaacaatgaattgtttatgttcttgttacctgaataaaactgataatttctcatgggcttggagagttgttatttattttttatagcatacacaaggcagaatttggaaaatattggacacacaatagataacaattagatattgttattgattgactgagtgcctagatgaagagaatcaacatttgcattttttatattttccacaggtagcctgtcttgttgcttttcttcttagtgtatctttaagtaaaagacttcataatttggaaaatgccaatacctttattgttgaaatcaattgcatgcctaaagcagacagattaactgcttttcaagacatagagaattcatggtaactggtttatctaacagtattattattcagtttcagaataatacataccaaaatatgttgtgttttcccattcttagtggctgttctaacaggttcaccaacaacgttgtttacttctctctttctctctcttactttctctcatgtctctatatatctataatctttctatctatccactgatctataatcccatgtatatacatatatgtaccctgaagcgagataaacatggatttaaatcgtgttgccttaatttaactatgactcagaaatgtcatacagtcactgagcctcagtttctgcatctgaaaatggtaaataatttctcttatcttgcagactttaagacaggattagaaataacatcttgtgaagtatttaataattggtagacaattcacagtggctattattttggtgtatactttatggtactcattgttatgtagttgtatataggcataaatggttaatgctattcataactgacaatgtattctgatcctttttggtggacaactgagagaaaagtctgtggtttcagattctgcccctttaggaatggataattgagaggaaggagccgggattcttcattcctctccctccattagcatccaaactggaaccttcatgatggaggataggatggattctcctgttagagaagatagttgcaccatctgaacactggttactcaggattctatgtttatcttttaactttttcaatgaggacgactattgtattggcagaaagagtgctttttgatatggtttatgtatatgcccaactcctaatgcacaaacctgttagtagagcacattcaggatactcaagccctgactactgttgaataaagaaacaataaccctattttatttagaggaaccacctcaaagtctcttgcagtaatgctcaattctcttcccttcctaactcaccaggaagaagggggctggaggcacaaatacatgtttcttcccactcccaaagagaaaggctgtgcagtgggagtaggctagatgttacaattctttgctccattaggggattaaaatgacaggtgacacttctcttttataagctaggcacctaggaaaaaaaggttgcttgttttgggtttgctttataataagaagaatatgctgaagcacagggtgctagaaaataaaagatgggtaagaggtttgatgaaagactgggaataaaagtagttgcatttctagaacagcatgaaaatgtaatcctacaatgtttgagattgccatggatgaagttttaaagaagtgactttgctcaggaaattaagtttttgatcaaggagagtaaaggttaagaaagtatttgcaatttggtatcaggtttagagaagacttcaagtgttatagtatagaggccatttggaaagtcaacccttagcctaaagtatggagaaaggggagggagaggagggcttttaaaaggaagtaggaaagacaaaatcgtatcttgctcatttgataattttgcctaaaatctgatgggactgatcttagcttagtggccccatctttttaaaaacgtttcagcccatcttttctggaattggtaagattggaagtggatagcagctgggcgtgtcttcaaatgatttgttgttgaacagaataattccttttctagaactaacccatactaaggtgttgtatagaggtggagtagggtggtgatagctagttatttattgggcaaacatgctaagcaaagtagcttagaaagtataatggcacaaagataaactgttggcttacttcctgcttagtgaaatattgtttattaagactcaattcatagttggcttctattgattttttaccatccagtactcaaagatgtgcaaaaatgttccagcatttgctcaataatcaaatgatcactttctttgtattgacaatctctcttgatgttagtttgttccacatgtcatccaaggctgacaatcgttatagtagcctcaagtttttcgtcattacaacttcttgacctctctccttctttctctttctccaacttaagacccaggtatatagaaccatttgcaacttctacaacatactgtcattgcttatactttacccagtggttggaacattctaacttacttcttcacttgcctcactctactgaattctcaagacggggctcaatgtcctataggaagcatggccagttgcaggatgaagtcaaagatagctgtctctgctacgtgctccagttagatttctgtgctttgtaacagcattaatcacaacatatagcatgtcattttcctgctcctctctttctgggtcatgaataacttgaggaggaagaatctattttacttttgctttgaaatacacacacacacacacacacacacacacactacacacacacacacacacacacagaatacctaatgtatgattcaacataatgtctggcttagtaggtcatcagtaggttcaaagaataaatgaatatatgaattgcaagtgctttgcataatggatatgtaataagtaactgttaaataaatgttttcaaaggagttactcttcttgaagaaagcaaacttcttgattctatttttattacaaaagtttaaagatatatttaatgagacattttcaaaggaaatgccataaatggaggtcattaatcattcactaattccttttcaaccaacttcaggtgattgtttcccccaaatcaaataaatgttaaaattatttgtatagctgttaaagtgattgatataacttacatttaaatggaagaaaagtgttttgatagtaacattttcagccccaagatagcatgttttcctcatgtgttttccaaagaaaggaagctagattactatgacttaatttataatatatttcaacattgatggatgaaaaaataatgaagtgtttatttacctgaagaaagtaaattcaaggtccaatatatcttaatatactgatttattgcttatgtaatgtataatattaattatgtacaactgcattatacaacatacataatggcagtaattatgttcgtgtgtctgaaatacatttttgaatgaggtatttatttattgaattcaaagggcagaacaataagttaaaagaaagtataaggcatggccagagctcggtccagtttccagcatacaacaagctctccataaagcataatttctcttttaaggatattgtccttaaggcagtgtgctgtggtagtgttgagtcaagcagtctggacttaataagacgtttccctggcattcaaaagtttttgatctgttaaaggtagaaaaatttttattaaaaagactattttgtattagccaaaaggggatataatcgttgttaatgtaaaaatagatatgatgtattacttaaaaatttttgactctctaatatctttcaaatttccaacaccaacagtaatataagtccagtaagccatgaatcaaattggaactgtacttcagcaatggtgtagttctttgcagtgcagtctattatgttaagtagtttcttaccgtatgaaattcatgtgttcttttcataaacctaggattataaaaagtctaatgtgatgtgtgagtttaaggctatgaatccagctttagggaggtctcattaaggaaaaaggggacagatggatccatgtgcctactgtgtgttatagtgcctactgagtgcttttggaataaaaagatgagtaagtttgagccttttaacaatagctacttcccttagaaggaggaaaggaaattacagaatacctctttgaatttttgaccagttataaattttttttaaaagtgaaataaagaagttaactaattggatttgcttcactatttcagtcaatctgtgttgaatctttgagcaaaactggttgagcagcttacatgacagctctccaagtaaatggaaaatttcccaagctcatgctggttaggaaacagaagtcctcttttaaagcagtgccgaactcagcagtttgggtttcattgaactggcttagtggtttcaacttatataacttccatatggaaagttaaggggaacatagaaaccaaaccctcttattgtaccacctgagagcagctgctctttcgggggtttctggtacattgcctaggaccctggagatcttttatttttcctaaaaatctggaattctgtccaaagaccaacgaaaccatgaaagtcaaacttatgcaaactaatttctaatggcagtgagaggaggaaatccagtttaatctcctttttaaagtgcacaaacacttggaactgtttgacctaacagtcagcaaagggtccagagagaaccagcacaaaacaggcaacaggattgtgttctctagtaaatcatggatggtgaaaaaattttgtttttcttttgaaatagtctagaggcaaatgagaatattaggctgaacactgtaaattacagacaactaggaaccatgattggtaaggactaaagatgcaattttgaaactaaaacaaacaaaaaatttatgtctcacttggttatgggaggacattgagaatcaatgaaggtctgtcaagtattatactaaatgtattatactaaatgtattatatgtgctttgtcatctaattttttatcacttctgtgggtaggaattatttcaacctaatttttgcttctgaagaaactgacagagagacggaatgtgtttctaaaggactgaaaaggggtgaatttaggatcgaatcctaggtgtgtttctacctgttttaaacatactgctttctattttgaggtgtttataatatttcttttaggtatatgaatttacaaatgccaagagtgggttgaaccattcttaaaatattgatagtttcataaaaaatattgtaaaaatctttacatgcctaaaattgattacttctctgagaaagtttctacatgattgaatttgtgtggccgaatgaaaagacatatgttttagaagagaaaagtaatgaatgattgatgattgtgcagtgtttctatccagtgatttagaactcagcttgtttgaattgctttagcagagggatcacaagcgatatatattttttaagtaaatgtttaaaacattggctatatctttaattagagaaaaatttctggactcacgacgagcacagaaatttgagaaaattagtgtaattaaaactcagatgtccagcaagtttgtattatatttcttttgtgcttcataagatgtgaataatattttccaaataattaagactgaatgttaactctgtgagaaaaagaatttatttttagaaatttgaataagaatctccctttaaaatccacatttccatgccatatgtgatcattttatgagtaaaattttacctttcctagaatccaagatcattattataaacatcagctactgagttactctgttaactgccattgatacaatttttacaaaatataaacttgagtaacaactggtcctagatttaacaaacagaaacaaaaattacccatttattgtaataatgacatatttttaaatcttctataactggaataaaataaccagccactatatgtatctgatcctctgcattctcattccaactgcatgatgaaggtcaaactcctgctcaatgcatgatctttgtcacgaggtggagcttaccaggacttatgactgtttacaaactgacctttttctcctttgacccctatctttttcttagtatatgtgctgctgaagtaagcattctcctttgactctttcccttcattttattattatttttttcaatttttcttttcaattttttgtgggtactcccttcattttagaatctcaaagtagcacttagtcaccaaatgtctgtttcttctgttttgaagtctaatctaactcctctggctcccctgagctaatgctgattcccaaagagaaggcacccttaactcaaagttagaaatataatcaaagtccctaagtttcctcaaatatctctttctagcatgtctttctgaactgagtcttatcagaaatttctcctgcaaaaatactttcctggcttgtacttcctaattttattcaagaatgtagcaggaaattcatgaagcattgatgaagtgtctattatatggaagatactcaggttcttcaccacaaagatggctaagacgcatgctcatcccccaagatgcccatgttaaagtggggggcagggacataaagatgtaatatatatatagatgattgtgaaatgatatagacgagattcaatcaaagaaaagatgttcttgaaaagcaaatctcccaccatgattaagagtctgactaagaatatgggaatgaacgtgataggcagtgggctgagagatgtgcaaataaatgctgtgttctaggaaccatgtatagttaaataaggctgagcatagacatgagagagatggggagtggaaggagggcaggctgtaagggtgagaaccataccacaaatgagaccatgctagggaatcagacttgattttacacatgatgggctgcttttggagtgtgtttattttagatgaattattctgtagcaacagtgcagaagagatatttgaaaggggcaacagtggaggcaggaaaaccagttaggaagtgattgttgtcatctgagctggataggatgaagctttagattgggtccatagcgatagagatggaggagagaaaatttagagaaatatttattaaatgtacgtgatatggagagttctaaatgtttaccttgagcagcaggaacagatgcagattttgtggggcctgaaaataaagtaaaattattaattcaaaagcaggtatgaaagtaaatatttatttaaaatgagagaataaatcacaaggttacacactttaataaaatgacaagccacaaacctcacaaaattgagaaaaagaaatgtattttatataagcacaaactcagtatttcttcagttcaactttcctttagccatattccaaaactatctgtactcattctaatatctcccaacgtgaagaaatatgatagagatgaaatcagaattcaaagagaatcaggagtgagcaagatacatcccagaacctttgttcctggtggtaaattaagcaatcatgtctggcgaaagtcagcacttgttatttcttatctgcgtaaaatattttccattttaaaccaagaagactctgaattatcgggaattacatgtttttggccataagagtggaataatgactgtaatcattaacagtaaggagtgagggaggctactcaatgaggaaagaaatgtgtaacattgcttcacttaggaatattatccccctctgctattcactcttttagtgccttcctgaatagaatatcctccaatattcagatacaatgggctctagcatactctttaagaaccaaaatcttgaaatctataatgaatcaatgcagataaacttttctgaactttaattagatttttatctatttgatgtctatgcacagaaacaagatagcaaaactaagaataaataggattttataaattgttttatttaaagaatagcaaatattaactttagagtattaattcctgtgatttccttgatattttttaagacaatcagtgattcctatgagaaatgtggcaagactggtgaaacatgccatcttttaagctttctgttcttcctttgagagacagcccagcatagggattaatgcaggaaccatggagtttgactgatttagttggactccaggctgcttactggttatattctacttaacctttatttgcctcagtttcttcatctgttaaatagggataaaatgacacctaccttactgggttattgagtggattataggtgttaatatatgaaaatatcttagaagcaatgcctggcttctaaggtggctgttattgttgttatccaaagagaaggaaacataattttccttagactagcctagaagtccctgtacaactgagtcagtcagatctccagactttattcctagctactataccaggtatgctgagctccagcccagtgttgctcagtgtgttccatatggatgttctgagataatttgttatgcccagtaagtgtagagctgaattaaatattttagaggtggcagaaagttccatatagtttttcatgctttagactcataactccaaggctatatggatggtctctgaagatgatggggcaatatcctttctatctgttaccgtgagctttcactgaacatgaccataattgactgtgctaagactttggcctttcctacttttgtggtataagttcagaccctttgaagaagcagttcataaatgcaattaaataaatttcaccccaacattagctgtcctgtcctgacaagggaagtgttgcttgtttacttagcacttgtgtcttgttaatactggtgatggccatctgtgggtatgaagagctaatggctgttaagtgacagacgaatcatttccacagagcatgcatacacgttctttctttggatggcgtctacagtttgtccttggcagaccattgctattttcagacttgcttccagtatcctcttgtatgtgttgcctcacagtaacttgtcacttcacttaagcagaaagctcacggttctctcattgctgtacctcctgtactagcctctgaatgcaatgtttgggtgactgccattatcacttcctttggcttttgatcactaaacttccattatccaggcatcacttgtatttatgagtaaacttttccttttgcaccacccccatactccaagtcttatagatgagccatttcctgacagctaaggagcaatcaactccactgtcctcctacataataatgaataatcttttcttgcagtcaataaaacaggctcccacgatcatatccttttatgacttggggatgctggtgaaaaatcttgaccagatattatttgatttgggagaatagagcaatgtaaatatggcattcaatatgctttaaaataattatctggaaggtgtaactttcatgctaaacatgatttacactacaaagaaagtagtctaggagaaataaaccacggaacttgtgggcattttgtaattgtctaatctagctcctttattttatagttgtggatgctggggccaagtagagttgactttctcaagggcacatagtcaaggagcagtggagatgctggaatagagtcttctgattcacagcctattactcttcattctcggatgttttataactgataatatctttgaaaatatctaaatatttttgtttgggaggctacttgagatcacttccttttcactgataggtcagaggacacacaagaagtccactcttaacatatcagtaagtgagtgatggatgaagtgaagaggtaagtgtagacacctccatttttaagttacattgttggggagatgggaagaaatgcttaatgaattagctctccgtctttagtcaatctatctactatgatttatccagtaatgcattggcccccggaacttggtgcttttacatctagcacatctccatatcttatatttgagtaaacttttaaatatttattaattgttattctgagagtggaaatatcgtaagtgtagaataaggagattaggctctactctaaattctattgtgaacctgaatcctaatcatgacaaagtcactactctttgcctcagtttcttcacatgtaaaattgaggtgctgctttaaatagcatcatctaaaattcatttcagatattgtgaatggaaaagctacaatctctgaatgttacaactgtcaggtcagttaccctcatggatttcatacatttcccatgcctggttgttggcagagggaaaagagtgggagtgtggtgtctgtgttagtattgccagctgatgggctttaaaacaggagtagtatggtttgagtaacaaaaataccttcttaggatgcctcaccaaataatagagggtgctgaagagagtatctaagtaagagacctggctatttctggaggtttttcaactagacctacgtttaatatttaaaaacatgaaaactcatgtaattaacatgtaacttatttgtattaaaattagtatgctgacatgatattttctaaaactgggccacatatgcatggatttcctaaataatccttcaagagaatagagcaggaaatgaagtgatatgcccatttgcagtgtggtatggggcttcctgaatgtataaatgtggaaggcagcaaggtggggttggataccagtaatgccaagaacttaatttcagcatttcaaccaccgtgtacatcctcaaaatgcctttcactttaattttgtataaatacgaattggatcccgggttaccttttgctttagagatgaaaaaaatgtatttacgtttcccacacaactgctaggaattaaagtagtgtgaaaactccacacaaataaataatacatttaaaactatttttagaagaataattcaaaaagacagtagttttgggacataggcaacaaaaagtcccttttacctaggtttctttgattcagagattcagcatacggatttatggagacagattatatcctcaacaaattaaagaatacaggatatacactgttgtctaatataatatgaggaaactttaaaatttatttccatgaattctatgttcaattggaaatatatgttcaattgagtatcagtagaaaaatctattgtttttactaatgactcagctgcttaaatgatctattgtatcggtggccagtggcaggaaggaggctctgtgcagtattgttgtaaccatgacattagtgacatcatttagcagaaatagaatttgggacatttggaaaacaaagcagtggcctcttggctcaactttgtgagaacctaataaattctaagaaagtataatggacagtgttgatttcttcatatatatttagtgattttacatgtatgcacacacacacacctacatacataaagtatttcatttaaatttacctactaatgtatgatattcgcaatgccgtatagactttgggaagaatgttaatcttgtattgcaaagccatgctctactttaaaagcaatgcctccagatgtacagcatacttaacagggccaagaaaacatgtaacgttgattctgttctgagatacacctttgttaaaaagaatcccttcagtttttcctgtctgactaaaaatgatgaaaggcagggtatcctgaatggctgtgttagaacatcgaggtattggagatccgtgaaggagcatcatcgttactatagaaacaaatgctgcccctgtcatggacatccaaaggacagactgaaaaatgaggaggggaaaagcaatgggaggaagaggtgccatgaaatgagaataaagaaactacacaggaaggactgaattaagaaaagaacagcctgaggcagagtgaggaatctagacacagaaaattcccaatggaaatgtaaaaaactggatcaccacttgtgtgggtacaaagaaatgatgacttttctgtttttaaaagttaaattttcttctaaagtataagtatgtttttgcctttggaacaactttttgtatcctgaagtctctcttatggcacatgtatacatatgtaacaaacctgcacgttgtgcacatgtaccctaaaacttaaagtataataataataaaattaaaaaaaattaaatttgaaagaaaacaaaataagtgaaagtattgaagattgtgatagaaaatgtgtttgaataatgagtattagaatctgtgacaagtcactcgacctcaccttaaaatagggaaactaatagcaacctcatgattattgggtcagtataggagagaaccaaattcaaaccctgctccatggagtgaacatttctattttgggggaaagattagggaacggaatctgggaatataaattattcattttagtatttcagaatgaagagaaaagagaagatttcttttcctttattcctcttgctgaaaaagaataatttgttcatgtttgaagactgtgaacagaggtagaaaacatttattatatatatgtaaatatataattagatgacagtttacaaagtgaatgaatagatgctattaaaatgctacttttgaccttcaaaaacatctcaaatagggttgatattatttggttatttgctgatttggataaattgccaagcagaattttatatcaagaatagaagatataacgtttttctataacatttgatatgttttctggaaatgtttacttatagattattatcactcatgtattgtggtagacaaggtgatgtagcatccagatacctcttaaaagaaacacttcccagctcctgcctttttatccaaagtcatactattcactccttagggcagcctactttcatagctgatgaaggttggggtataaaggtatggccatcttctgaggttctgttgggtttaccaaggtggtggtggggcctgcattgaagctcagcttttcttctgccagtcctgcttcttcctcatccctttcatgttgttgagtccaacaagacagttcttaataaacatcctgcatgctaaacttcaattcacagtctgatttctagagaatacaactggcatcatatactttactattacaagtaaaatatcatatggataaatattttctatttgaaatgtccgtaaagttttacttttaaaatcagttttcacatgtatgcatagcttcagattacctgtactatcctttaaaaattcacaaagaaagctaaaaatgcttgcaaaaattgttagctcatgttttatatgcagaatcttagtgactaaggaattttaagaaaatatttataatgatagggtttcaggagaccctagagatcgcatcaaacccacttgtacagataacaaagctggagcctagagggctaagaggactctttcaaggccatgccagggcttagaacacaagaagtcctactactgctttagctttctgtgttcagggaccgagtttttttttttttttgcctttcttctctcttttctttcctcttctgtttctttaacctaatttgcttcctcatgttcgtaagccacagctgtttcccagaactgtgaaatcctttccgagaaatgattaggagtgtgatgtgtgtagggtggtatagagagagcacctataactcctgtaattctgtcaacttgtaactgtgcttaaaatttatcaaattagagggtgttttctgagcctcatgacactagcggttttcccagatgaagtgaatgttacccaggtttcctctgagaatccagaaggcaggctgatgggcagcttcttcattttacattcgagactacacatttgtaccttcctcccatgagcacaaaaaaagtattcaatatttcttaggcattagatgtaataaattgtcattaggagttttatagtgtagaaaaatgtattatttccgagcccattttagtctttctatgtgggagacagtgtatttactgctaaacatgttctacagtatatggcctgaatatattctgcagttatctcatatctaagcaggtatttaagtagttgagatccatttatctttcctgaaatgccttaataatattttataactcattagcgtgtacaaaatacttttacgtatgtgtattaaatgtttgttgaataaattatacatgttcttatattcagacattagaaaagaaagttatgtaataatctcacttaatttaagcctcaatctatgaagtaaatattatcttctccattttccaataagaaatctaagaatctgcaagtttaagttctgataaccactggcttacattttctgtttatcatgtcccagacatgttctaggagctttatgtgtattaactatttctttgaacaacccagctgaagttggtaccattattatcaatggcattttacagttgagtacaatgaaacacagagagatagagtaacctggccaaggtcacacagtgggtgaatgttaggaatgggggctgggcgcagtggcttactcctgtaatcccagcactttgggaggctgaggcgggcaggatcacctgaggttaggagtttgagatcagcctgaccaacatggtgaaaccccatctccactaaaatacaaaaaattggccgggggtggtggcgggtgcctgtaatcccagctacttgggaggctgaggcaggagaattgcttgaacccaggaggcagaagtaacagtgagctgagatcgtgccactgcactccagcctgggtgacaagaaagaaactccatctcaattaaaaataataataataataaaaggaatgggatgcagcctaagtaggatgaccaactatcctggtttgctcaagactgaggagtttcccaggacacaggattttcagtgctcacaccataacagtctcaggtaagtggaacagttggttggcctaaatccaggttgtgtgctcaaggacctacacttttaagcacctagctcttctgtttctcatgcagaaggcggtggatccagggtttgaaccctcattgagtgactctgaagcttgtgcttttatatttccatcatgttgccgtggtttgtattttaatacaaatatatcacaaaaagtgatcatagattactaacgtgtaatatgtttggataggtaatcatataccaaagccttatacatttagttagacaggaacatgcattcggatatttgtcatgattcttttgtaaacagctttattggggggataattgatagcaaaaaagcacatattttaggtatacaatttggacatatccatacacccatgtaacagtcactataaccaagttaaaaaacatatttatcagctccaaaagttttctcatgcccccaccttttagtaagttctagatatctgttcaacatagtgcctatatcttgtgctctttaaaagttgttaggagagtagatctcatgctttcattcctaattggcttcgtctcatttgacaattggctgtttaatttttcttacacttcagtttctcccaaaagcctattccctattttccataagttactacagacttgtagtacagattgatattttattcttccctttcccatagttcactcctgaatgatatctttctcatgtgtaccctacttcaacttcactttccctgatgggtctgaaatatatgatgtatacattcagtatccacagatacctgccagtttcctcttctgtcatggttcctccttatctataggcccttccttctcaaagtgttattgtttccctaatcccaactcctcacatctcttcagtttcatgacatcttcctataatattgtgccgataaaactgccttcagattggagagaagggagaaatcagtgtaaactagtgttgtcatggacacctttatagaggtgatattagtcaaactgcgttttaaagagtgcaaatgcgatttagatgagcatcagtaatatcaaagtcttgattttactgatttagatttgaaggaagattacatctaggaactaaggaatattaaattagtctttcttttttatttcatgaacttaatcatgagtgaactactagctgacttatgcaatttctagactctgtctttgaaggcagtgttcttaaattgtggaggcacatggtgcttaattgtattggaggttggctttgcattgtaaagagcatgtttgcgtaacgcttatcaggtgagttacttttggctggcatttatttaacttccttgagcctcgattatcttttggctagccaaacttaccatgtagagttgttgtaagaataaaaatagataaaggattaataaaatagctagtttagtgcctggcacatagtagctattattagtcttacctaaaaagttgttattctgttcatggatgaaagcaattgattttctacttctttcaatactctgatgagataacaagtacatgagaatggatgactgtggttagtattgtaggtcaggaataagaaattatttttaaactcatcccactctttccttctatagcaactccttctttgtctggattgagatttaagtagatgcttttctccagtgcttcagtactgaatgtttaagaatgccaggtattttaatttaaaagcatactttttcatcaaaaatgatgcattaaaaatattaatgttaacagtagataaaattttgagatataaatatagcacactctgaaaaaatttttcatttaagcatgttgatatgttagatgttagattgaggtagacagagggtttgtgattacttgttttgtctacaaaaaggtagctatcagaaatgttcaatattgttcacattcatatttcaacagaactaccacttttggtaaataccaatatgtgtaatattttctggctacacttccctagaacaaaatttatatttttcccataattgatttaacttcattatttgaatatatcttatagtcaggtatgtaggtgatgcttactttatttatgctactaactttttttaaatttacttattgaacagtgcttttcaggctaatggggcctctggaggcaataagaaatagctgggaaaaatagatgaaatgtttcattttaatttcaattgttatttgcatgcaatttattttctttcagaccttttctctattacagaagttatgggggttggagggagagaaaggcaacgagagagagatgtgtgtaaaattgcctttcctggctgtggtcagaagggcatatgactgtggaagaatggtcagagacatgcaatgctaattgctttgaaggtggaggaaggtggccaggagccaaagaatgaaggcagcatctagacatggagaaagcaaggaaattttatatctatctatctatctatcatctatctatctatctatctatctatctatctatctatctatctatcatctatctatctatctatctatatccttacttgggaagaaactttgtggatgtgattaaagatatggagcttgagatgggttatatgattgtgatcagtctaatcacatgaatctttaaaagtggaagaccttttatgcctttcctggctgtggttaaagagaggtgactacagaagaatcatcagagagatacaatattgatggctttgatgatggaggaatgtgatcatgagtcaagaaatgcaggtcatgtttggaagctggaaaaggtaaggaagtagattctcccttagggtctccagaaaggaacatatccctgctgataccttgacttttacccagtgaaacctgtgtcatatttctgacctccataaatgtaagagaatacatttgtgttgtttaagtcactaactttgcagtaatttatgacagcagcaataaaaactaatacatgtgtacatttcagattgtattgaaggaaataaatatattttcgttgttttgaatgtatgtatattcatctctagcataatctgtagtaatataagcttaaattatcatcccctacccaagacaaatttatttataggagtccccagtttggtgcaccatgaacttgcatagagggaactctttccttatttcaaaggatatttactgagcacttagtatacaccaagtgctaagtgctggatatactgtaaataataatagacatgtttcccactcttactacattattgcaacattagtcattactagttctgccattttttctcatttttagattgtgctaaaaaggaggaaatactaaaagagtattgtactaaaagagtccttggataagggcctctttctttcttggtttgcagttagcactgttccaacagtatgaagacataaacaatttttaaagaatggaagcctttttgaggctaatacatattatattcgttcattttcatgctgctgataaagacatacatgagactgggcaattacaaaagaaagaggtttattggacttacagttccacatggctgggaggcttcacaatcactgggggaaggtgaaaggcaaggaggagcaagtcacgtcttacatggatggcagcaggcaaagagagaccttgtgcagggaaactcccatttttaaaaccatcagatcttgtgaaacttattaactgtcaccagaacagcaagggagagacctgctcccatgattcagttatttcccaccgggtccctcctacaacatgtgggaattatgggagctataagatgaaatttgggtggggacacaaaaccaaaccatatcattctgcccctggcccttcccaaatctcatgtcttcacatttcaaaatcaatcatcccttcccaacggtcccccaaagtcaacccatttcagcattaactcagaagtccacagttcacaaagtctcatctgagacaaggcaagttcctttcgcctataagcctgtaaaatcaaaagcaagctagttacttcctagatacaatgggggtacagctattgggaaaatacacccattcataatgggagaaattggccaaaacagaggggctacaggccccatgtaagtctgaaatccagcaggggagtcaaatcttaaagctcccaaatgatctcctttgacttcatgtctcacatccaggtcatgctgatggaagaggtgggttcccatggtattgggcagctccactcctctggctttgcagagcacagccttcctcccagctgctttcatgggttagcattgagtgtctgtggcttttccaggtgcatggtgcaagctgtcagtggttctaccactctgttgtctagaggacggtgtccctcttctcacagctccaataggcagtgccccagtagggactctgtgtgggggctctgactacacatttcccttctacactggcctagcagaggttctccatgagggccctgctcctgcagcaaacttttgcctgggcatgcaggcatttccatacatcctctgaagtctaagcagaggttcccaaacctcagttattgatgtctgtgcacctgcagacccaacaccatgtggaagctaccaaggcttaggacttgcaccctctgaagccatggcctgagctgtaccttggccccttttagtcatggctggagaggctgggatgcgggaaccaagcctaggctgcacacagcacagggggcctgggcccgggccatgaaaccattttttccccctagacctccagtaaaggagggggaggggctgccatgaagatctttgaaatgccctggagccatttcttccattgtcttggggattaacatttgactcctcattatttacacaaatttttgtagctggcttgaatttctcctcagaatatgggattttcttttctatcacattgtcaagctgcaaattttttgaactcttatgctctgcatcccttataaaactgaatgcctttaatggcacacaagtcacctcttgaatgtttcgctgcttagaaattttttccaccgtataccctcaatcatccctctcaaatgcaaagatccacaaatctctagggcagaggcaaaatgccaccagtctctttgctaaaacataacaagcatcacctttgctccagttcccaacaggttcctcatttccatctgagaccacctcagcctggaccttactgttcatatcactttcctcaaagccattcaacaagtctctaggaagttccaagccttcccacattttcttgtcttcttctgagcccaccaaactgttccaacctctgcctgttacccagttccaaagtcgcttccacattttcaggtatcttttcagcagccccccactctactggcaccaatttgctgtattagtctgctttcatgctgctgataaagacatactggagactggtcaatttacaaaaggaagaagtttattggacttacagttccacatggctggggaggcctcacaatcatggaggtaggtgaaaggcacattaagtcacatctcacatgaatggcagttggcagagagcttgtgcagggaaactctcattttgaaaaccatcagatcttgtgagacgtattcactatcatgagaataacgcagaaaagacctgcccccatgattcaataacctcccactgtgtccctcccctaacatgtgggaattatggaggccacatgctgaaatttgggtgaggacacagagcaaaatcatatcacatatatattcaggtatcttaatattttctcatataacatgggatcaaaagagagcttattttctttggctatatcacattgtttttaagatacctcttacaatggaacccctgagaatttaaaacaatttctggccaaaatggcagtaaccaaggaaaaagctcagttagaattccaagtccatacacatttggaatccaaccctgacttcaaaaacagtttttaagtaagtcattctgtgaaaattaaattataaatgacccatatgtaaagattaattctttaactactatagcatagcatgccccctgaatgttaacagctcttatttgtttcagaagggacttcaggcaacaatttatatcttgtggttttcaatctggcttcatttgtcaccgagttgtgaagcttcaggattaaattttgtagggctagtgaacacagactccttatcaaatgttcttgactattactaactctttcggtattgtgcaaaaagtagaaagaaaaatacataggaccaaaatatcaaggagtttttacttgctgtaaaattcttcccatatttaaaatacatagtacaatacttgttgtttccttaaaggaacattcagaaaaatgtagcactctttatgtgctttccaatgtggtagtcattagccagacatgtgaatattgaatgcttagattatggttgtccaaactgtttacacgtgtaaaatacacactggattttgaagatttagtataagatgaaaacatttaaaatatatcataacacactttgtattgattacatgctgaaattgtaaaattttgatatatttggctaagtaagatatattgttgaagttagtattgcccatttctttttacttgttttaaaacatagctactaaaaaatttataattctaagtgtgctttgcttctgtgactcacatatttcagttggacagtgctgttttaggtgttaagttagttattccaattgtaggaaaatacagggaaccatgtttggattcttaaatatgaagtgtgaggtcagtgtctcctgccttgtgaagccactcctgcttggtccttctcttcttcctgagtctggtgtttcagtgggggtatctttcttgtaaagagagtgaaaaataggtgtaatacatataagaaaatgattagaatgtcactgaatgtcataaaaagaagtgaataaaattgagaaagaagagtgggcagcatatttattctgtcagctataactatgttctttgtcctttttcagggaatctctagaacacgttctttgaaaatgagaaagatagcctgtttattcaccagataaagattacatgtggtctttagcaagaaacatgaactcaggaggatgacagattttaaccttaatttgaatggaagggaagcattgtataagaaggattaaataatgtgacttcacactgtcttcatactagataataactgaaaactgattggcaatataacatttattattttccctgtaataccgttattagaacacaggaaagtggttatccaaatgcccatgctttctaaagaagaaaccaaaggtctgatgtctggatatgagttcagactatctttccactaagagtaaagacttctcggtttcatgaaggacaggctggtgaaaggcaaaaagacaacctataaaatggatacagagagagaagatcgaatcataaagtctctaagcctttgtccaattatgagatatttttcttttgtttcaagactttactgaagttctgtgagctacactcattgtgtaaaattgataaaggttaatattaccatctaatctgttgaatattattttatttaaactgatataccaaaggaaatcatgagctttgtgttagcaaaagggagagattttcagtattctcttactgcttacaaataactgttttatcacacaccaggcctgtcagtgggtggagagcaaggggagggagagcattaggacaaatacctaatgcatgaggaggttaaaacctagatgatgggttggtaggtgtagcaaaccatcatggcacatgtatacctatgtaacaaacctgcacattctgcacatgtatcctagaacttaaagtaaaataaaaaataataaaaagaagttcttaattttatctccagggagagagggacataattgtgaggttcataaagaagcaaatgaaaagtgatcatacttgatttcccaaatggatctttgcttgttttaggagcaaggataagaggttgcttatacacctagttttgcaaaaggttgaatactttagccatcttagcatttaaacattgctgatattctatatcccaagccagggaaaagagattctgactaagcaagaaaatccgaacactgaaataccttagttaaaatgaaaagcaggaactactctgggtttctttacaaaatgcaatttttcctctacaaataaactcattggtgctaatcttgtaaacagtggtaactatggcacctaaataaaaatggcactttatttcgttagcatcatggagggtttataggagattactttgaaagatactcagggagacaacttggggattctgtataactctcttaaaagaattcagaatgctctcagatgatagaggaaattaggctttttctgcatgacttcaagtgaattaggaagaagaaaaaatgttgaaggagaaggacattttgttcaagtttaccaaagagcttcccaacaaatagagattatagtgaaactggtggcatttggaagccctaaaagttcagctatgaaataaagtgtaaagcagaggattgaaaattgttgtaaggtatgctagagtggaatttcagcctttggtagaaattaggtaggatgctaggcaagctgaccttcaaagacccttcaatgctaaaattctatgaaaagcagtgattgatttgtgttagttttctaaaaagaaactttcagtatctgtattgcattaagtattgcaaatccaaatgaaatgcattattatttaaaattgttgaccattttaatacaattcattgtgctctctttcacatccctctttagtgcagtgaagaacatgcttattagtatggatcctcatgttccagaagagtcctttttctgagtggtaaatcaagcatgttggtgtctctgcagcaatcccaaatacaacatagcctggtagctggtggtactgctggtactgcttgtctctagcttgaccttattaaaacattgatcagcaatggcctcatgtagcttatttgcacacagcggccccatagtagatatcatttgtttcatgccctagtagttttgcccaatgagtagtttaaaagacactaaacttaaaatcctcacagcactgcaaagatgggaatttgtctctagtttctcactcagttggaatgacaaaaggttagagcaaaaagaggaggtgaatattgtttacttcagtggttctaaaccctggctatcctttagaattgaagagtaaaaaataattaccagagtctgagccccctacttagggattctgatataatttatctacagtgggtgctgggctctggtattttttgacagctccccaggtaattctaatgtgaagccaaggttgggaaacactagtcttttctaatgtttttcttattatactttgttttattttttaaattgacacataataattatacatgtttatggagtatatagtgatgttttagtacatacataaagatcagattggtgtcattagcagaaccatcatctcaaacatttatcatttctttatgttgggaatattcaatatcccaacagttagggaactgttgtatcttctctcaagtcttttaaaaacttaggttataatcagaatagagcaatttttttaattaacattgggtaaaatagtttctttttttccttttgatatgttcgtttcttaaatttaaaagtaggaaatgtctaaatgtgttcaaataaatgaatgatcaaggccaaaatcagaagcaggttttatattttatggaaggtacttttgcataaaagaatccataaagaacatccagtatgttttctctgagtcctctgaaatgaacaggtgctctcctatttagttagacctctcactactgaacattataataatgtttgggaaagatcagaattaacaatgagtcagtgagttacccaaaattgagtcagtgcttttcttcggagagtaataagataagttgtgaacaaaaactgaggtatgattaaacggaagtagattttcatacacctcaatattacttatattttaggtttcgctcaagtttttcttagcctttatcagcaaaaatagaatttgcttccaacggtgctaatgaagtgttgtcaatgaaggaattacaggggtatagtcaaggtaagggacaaagccagggttgatgcaatgccaagaagctaatgacagtgggaagcctaggtctgaaaaagtaaaggtgcagaaagtaaaacagagttactggggcaggagctgatgcagaagagaagggccactcaatggagctgtggaattggaagtcactagctgttctgcactactaaaaaaataaagaaatgaggaaaaacaagaaaaggaaaaaaaggaggcagtccagagatagagagggatacagaataagtagctatggtctgtctctcttttgccctccaatttcttgctggtatttactgttagccaaatgaaagccaagtggagcttcctccttagcccatttaccagtagagttctcattgagtcttttcctcagggctgttttcctggactctgaagtctaatgtttcctgatacctctatggaaacttagggttgcagtgtgttttactgaattcttggacactgcactttgctttcccatctttattagaatgctatatcttatgttttaacttgagtgccaactcttaactattagtagcatttactaaaaaatattctgaatgagctttatgtctttgatatttcttgccaaatcagaggttaaaaagaaaaaaaagtttcagaaactttatagtcttttcccctaaactatattattgcttttctcattttataactctgcaacatgaatttggctataaaataaaaatttcgttacttttaaataataaatacaaaattaatgttttcttattcttgctatgtaaacatttctatgtacttctttagatttctgcgtcaaactttttctttcaagattttaaatcaaaggccagaatttgcttagaggtagatttataaataatgtattaaattaattttttaaacatcaaagaaatcacttatggtattattaatgaaattggaattaaagattgaaatcaactagttcttagttaacatcaatctttattaattcatctattcattcattcatggagctaaatatttattgagtggttattaccgtatgtcattgaatgtaagttgccatcaattttaagtagcatcctgatttcagaaacattaacatgtaaaaaaatgcatactttagaattaatgaataatatgtgtggtgggtgtatttcaatttagaataacttatggttgggaaatagcttatgatctagaattgataaccaaaggcaagcaaaacaaaacaaaaccggattactggagtttcagttgtcatttttatacgttgcttttcttttttcaataagtctgtttatgtcttgaatgcgggaactgtattgtacttctttgactttctctgtggtgtgattacaaaatgtaatcatagaatgttagttatggaagagactttggtgatcatttagtcatctagtccaacttcctcatttatagaagaaggaatcagagaagggctagcttgcctgatcacctagctagttagtagcagagtgaatgaacactgaaattcagttctcaaattcttgttccagtgttttatctattattatacaatgtaggttttaagagtagatatcaatgaatatacatatgcatgttgtacgcttaccgagttcataattaactccaatattagtcctccgcttaggtgctagggttttacttttatttaaccgtagtacaaaaaggcttagtggtatcttttgtcatctttagatatatacatgtgttagtagtaggttttactttagcaaaacttcatccatttcctgttatattaaatggctcattcagtcttcttttgggtgcttttgttcttccttctagtaacaaaaattataacttagaaaaatatataaataatttatatgtatttgtatatttaaaaatagaatatgtatcatttgatctttcagtattcaatccttatcaagcacttaatttttaatttctgtgatgagtgttttcatataatttatgtaattttgttgcacttagtaatgagatagtccctacccgcagcctcctccatcccctacattacctaaattaattagtatacattttttagtcatgtagatacagaaaaagcttgccctgaagctttgcagatttggtgagtagtatttattatgcaaatttcctaagtgttcaaagataagttattttccagcatttccagtaggaaatgattggtagtatttctgttgagtacacaaagctgatttcgcctttgaatttaactatcacactttagcaccggctctattgaaatgttaatgcacatgtgacgtgccaacatttagaaaaatgtaaataaaattggaaagttccaggtgaatttatatgttccctaaaagctgcagaatataattactttttgactttcttcattctggcttaaaagttatagtttcatgttcatttctgcttttcaacgccttgtatcttatgtctcattcacccttccccactaatctcctgaaggcatagcacatgaagcctattatttaagaatgttggctttttagtttcaaaggtttaaatatgaatcttggctcagacttctaactagcgatgtgattttaggtatgttacttgatcttcttagacttagttctcatatatgtagaatattaaaaagattaaaacctcacaagattattctgaacattcagcaggaaaagtaatataatcttttttggttcagagcagttttagatacatttaagctgatatttttattttataatattcacacaacaaaaagtagattgctgaagctaagaaacctataagacacagcaaccacattttcttaatccagtctatcatttatggacatttgggttggttccaagtctttgctattgtgaatagtgctgcagtaaacatacgtgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacattttaatgatcgctattctaactggtgtgagatggtatctcattgtggttttgatttgcattctctgatggccagtgatcatgagcattttttcatgtgtcttttggctgcataagtgtcttattttgagaagtgtctgttcatctccttcgcccacttgttgatggggttgtttgattttttcttgtaaatttgtttgagttcattgtagattctggatattagccgtttgtcagatgagtagattgcaaaaattttctcccattctgtaggttgcctgttcactctgatggtagtttcttttcctgtgcagaagttctttagtttaattagattccatttgtcaattttggcttttattgccattgcttttggtgttttagacatgaagtccttgcccatgcctatgtcctatgtcctgaatggtactgcctaggttttcttctagggtttttatggttttaggtctaacatttaagtctttaatccatcttgaattaatttttcactcataggtgggaattgaacaatgagaacacatggacacaggaaggagaacatcacacaccagggactgttgtggggtggggggagggggagagatagcattaggaggtatacctaatgctaaatgacgagttaatgggtgcagcacaccaacatggcacatgtatacatatgtaacaaacctgcacgttgtgcacatgtaccctaaaacttaaagtataataatagtaaaattaaaaaaaaaaagacacagcaactaaacgtcagtgccttgggggagctatatgtataattgttctcgcttccgtgaaaagccaggaagacaacacaacttggagaactatccctgaaggaatagcacagagcagaaatacaactcaaaaccagcgaagctatccccagggatacagagaaagagtctgcaagcattttgcaaagcaggcgttgaaagagaaaaaacttccttggagagttgtgtagcagatattagaattaaccaatagatagaaatatagaaacagaattgatgaagaattgataagattttgagagaaatgacatcacatttttaaaaatcaaaatgcagtgaacccctacccatttaaaaatttatattttaacattcctgaatttggaattgattaatgtcctgtcttcccccatcaagttgattttctatcttataatcaagtcataatcctggattggggcaataaaataatatatgctttgctatattaactaatacactttgaacaattgcagatgaaaatataaaaaaaattcttctcatttaaatataatcgctcatacaaacacacttttatataaggccattacaatataggcagaaatgggatatagaatataatgagacactgaagaagagtaatctgggatcatggaaaaggaagatccaaatgagatcatttttcattgctttgatcaattccttaattgtacaactacaaatctgttatttatggtttgtaacagataggtacatgttcagttcactctttggttacctgtaggtaagtgtcacctcacagtgtggctaaatcacttcgaattgaattttttgttgtcttcataaagtcctgaattagaagaattccattcttctatgagacatagatactaaataaagctttaaattgcaagtaagaattatttgacaaagagaacaggctgtggccattctaagaatggtttccagataagcctgtttctgttcggtaactgtgttaacaccctgctgtgttcttacatggtcctctattgtgtattttaacctgggcattgaagtgcatcagcaaagtctgaccaataactccaattgacttttccaatcatgttcccattattgagtctttgacatccaaggaaagcatgtctttctctgagcatcctctgtttctttttgtctcttattttatgccactcataaagcttcgtttattgtgaaataccctccttgacttatctctgtaggatgaaatcctaaccaaacttcaaagcaaatctcaaattgtcactctccaataagatgaattgattatcataatattaatttcttttctcagctcttccatagcatatgattatacttctgcctttagcattttctacagttagttttgcattatactattttctagatttatggctctgattatctacagttctgtctttcccagtagaggtcacacatttattgagcacatactatatttggaattagcagtgttgaaatgagatggccgtattccttgctttctcagatctcaagtctactgaggacataaaaaggataatctctaaaatggaatattggtaccattatagataataatagggtgtcatggggctaggaaataatgtgggcctgggtcagaaaaaacttcctggaggaaatgaaaactctgtaaattggcccttcattgtatctctcacttaaaccattttgggtggaattatgtttcctgtgaatccttaacttatatttatgattacaaaaaataagatttactcctttttgattctttgtgtaaagctctgttataatattccttccattcttccttatatttacatgtatgtgcaagtgtgtgcatgtgcatgtgtgtactatgtatttttgtgtttgctcatcgagggggactttgaaatcttgatcagggtatacacagtgtttctttacacttgttactctgaaattatctgtttcacgttcatacacttttacaaggctctgaattctttttgggcaagtgccaccaccttctcataatcatagccacaggtggtcagctcatatagggcaggcaccctgtaaatgtgttgagctagattgattaatgtgtctatatgcatttttttttcctcaggagaaaaaggtctgttgaaatctttagttggaatatgtgaatattcttgttactatatatagtctgtaactatatggaggaaaagctttgagggtggaagagacatttgcaagctggagaaaaaagaatgtgtcagtatatgagggaatggtagagggaaaagtagatggagtgggaagctgggggcggtgaaaggtggtaaagtgagacactaagtgacaataaaccatttaaaaataatttgtcccaaagttctggctattctgaattcatctttgctgagaaattttacatttttggctcaccttttgggaaggtggagatttaggctagggaaaaagtagacaagtacaagtttccatggaaacaattaccataaaatatcgaccaacaaagatattaggaagcaggaaaggaaagagaaaaaagcaggaaagagatagttgccatggaaacatggacaatcagagacatgcacttgaagtgattccttcttatttattttagttaaatacctgattaaaattgttatactttagtttgtggtttatttttaaatattcataaagatttgtttaagaacatgtttttctatcttggtaagttataaattcacaggaattcagggaatatccttttattttgattggatatgacatcattttattgattacaaaatccatttaaaatatggcatttaatatataagctatgaaagcattattttataaaaatgactgtttaaaatttactctttcttcagagtaaattatgttaataatttttcttaatgaatgttaacatttttcttaatgaagtttaaattattgcttttaatttgcattgactagcagcataaaatactctaataatattaagagagggtcattccaagcattttgatacaataaaagcaggctcactttttctccaaacaattttgtatgacttaaattttgagatcctttttaggtttacaattttattttggttattttggctgtccacttactatataaacatgaaggagttactattaaagacaatatatctgtagtggataattatataaagattagatgattcaaaactgtcccatctatagataaatgcaactcagagaaatttggattgataaagcagaatattaaactccaatgttggctataaatttgtaggattcaattttaaagttccctttgaagagtactttgggaatatattctgaaatgatttcttattttttcattgctgtaaaactgaaatgtaaggagcttacatcatttcccaccagatactgataggaacttaagtattcccttaagtgtcaacttaaattgaattaccttttttgagaattactttcccctcctggctgtcacctcttgtcatcttctttggcatccagagttcagcattctaaaagaggagcatgtagacctcctgtggacagcttccctgttatgacagattttttgtatcttaaaaagtagcttctttagatgctgtaagactacgtgttatcgataacctttgcaaaataaagcatgttgatttttcagactctgtgggcaactgaaaagcccttttgttttcttaaggtcatagaactttataggtaggaggaacttagaggttaatttgtacaactctttaattttaaagcggaaaaatttgaggtacaaagagcctaggtgacatgctgaaggccatgtcgcctgtttgtcagtttagtgttctcttcacagcaccagtacatctccaagacatggcttggctatgttttagcctacaccttcatctctcttaatctacccctaagccaccacacgtacatgtacacacataaaccgctcactatgcacaggaagctttaagccaaatcattcactgcatgcttctcctataaagaaaattctgaaggtccatgaataccatgtaggctgcttaagaaataatgagcaagcattgaagtaaaagagtggtgtccttatttctaagtagaattaaccttcccctccaaaagatacacatccacatcattatcaagtgtaaaagacagctgatttccaaaatcatttgatttggactttccttctcttttcttagtgctaacatttttcacccatgttgctaacattttttcaaatgtgtggatatttccttataatttctctaagagaaattctactactaaaatgcttttaccaattttagtttgtagacttaacatttctgggggaaaggagtgcaagcagctaggtggccctccagactactaacaagctggagagtggagttttccctgttaaagagtgactatggctgttttgagaatcttggtgcctatacaatgcagcctttcaaaatggttcccacatggccaactcactaggattctctgtctttccattctagtttagttattaaattacacagaattattcaggtatttagtcctaaatacctgctctgttctaggtaaccttctaggttctaggaacatcaaggcaaatcatatatggtccttgtcctggaattttttcagtctagtggggatcaaagtggaacaaatagaaaataaagtataatacattgccataatagaaatgggatctcagagcaaacacccctaatgcacatctgtggaaactgtaggattgatgaaggtggaggtgaagtaaacaaacaaaatttaaacagcaaataaaaaaaatcccacttctctaacacaagttgtattcagcctttagcccttttttttttttgtacattcagccagttccttatagaaacatatttgcccttgtacagtgatttgacaatgccctcgctggggtttgatggccaggcctgccggatcttgtgattctctgggacagggattgtgtcctgctgtgtctgctgtgaattggtgcgcccaacagattgaacccttccatggcacatctacgcacctttctttacaatgtcacctagtacttaagagcaatctgtgggattaggcagatctgtgtttgatttgaggctttaccacaaactgtctacattatcttgggcaatgagactttatttcttcaaacctatttcatgttattatggtgagaattcaatgagacagtgttggcaaaagttttagaagagtacctagacaggaaagtctcaataatatgtcaagtgctttatgatgacacgtatgactatagaagggatggggaaactaggtactagcagtcttaggagcccagctctgtacacccagctcatatcaccctcctccactctctcttgtcccacctccctttcctttcttggcatgtggtgatgcaactgtgtctcccccttgtgctttttgaaaaaaaaatatttgcagccagctccaagttttagttggcaacaaatccgatagtaaaccagataacatgcttctctccaaagtaaatataaactgtatcaatagaaatgtagtttttggaactctggaaattcttctctggcacccttgtggaccatatttgaacacttagcctagtttcagatgctgcctctaaggacattaacaaacaagaatgaatcctaggaagggtgtgtgtattacttaatggtatgaaaaccatatcatagaagaaaaaagttcaaagacatagagataatagtgtggaaaggagtagacccagggtatatgagagctaaatttaatacagatagggctttaatgtcgagtgcagtgttccttgggaacttcaaggctggaatccctcagccattgcttatatgttttgagcactgtaattcgataggtggatagcacctgatcttcaggcaggcaatcttacccatttcaggctcactagctgtgtcagagaaggttgtggaaatgtgattgctcatggatatgtccttggaagagggactggaagacctttggtttaatgaattcatctgcacatttataatggtgagcatatccaaatgttttcttggtcagaaaaatttaagtattaataataccttccttttgtgaggaattgtcaggtcatgcttcattttgctcaataattattttatctcctttctaatagtgctgattaagcactatttcatttatttaagaaaagcttactgaacggagatacttggacaaaagagaacaaagcccatgctcgttgaaaacctaagtcctatgagcaatgcctttatttaaattgtactaatattacacataacaatatttaccattttaaccactttgaaatttacagctcatggcttttagtacataaacactattttgcaaccatcacaaccatctagtttcagaatattttgatcatgaccaaaagaaattctgtacccattgaaccagttgctcctcatttccccctcccccagtccttggctgcactaatctgctttctatttctctctatatgaatttgcttaagttgattgttcatatgaatgaaatcatataatatgtggcctttgtgtttgtcttcttccactcagcataatgttttcaaggttcatctatggtgtagtatatgtcagtacttcattcctttttatggctgaataatatttaatgttatggattcaccatcttttgtgtatctgtttgtctgttgatggacattcgagttgttttcagcttttggctatcgtgaatagttgtgatgtagagcaggtgagcccccaaattgggtcttagcgcaggagggtttttggctctgcccaggaaagaaggggattcttcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacctttgaattatttcctgggcaaagccaaaaattatcccatgctaagccccaattttggggttcacctgccctacatcagctgggctatgaacatttttgtacaaatttttgtttgaacagctgtttaaaatgcattgggtgtatgccagagagtatcattattgctgggtcatatggtaattctttgttaaacttattaaggaagtatctatttttctaagtgagatttccaggttttatagttactggtttacatgcagtttgtggaattagaaaaggttctcagggcctttattccctctttttgagagatttagcaatattctgtttgacatgagaatttctaaaaatccatttataatactgaccaaaattataatcctgtgaataaatttttaggaaagatcttatctaggaggggctttctatatgccctacatatcattcccatttcacaaggagttgtgcaattggagccctggccttgctgcctcaagttggtctctggcaccatgcaacgggaagaagacctctgggctttgtgagctgaactttggctcatgctcatgttcaccaagcagaaatgttctttccaatttttaggtttttcaggagaaactgaatatctaaatttttatatgatgatcttctatgtttttaatgccggcaactcattcacatttaaacaaaacaaaacaaaacaaaacaaaacaaaacaaaacaaaacaccatgggccaagcaaaacaagtctgggagctgaatttgatgtgcaggccattgatttactactgctttctttttctttctttcttttttttttcttctaacttttgttataggttcagatggtacatgtgcaagtttgttatctgggtatactgcgtgacactgaggtttggagtatgaatgaatccatctcccaagtaggaaacatagtacccaataggtagtttttcagcccttgcccacctgctcttcttatatttcccagtgtctgttgttctcacctttatgtccatgtgtacttgatgtttagctcccacttgtaagtgagaacatgtagtatttgggtttccatttctgcattagtttgcttagaaaaatggcctccagctgcatctacgttgctgcaaagcacatgatttcattctttttgatggctgcataattttccatcgttatatgtagcacattttctttatataatccagagttgatgggcacctgggttgattcagtgtctttgtgaataatgcagtgatgaacatatgagtgcacctgcctttttggtagaacagtttattttcctttgggtatatactcagttaaggaatttctggatttaatggtagttcaacttttagttatttgggaaatctccaaacggatctacacagtggctgggtacatccccaccatctgtgtatgagttcccctttctctgcagccgtgccagcatctgttgcttttagactttttaacaaagaccattctgagcagtgtgaaatggtatctcattgtggttttgatttgcacatctctgatgattagtgatgatgagcatttcttcatatgtttgttggatacttgtatttcttccttgagaagtgtcctttcatgttctttgcctactttttaatggggttacttgtttttcgcatgttaatttgtttaaattttttttatagattctggatgtttggcccttgtcagttgcatagtttgcagatactttcccttattctgtaagttgtctgttgactcccttgttagtttctcttggtggcagaaactctttagtttaattaggtcttacttgttaatttttgtttttgctggatttgattttgaggacttagcgtaaattctttgccaaggccaacatcgagaagggtatttcctaggttttcttttaggatctttgtagtttgagatctaacatttaagtctttaatccatcttgagttaatatttatatatgatgattggtggtgttcagtttcattcttctaggtctgattgctttttctttatgagcataccaccactcagatgattacaatacaataaaatcaataatagctaatgcatttatgctaaatactgtgttctggcactagtgtaaacatttaacacgtgtcaacttaatttaattctcatgacaattcagtgaggtaggtgtaattttattgccattattgcaatagcacacttttcagagtactttggttatttatttatgaacttgatttcctttatatgttgaaagttccttgtgggcatgaaccacgttttacttacatttatgacctcagaactgagtccagtgcctaggatatgtagatattctctaaattttggttaagtgaatgaatgaatggtatactgccctgactataattctggtctgccctgcaatagtaagaatactcactaatatttaaggctttctgtgtgtttgggacagtgccaggtacttctgagagatattaatttattattaaaggccacattgtgaagaacttgggttctcagtctctagaaataaatagacttcccgattcaaatcttgcctttaccaatttttgtttgtgtgatcttggtcaaataacataactctatgtactttattttttatatcttcagatggtgacaatgatgtaataataatcatacccaacctcttcaaatgattatcacattctctgtactgttctaagcaatttgtaaaaattatttctcacaatggtagccagttcgtggattttgtgagaattaaataagttaattcatgtaaagcatttatattttgcttggcacatagtaagcactgagaacagttggttctttgtattatatccattttacgaaagagaaaattgagtagtagagatactgagtccatttttttaaggttgcatggctagtaaactacagaattgaaattgagactgctttctaccttgcttaaagcctctttctttctttcttttttttttttcaagatggagtcttgctctgctacccaggctggagtgcagtggcataatctcagctcactgcaacctccacctccatggttcaagcaatttccctgcctcagccttctgagtagctgggactacaggcacatgtcaccacgcctggctaattattattattattttttgtatttttagtagatacggggtttcaccatgttggccagactggtctcgaactcctgacctcaggcaatctgcccacctcggtctcccaaagtgctgagattacaggtgtgacccaccaagcccggcctaaagcctctttctttaatcaccatgttgtgcagcccatctccttatatacactttccccttttctccacctatgtagcatgtgcttaatctctagaatcgagacaaaactggttatttctcccttctccaacccattctagtgtttactgggcaattcgtcttttaaaaatcatgacagcttcctcattatcactatcataaattgtactttaaatctgttcatagatcttagatcttgtcttttcatttttttctgcatcacagcctagcacaaaacctcatatgaaaagcgcataatacgtgagaggttctagcaggtgggaagaaccactttatcaccttcatcaaagaacactcctgttctcttcaagtgtgggccacttagagttttggatggatgagcataaaggagagaaagagacccaatctaacccccacaatccactcatcaattcccttatttattcaggaaatacatgtagatataatgaataaaccctgatgataaaaaatgggatggattttgccaccagacagcctgcacatctttctcttatagtgtatattgattctcttaaaacagaattaaaaatgaaaatgtatgctctgaacacactctctcactgtctcggtttctgtctctccctgcttcttttctctctctctctctctctctctctctctctgtctctgtctctgtctcttggtctctctcaatttcatttaatgcttttttattttcagtggaccctggggagtggacaagtatttctagttaaaatataactatttatagttaaactcctgctgattgggtcacagttacactggtgccctatttggtgacttgagggagcttgaggatttggaccctttatctctgtcattttgtatatctggcagcctacaggttacatgtgaaatatgccacatgaacctgccagtgctttaagttcccagcagatattctgcagagtagtagcacatcgtttttgtagtacatctgtaatgccatgtaatgccactcaccaaattccagcaaattaaagaaacttcagagaattcaccacaaactgattagagaatagaaagagttatttagagaaaagattaaaggagctaattagcacagcttgatggagtggggactaaagggagagctaatggctctttgatattatttgaagatactaaatgtcaaggaggaaaaaatattttgtataatgcaacaaagtgctattaagagcaatgagacagaactgagaatgaaagtattaaaatgaagtatgtgagaactctattaaaatacaatttgttaaattgtgaagtagtctttccaattatgaggtagaagatcttcctcaaagaaataaaaatacacatataaatatatactaacaagctttaatgaaaataattttaatacttgttggacagtttaaatggcctgctgttttaaacgtttattaatttcaaatttgagcaattatttcatcccaacaaaagcctgttctgtcctcagatatttctacatatcctgaaaaaccctaggtctctaactctgtaagagaggctgagaataccaatattttaaaaattattctttaggatttcgtttcattggcacatctctgagaataatgggagctattgaccagattgacatttctgtggttttgtgccatggcattttccattcccaagtgagaaagttattccagttcatacagaaaaaattgtgtcaaagtgttaccaaccaaattccacaaatcaccatgacactaccaatagaacatgcctgtaatgtaagttgttgaaaactgagcaaataagatgcgttgacaaaaccagtcagtctaagaatattgttatctttttaccaagtgaaaagatactgctttataacttgaattgtagtattggggaaaaaagggaaaagaagagacttcattacatgagtaaaattcaaaacataattattgaaaacattagcaaaggttttactgtttggatgttattgcagaaatagcctgagtttataataaaaatgataggaagtctatagaaaacaaagtgggaaaagcatgtcttcgccagtgtgtccccaggtgctgaggagccccatcttagaggcaacatcaaggtgtcaccatgtgttacaggtacactctggccttcttatcgcttattagagtgttggagatttttattttgaaatattaaatgtatttttcttttcttctttgttaacttttattttagaattgtgggtccatgtgcaggattgtcacagaggtatattgtataacgctgaggtttggggtatgactgaaccatcatcctggttttgagcacagtacccaataggtaggtagtttttcagcccttgctcctatccctctctccacaactagtaggctccagtgtctgctgttcccatctctatgtccatgtgtatccaatatttagctcccacttgtaagtgagaacatgttgtataaatgagaaagagatctcccatcttccatttggtccttagtccagaacttctaaaacattcttccattttttgtggtctgacttactcacggctactgcatcttttacaaagctttctccatggtcttttgctccatgtgaggaaattcaattttagtctctatttcttccttttcccccataaaaattgctgtttagtcataagagataaggcatctaacattggcatcaattgagattaattcacctactgcataggtctcttctgttatcaacgttctccatttcattcaaaaacttcagtgctaggtcctcttcactcgaatgttaagtcccaccagcctttgtctgagaatcttacatagatgatattccatgtcccaaacattctgaggtctacactttccacatagaatttcaacaaaattcaccttataaaagaaatttagtgaaagtaagtctctttgaagtaatgtttaaaaaatctcattgaaatatatattctaataacatctatctatactaatttctcaagtagaataaagtgtatataataaataaagaaaattctatgtatggaattagcaattcaattctatattgttgatgattctaaaggaaatttcatgttttatcaggaaccctggtagcaatatgaactagtagaaagtgtccagcctatagtagtagtactggagagatttggtcagtgttgtaacagtttgctctgcacgacaggtggatatataaaagcccatcttttctttactataaaactttctacacgggagtgaaaagtaaaactctctctctctctctctctgtgtgtgtgtgtgtgtgtgtgtgtgtgtgtagctatgaatactctggatttgcaaaaacaccactttgcccattaaaatagcatgtactcatttcacaagtcatctagtctaacatgtcatcagattcctggaaaggaagcttttagtgaaatactctttagatggactaatatattttatacagtcttataatacaaaaggagagttggaagggcatatgcagaaagaagtaagaaaataaaatcagaggagcattaaaacaaaggaatatgatagcattcactcccattccccaaatcccagcattgattaacctggtcctcattgcatacttcatcaggtgctactttgcagtcttcttttactattgacttttatgcttattttgcttttcacatctactgtcctctactggctgagaacaaggagcctcctttgttctctctgggctccttgcttatccacagtaggagagcattttaaacctaagtgaatacctacctgtggaatcgatatgaagattaaattcttatgaagtacaaggtataaaaaagttatctggtttccattacttctgtttctcttttgacaggactttctctttttccaaggcccattcccatttccttgagtaagtgtataggctctggcatcagaagacatgggtttgaatcttggctctgtcattttctagttaagtatccttgggtaaattggctcaatgtgttgtgcctcattttgtcagttttaaatggagatagtaatagtatctactgtataggaattttgataggattgaaataatatatatatatatatacagtgcttataaagcactcagtagaaaggctcaataaataaatatttgtggtagtcattaataatatatatttatccatttgatttgttttccaagaacaaaatttaattcattattcactgatgaaatttgcttaaaaatattatgagtatcatgtaggtttgaaatactatgctaggcatctgtgaacaagacagaaattgtggtttttctgtatgagttcagaatctagtgggagataaagacaagcaggaggcaatgggtaggacaattactatgattaggcttgacctttgactcattcatccctcctccatagccaatcacaaaatcctctccaaagaaagaaatattttcttcaaagtatttcaaagtctctcctttgcagtcttctgccgcctccctcatcctgcagtttgttgttgctttgtgcctattaccacaacagccttctagttagtgtccatgcctatagtattttctccttcattctctgcctgcgtggccacattaatcttctttaaacactgctttcatcatgtcactgccctgttcagtaactttaaatagctcgcttgtgcctcctctgtcaagtctgaagctatctgctaacttataagaccacccaccatcagtccccagcctaactatataatcattttttccacttctcctcacagtatagcaggcattctagtgagcatgaaaactgcatgccagggacactcaatcctacctccagacttatcactattgtcatagaaatgactaacctttgagtgcttaaggggtgctaggtattgtactcgctgttttccacagtttatctttaatttttataaaaccaagattcttcatagaccttattatcctgatttacaaatgaggaaaagtattctgagagggtcaggaatccaggatccaaatccatgtctgtttcatctcaaattcctccttcttttcactgtacctcctccattccatgccgctcatttgacccagaatgtttttctcctcattctatcaatacaaaaaccttaaattatctccataacctaagtgctggtttaagttctatctgttttggaaaatcactaactctttggaaaatctgtaactctcccttcactaatttccttcattgttaaactcctgaaatgctaaccatcaatatcaccttgttcctaacctttacacttgtatcatatggtattattctgtatgtgccagtcttctttcttcagctacattgtaggtatattaagcatgaacactccatgttatgtcataatctctcagatgagtggcagtttttctcagcctgaagtgtatacataatacacgcttgttgataggattatttgtcatcctcagccattgagttatcttattttcttgggtccatgcggtcagtacagaaagggtaagccttaattcaatttaaaaaattatacctcttacaagagagatagaaaatataacaagagagtacatgttggggtgaaagaaaatagaaaaataaaagtggggacaaagttgctgggaatgtgactgaaaacatacaatataatgctggaggtaggtcctgtttcctatcagtcaaaggtgaaaaaacaggagccttctctcttacaaaatgtattgttcagaagataaaacgcaaatcaatcgctcataagcagtaaatctatatttggtatcaagaccagacagaaatttctccccatgcgttctcattaagaggaaattgagtaaagtcatgaacacccttgcaaacattattacagtattaacaataaagagcttcttaggaatctttcttataatgaccctcagtctggccaatgacatcatagcaacaaagtgaaatacattaagaacaattcctcaggtggggaccagagcaaactctggtttagaccccaagaaactcatccagtagaagggctgagggatcaaccctcaaagtaggtgctgttccaaatcaatgctctaggggtctggaagctcaggtgtggaagtgaggatcagatatggtaggtctggcctgcttttagtcttttttcaggtatgtgatagtatcttcattctacttggtgatctgtctaggttttagtagaaatttagactgtggctagcactacagtggaagggattctctctgctgggaacaaggcagagtcccaagcattgggctgaagttacaggcatagttcttgttttggttggaaacagaggtactgatcaagaaaccaaagtgaacagccagtcacatgcatagagttagggcagggatggtgggggatgtgggattagcttgatggacttagggatgtgctggttcactcagttaggatgcaccaagtatcacgattagtaaggatggggctggaaatatacctatgccaggctctgttctcattggctcagcagtggtccccagtgtgtagaacggaatcgcctggggatgcttgtcagcatgcacatccctgtgccctacccaggacctcctgagtcaatgtctttgcaggcagctgcgggtttaacaacctccccaagtgcttctgatgtagactaaaatttgagaaccattgaattagggagtaagtggatgaacctacaggtttgagatataagtatctgttcttaggctgacttgaagctaacattggacacagagcaattttagtgggacttagaggaatagacaccatcaaatttttcataaagcattgaatgatgaaatggcttggaagaagtcattgagttaaaaatggaatttttatgacagaagtgcaaacaggaaaatttaaatgtcctcttaataatgagagaaggtgcacatttaatgaatggggaagttttaatatgagctagcagcacaccctgcgtttaccttcatggaaagcagctctcagagcacctgagaagttttattttgggagaagggagatctagagggcccacatgcagctagggaaataataacttgacagcagatgaaaacaaaatgataggttgctgtaggaaacagagtggctgggtactctgactagaatgtttccctggttctgaatacattataactgcaccagcacgaagatccagggcatgcagtacatatttcccttggtcttgacaggttatggggaatcatgacaagctttgccttgtcaaaaaatagatgttttgactgcaagtttgcgcacctgtctttgatgatgaggagctcatcccacgctgctgcttgttgtgttattgtttcatttgtttgttgtgatttaaaatggagaaagaaaagaattggggaaaacgtttgaaccaaagcaatcagataacttcaataataaaatgctacccaggcttttgtgataggaaacctatgcaatcccactgctaattctgttctcgctatagggattcatggagcctattttatcagctcagtggggttcaatgtctctccactccgatgggaaaaaagtggaattatcaccagggtaatgaaaaacaccccatcccatgtttatagcatgttttattaaaagcatgttgctttggcctcatataccaattgcaatatgtgagtgtaagatgccagaatagctctcaagggaagcactttccttcgtgctaatttaaaattcctcgaagagcacgcagtcaggtgtggtgttaatattttgtatcttttctacctgagattttcataaaggagatgataggtggagtagagtaaagggtcagctgagttttggagccacctggccagggctgggaatttactatgatttgctttcacaactattctttacatttctgatagcccacactctcttattttatgtcataatcattagggaatttgaatgagtgttcctattatgattaagtaaataacattttacttataatttctgttaataaccacattttactttgtataaattaattttctattatgccagtggaattttcacatttgactctttgtttctgcgaaccttaacccaatgttgatttttgcaaactccaccattagttccttccaattagcatttcattctccagctcatctttatcctaattctttcaaaactttagggcccatattaagttctaggacaattaattcctaccacagtgtgtagttgagtagaggaggtagacttgtaaagaaataacaccaatatagtgtgacaaagataataatagaggtgtttaaagagagaagtttaattgagaagagtgatatttcagttaggtcttaaaggactgagtggaaattcaccagactttgaagagaaaggtgcttatgcctgggagagagacctgcatgtacaagggcatggagttatggaagaacagagtgcttggcatgttcagagactagtggataagtctgtacctgttctttatattcacgtattgcaaaagataaagccagaaaggtaggatcaaaattgtgaagttccttatgttctatacagttgggcttggtctttctcctatgggtattgaaagggcagtcaatggcaagtaggccagtatttttaaaagtatcttacaaagattactctggcagaagtatgcaaaatgatctggaacagtccagactagtggcagggaagtcagttaagagtttacggcaatatccttcgcccactttttgatggggttgtttgtttttttcttctaaatttgtttgagttcattgtagattctggatattagccctttgtcagatgagtaggttgcgaaaatttcctcccattttgtagattgcctgttcactctgatggtagtttcttttgctgtgcagaagctctttaatttaattagatcccatttgtcaactttggcttttgttgccattgcttttggtgttttagacatgaagtccttgaccatgcctgtgtcctgaatggtaatgcctaggttttcttctagggtttttatggtgtccaacaatgatagactggattaagaaaatgtggcacttatacaccatggaatactatgcagctataaaaaatgatgagttcatgtcctttgtagggacgtggatgaaattggaagtcatcattctcagtaaactatcgcaggaacaaaaaaccaaacaccgcatattctcactcaaaggtgggaattaaacaatgagaacacatggacacaggaaggggaacatcacactctggggactgttgtggggtggggggagggggggagggatagcattgggagatatacctaatgctagatgacgagttagtgggtgcagcacaccagcatggcacatgtatacatgtgtaactaacctgcacattgtgcacatgtaccctaaaacttaaagtataataataataaaaataaataataaaaaaaagtttacggcaataattctgagactagctgaggaaccacagcttgagctgaggttgttgggttggaagaacattgctaagtaaaggttaaatgaacttggtgattgcctgtgtgaagcagagaagaggggtggggaggacacagtgaatctgaagattctaacttagggaattggctggtgctatgtcaactcagacaaggcatctgtgagaagagggctatttatttattttttaaggacaggaagttagtaagtcagttttaggatgatgagatccaagaacctctgagtatccaactggagatgtttagtatttagtcagataaagaagcctggggctcaggaggaaagtctagacaggagacatggatttgggagcatggggactaattattggtctgcctgaatcatgaatttacaatgctattaatataacctattcgtacagctgcattacatagatgtctcatttacagattctactctaataattcttaaatatttttacattttttgctactgtgtcagatctaccctatgctatacttgtatttttgcacctttttagactaagtgaagtagaagcctgttaatttatcttttttcaatgtcaatactattgaatattcaacaaagaagtggtcagaacttgggcttcagagcctagtagtcattggggctttttttctcttctcccggacacaatgccattatatccctcctcttcccccatctccaagtaagatttagctacgtgactagcttttagctcttgaaatgtgagtagacagatcatgtcatttctaggtagaaactttaagagttagtttgtgattcatcacatcctttttttctgcatctgcagccttggagatagaagccctaccaacaagggttccgaagtgactgtattgagcagagttctccatatgacccacattagacacgtagtgagaatgagaaataaaatgtactgcactaagccactgagattgacattgttgttatgaaagcataagctagccagtctggttggtaaagaggtaactagacatggactcaagtcctggctctgtcactaactgactaactgtaaaaaagttacacaacttcttaaagctccagtttcttcatttttggaaataattatactgaatttgccaaaactctgtgagaattagagacaaggtatacaaagtaccttgtaaacaatagccatccgctacgtagccgctattaaagtctgcatccatcattttagatagttactcaattttagtgttttgattttgtaataccttatggtggctatcgctctcagatttgtgttgtgttcagatttcttgaaaatgttttctccatgtttatctgagaaattgttaaaaataaaaataatgaaagcaagatatggccaaggacaggactgagtggtcatgctgacatagatcttttcacatttattaatggctgtctttagataaagttgtaaaattaattcaccttgcaatggccccaaactccccatcttgtttctgaggatacagaggtttttttttcataggtatcctataaaagagttgcttagccagtcaccttgctacgactgcataagatataatcacatcaacttcttaaacatttgtaaacttcttaaacatttgtaaactatttgttttgtggtatgttggctttttgtctcaaacagctgattgttctgtgtattatgaagtactcaaatcatttctgagccattatctttgctcacaggataattctacatcaaaacttctgtcattatgctattatagagttatttttctatcatgatctgattgcctgcttatactatccaccttatttaaaatgcttcattggtcacacaagattttatctatttgtatataaactaaaattcaaaatctacttatggaaaaatatctcctatacccttgatctatgtagatgacaaactcaactcttaggaaagagaagaagggatgataggaattacatctcataatttcattttgaaaaacaaaagttggttggtatcatggaagagataggaatttcaggagagagtgaccttagctaatatacagataacaaaactgtagaaagacaagagtattaataaggcaaatgtatttgtagaatagcagaaagaaaggattaccttcagaggtaggcttggtataaaaggaagtatctcttcttatgatggacgagctataaagctataaagcctatttcttccaggggtgatacagctggaaatatgcttagattctaaataggtttagatagatttataaatacatcaataatgtaccatcaagggcaggacaggtcataggaacataaatatgatatttttgaggggaactttgggtggcctatcacctcatactcttaagagaagacttatgttggatggttcagcagcttgaccaattttgggacattcctttgttcttataagtgttatcatagtcaaattactcagaggaacaaatagttacaaactccccgaggtcttagatgacaaaattatatatatatatatataatatatgtgtgtgtgtgtgtgtatgtacgtatatatatgtatgtatatatgtgtatgtgtatatgtatctgtatctgtatataagtatatgtatatatgtgtgtgtatatgtatatgtatgtatatatacatatatatgtatgtatacatatgtgtatgtatgtatatagacactgacattactcataattaaaaaacatcttaacatttttgagaaagaggcaaggacttcttttacgctgtatgacgggaactagagaatgttgaaagtcataggtctgaaaatgtttaattacaagtgcgttttctttaaaatctatccttcagttgagatgacagtagctgtcaccacacccctttccctaggtagccaaattaattgggaaaagaaaaaatgtgttcattggagtggagtctcacacactatcacagtgcccttgacagcaccctgttgtggcccctgttccacctatgtgatggcctttcagacatgacaaacagtttttctagtttctttaggtgaaaagatttaactgccaattaacgagacaccctaggtttaaaaaaaagtgaccgtaacttcgtaattttattttcctagcatctgttctattcaagccaagcctactgcggtgatcttcatcaagacaattcaggggtttcctagcaaccaagtttcctgtggtttccttggttatatgtaatgacataactcttatgggcaacttcacaaaaacacagaagaaagccctcctaaagaatgaaattccaaaaaaaatcaggttactgctcactgagtgtctctgtttaaaatggagaaatttatcttcgtgaatgttaatgacactaataaataattatgtagcaattgcaaagtaaaatcacatggttatttgatttctttcattgtttttgttatatgcctgatcttaatttgatttctgaaatcaggatcctttttccatctcttctaattgactgccacatacttagacatatccagcagatgaaaattagacagttaaaaaaattacatgagaggtcatttattaaaatagcagagttgtagttgctcaagagtaggaaccaataatactgcctgttttttactaataaagtatattatgaggtttgtatggcagtatcaagggttattggtggaggccattaaataactgttaatgtatactgagaagtaaattttccatgccagcatgaccaacattagctacttttatgtacttaattgttttttccttctatattcacaaagacaaattatactgggtaactgtaatctttggtgatatatctaatatccataatatgtcaaccaaagaagaaatataaatttacacaattaagagtaaaatttgtgcaacatcggctattcatccttgcattttcagtgcctatcatacaaggcggcttgtgataaatataaaatattggattaatgaatgaccagggctcaacaactcctttggtttttccagtggaaatcagaatttaatatgaggatccccagattaaagtaatgcacacttagaaaaggagaaaaatataattaatacatcagaaatttttgagttagagtacagtaagtcctcacttgttgttgataggttcttggaaactgtgactttaagtgaactgacatactggatagtagaactaattttaccatagtttaattgatacaagcaagagttcagttcctacagcatacagtatatacagtaccttgtttcccttaaagtcacacttttcaagaatctatccgtgaggacttaccatatatattcctctgcatactattcatttattaattaaatatttattatggacctattaggtaccaggttctgtgccaagtgctcagagtacaactgagaacaaaattaaatatgattacagcctcaagaagcttgaaaattcaaaatgtttaggaattataaattagctaaatgataatacaaacaaaagtacaaatactgtaaagacaagatactgtaaacacaagatagattaagccacgagtttaacaaagaaacctcttctgatctgggggtagagtgtccagggatagcttctcaaaggaagtagcatttaagctgagagatgaaggcctaggtaagcataactgggagaaagttgggtgtgggtggggaacagcagagacaaaaggataagcatgtgcaaagactttagaggagcccaaagaagcagagagacctggagttctcatttctgtcagtgggaatgaacctagaatgagaggagatttcagagggtttcaaaaggattcctataggccatgttgagcatttagcagaaacaatctagaaaaagttcggaaatgtggttcatagttacaatttaacctttgtagtattaaatgtatttaaaaaatcacctaagactttgatctgagggtgaaagtttaattctgaagttactgaaatagttgagccccagtaggacagggtttgtggcatgaatagggcattcggacagactgtgctcatggactaggggtcaaaccaaggagaagctgaagtccagcagcagtgtcaattatccaggcaggaagattgaaggcctaaggctcagagcaggcaaaaagcatggtaatggggtggggtggagaaaatagcacttatttaagatgattttattacgtatttgtatatacattatttcatttaattctaaaaaccacatgatgaggtgggtattgctttctccctttttatattaagaaactgagaaatagaaagtgcaaaaagcataccctggatgacatgataccagtgaggctgggattaaaatctaggactttcttgagttctaaaattgtgcttttttttcagtgtaatacattatatttccactcttctgtgcagtaacttgggtcagagtcttgatatcaatatggaccgtatgtcatagctgaccacagccaatgagagaggaagatatttatcccaatcttgctttcctgaggcttctaaccaataagctatactaagcctaacttagttgaagaaaatgccttctttaactttatttaaatagaaccacttatttatgtatttatttatccaagaaactttattaagttatctttaaaatcacatgcttagcaatcattttgaaagtgatgcatttggtatttgatgtattcaattctgcattgagatgaggggaaaaaaagcataacacaacttatgccgctcatatcattaagacaaatatggaaaagtagaagggacccagaaatcatttgggcccttgatgttctttcattcattcaatcaattttttattgaacttctcctatatgccaggcacagttttaggtattctggatattccattgaacaaagtccttgatatcatgggaaatagacaaaaacacataatctaataaattataattcatagtcaggcagcaagaaataatatgaagagaaatggatgagagcattaaaaagtgatcaagtaaggcctccctgaggcagtgaaatctgactagagaccagaaagaagctaaggagtgataaatggaggaagacaattcaaggcagagtgaggagaaatctcaaatactgagacatacagcatgcttggtaggttggagaaatgactgcgcttcagattttctgaaaacttagtgattaatgatttttcaagctaataaactgagtttacaatccttgtataacagaagagactcaaagatctaccatttagtcaaggagctatgcagctgaaactatataaatccaaatctagcctcatttaatatgaacaattgtgttaaaatcaacttcttttctgcattaagatttagtcctttaaagttttcaattagcaatgactgcgcctcagataaacctcattggctatgatattgctactgtgcaaagctgatttagtcctttaaaaactaaaagccactctcttggcttacgaactttgagaatcactttagaattgtttaaggcaaagacacaaactgggttaatttcatagtaaagatggttctctgttgtttgcacagtattttattaattccagaatcatggaacattagaacttaaagtgatatctgaattcatctaaagcaccataatagtagctaacatttatagggccagctggcattctaaatgcttgactcatattagcatattttgtcctcataacctttgcagacataaatattatgcctctgtttttaaatgggggaaactgaggaatataggggttaagtaattttcccaaggtaatacaactattaagcaatgaacctgtgcagtctgactctaaagtctttgcatttaaccattgcatactagacagttggaagaaactgagactgactggttaagtaaaatttccaagatcacacctttggaaagcaaaggtggaatttcagccttgacctgtatgcccttagaatttgagttcttaattactattctgtgctacaagcatcattcatcttggtgaacatctagtttaaactccactttgagaggtaatattattcagtagagtgtacatagactttttgaactagaagagtctttttttaaattcaattatatacttgctattatagcttgcaatcttgagcaaataacttatttaagtctcagtttgcttatctataaaatttgggtagtcatacctgccaaattacattgtagagagaaataaatgatgtattgtgtctaacatagcattgagtatgtatgaggcaattgacatatggcgcaattactgtaattctggagaggaaactaaggtcaaaggaactgtgtcacatagctaatagtggaatacctgggatacaaatcaggttccctgattattatatttcttgccttgaactaaaaaagtactaagtagtgacaagattcacagaaaaataacctgccaatttctccatatgtctgttgttattccaactcagaatctgtgatattaatagccatagccaatttgctgaactcctagtgtgaaccatgctagttctctatgatatatgatgtcatggattgctgtgtaatatcatatgtatcactcttgctttcccaattagatcataacaatcatctcacagggatttgtttcttgtttgattgtttttgtgtttcttctgtatcctcgagcttcaccttcaagtgtgggagaaaaggtcttttatgttaacccacaaatcaactactttaactgcttcttaaatttttaaatattttattttatacttttaatcaatacatgctattgtaaatgtttatgggctacataatgatatttcaatacatataatgtgtattgatgagatcaggataatcagtatatccattatcctcctaacttatcattgctttgtgttaggaacatccaatattctccttctagctagttgaaactgtatattattgttgactatagtcatcctacagtgctatagaacactttgacttatttcccctatctagctataattttgtatcctttaaaaaatctgtgcatatacccttttccttacccttcctagcctctagtatcctctgttctatttttcacttctataagatcaacatttttagcttcctcatatgagtgagaacatgcagtttttaactttctgttcctgggttttttcactgaaactgctttgttgagagatcatttacatgcaataaacagtatcaactttaaatgtacaattctatgagtttcgacaaatgcatacagttgcataacaaccaccacaattatgacatagactactttgtccaaaatggctgccacttgtggctactgatcacttgaaatggggctagtcctaattaaatgcggtataagtaaaaaaaatcatatatatatatatatatatatatatatatatatatatatatactgcatttcaaaggcttagtataaaatttaaatatctcattaataatttatgttgattatatattgaccatatttttatatatcaagtaagtatatttaaattaatcttacttttttacttttaaatatagctagtaaaatattcaaattacatatgtgactggcactatatttctattgggcaatgttttcatagaacattgtgaccacttctaaaaacttattccttgccactttctaaacaatctccttcctgcacctgaactcttggtgatcactgatattccctctgtcactatagttttgccttttttagaacatcaaatagtgtgtagtttttcatatctggtcagcataatgcttctgagagtcatccatgtttttatgaatcagctgtttgttcctttattgttgagtggtatttatcatggatattccataatttatttatgtacttctcagctaatggacatttgggttgtttccagtttttgattcttaatgaagctggcatgaacatgtgagtacaagttttgtatggacatagtttttcatttctactggataaatatatcagaaggggattactggatggcataataagtatacgttcaactttagaagaaactgccaaactgttttccaaagtggttataatactttacatctccactagtaatgtatgggagtttaagttgttccacattttcaacagctttgtattgtcagtcttattaaattttagccattcaagtggatgtctttggtatcacattgtgatggttttcatttatgttttcctttataactaatgatgttgaagatatttgtatgtgtttatttgcctgccattcatatttcttccttggtgaaatgtgtcaatcaaatctgttgcccatttttaaatgttatttgtcttctaattgagttgaaagggtgaagttatttataaacactggatatgatagtttctatttttacatcttcaaatttacttttttttctgcagtgtttaatatcatggcaatacaatgcattgtaatttttcattgcagattttcttctctaaatttccagttggctcttggttatagcctatacttttttcttccattattttatattactctttctctctatcttcttgaacaaatgaaacatttgtagtacttttttaaaaagatccttgtctacaaattctattatatctgttatttttagtcttttaatttgtttatttctctattgtttattgtcctcgtttttctatctttttattaattattggactttttagataatacattgtttgctgctgggtttttttttttttgtattttttaaagtggtgatagattttgttctggcaccattgggatactttttgaatcagtttgatccttctgaagcttacttttaacctttattagaattggcccagagcaccaattagtctagggttactactatggtgataactatataatgattcttgcggatgctccatgtaaacacactgcttggtagaaacatgaattaagactaactctatgtaagctctgacagttgttcagagtcaggttctttcttcagcattgggtagtttcctctcacacaattgcatatcagtcttcagccagactcaaagggatgcctcagcagattctcagagctctatctcagtgcagctccttcatctctggtacttgttcttgcaattatagccatttggccttccataaactctgatctctaccttaactcagaacaaatgccagtctctgtctgggttccccatctctgcactgcagcctagcaactgctttcaggctgtacactggacgttcattgaactcaccctgcttctttaccttttctcaggaatcatgatccatcatttcatagattttctatttcattattccatcatggctggaagcataaggctagatattttaactttgaaataaaatatcatctctgaagcctgcaaaggttacatatgcagcctgagtttttcctttccattgacagttcaaaacatgggcactctgcatgggtcttcaagaggttagttttaaatttttgctccctaggttccaagtaaaacccagttagaaatattaacactttaacattcaagaaagaaagtctaaagactataatgggcgtacctgttgctaaatttgtaaggtttcatttctaaatcaaattagagcattaaaaagcaacttaattggagtacttttctttaactctcccacaaatggctttgctcagctatatttcattattgtgcttttagctttcactaaggccatacaaaaacatcacaccttctggtaacacatgcacacacaaatatagatacagtgagaattgaattaccgtaacacatctccatcacttcctactactaaatgtaattctcagatcctttgttcctggcttggtgaaaatcttgaaaatttttttaaacaatttcatttcattttaagttctgggatacatgtgcagcatgtgcaggtttgttacataggtaaacgtgtgctatggtggtttgctgcacctatcaactcatcacctaggtatggccccagtgtatgttgttcccccgcccccgtgtccatgggttctcatggttcagctccaacttataagtgagaacatgcggtgcttgattttctgttcctgtgttagttttctgaggataatggcttccagctccatccatgttcctacaaaggacatgatctcattcttttgtatggctgcatagtactccatggtgtatatgtaccacattttctttatccaacctatcattgatgggtatttgggttgattccatgtatttgctattgtgaatagtgcttcagtgaacatatacatgcatgtattgaagtaatacattagtggatgccacttaatgtgtttttggtagttttgactcttatttcaacttcattgttctaattcctttttctttatgtcattttgatttttaatggaagaattacattttaaaacaatgagtgaataaaattgtttttctattttggcaatcctaaacacatagttgatattcagtaaactctgataaaatgaaagtaattgctaatagactaagctagtgaacatatgcaagaaattgattacaagtccatttatctcagtcccaagcacatattgacacctacaatatataaaatgttgaggtgggcgccaaaaaataaactgacagagatgtggtcttgtcatggagcaatcacttatgaatttgattttgtattgattcagtcagaacagattgctttctctgcttgaaatgctgccgcttcctgcaagacaccatactcagataatctctcatgtttcttacttaattcaagcccttcctttaacatcacttcatcaaagaagtcttccctggccatgtttcctaaaatacaattacctgtttatattttattctcttactctgtttgtgtctatatgtatatatacagacacatatatatgtacatttgagacagagtcttgctctgttgcccaggctgaagttctgtggtgggatctcggctcactgcagtctccccctcctgagttcaagcaattctccttcctcagcctcccaagtaactgtgactacaggtgcgcaccaccacgctgactagtttttgtatttttagtagagatggggtttcctcatgttggccaggctggtctcgagctcctgacctcaggtgatcagcccgccttggcctcctaaagtgctgggattacaggtgtgagccactgtgtccagcctgtgttcaaatttttctttcacttctaaccttaatttcaaagtaagatctgtgaggatagggatttgggctgatgtgttcaaacagtatccatgagtcttagaacaatgactagtacatgtaaatgcttaataaatattcacttaatcaataaatgaatttaaaaagtgaatcctctatgattaatctaatcatagatatgtttaagtttagcctgaattgtctgtagcttgccagaatttccactggtagccagctgtgtttgaactcatgaaaaatactttccagcttcactgttgttgtgaggagagtattctatgtgtggaggttaactgcacatccccaaagcaacattattgctgaataaagatgcctaatgcctttactattaattatctgtggctatgctaaactgtaagcttttgagtttttatctttgtattttaatagttaatttgaatagaacccagtaatatttttatttttattttttattatactttaagttctagggtacatgtgcacaacgtgcaggtttgttgcatatgtatacatgtgccatgttggtgtgttgtacccattaactcgtcatttacattaggcatatctcctaatgctatccctccatcctccccccaccccacaacaggccccagtgtgtgatgttccccttccagtgtccaagtgttgtcattgttcaatttccacctatgagtgagaacatgcggtgtttgattttttgtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattggtctatatctctataatctaagatcttttagagttttttgggtttgtttttgtttttaagaagaagatttctgcatcatacaaatattctcctttaaatatggaatttcatcatcgtgttttcggggagaatggatgtgtatacctaaatattctttattttgaaatgtgatgaaaatgtaactagtaccagacagactgaattctgtaaatcagaatttattattctagcagcacatgggaaatattgaaattcattttgctgtaagtatagctggtgaagtgagcagtattgttggtttagagatgttgatgttttggaaagttgccattaaggccttttaatcttacattttggacttatgagaaaaatccccggggctattctaaaatcctaacagatgccttctgctaaaatgcgtacaaaatatatctctttttctatattagactttcatatttatttaatacaggaaacaaatatcttttgtattagaaaaaaacacaaatataagggatctgcaagatcctttagatctacttcttcaatttccagttgaaaagactgagactcactttcttgagtcagtacaggactttatcaatgacaggaaattaataacaggcagttctagaaagcagaaacctactattcaaattactaatatgccaaggtttcaaatagtttagttattgtgccttaaatattgttacaatagtattattttcccattacaggtatgtataccagagaataaaccacagtctacttctaaggaaattaattatataaaaggaaggatcctatggttctttatgaaaacagtatttttttataaaactgatcaattaaagctcattattagcactgaagtagaattactttttctccctaggagaactgagttgtaggaatgctttgtaaatgtgtttttaaattgttgattttatttagaattggcatcttttgctaaagaatcactatgagtcttcaccgaaaggttgaaatgagttgttgctattgttgagcattgtggggtaagagaaatcctgcctcacgcaaatttatttacattgcttcatccctctctgtatcttcaggaagttcaaggacctgcaataaaactgatgctgaatgtatttctccaaagagttggaactttacaatatttgtccttttcctttcttcagatttctttttcttatcctgcttcctattatatgtcttaaacttttgatatgaggccagcatatgtgccattgaaaatggtcttagagtttctcttttagtgaaattgaatattctcccatacatattaatagtgatatggtttagacaataatttagcatgataaagctctagaagcagccttggcttttctagtgaacatcatggcaatccttttaaacttattggtttagtatggtataaaactcacaggtaaaaaagaaagcaaataaatacaaatagataaataaggtatttccatagcattcagttggtgtgacaatcattatacacaaaaatttgctctagagatttccccctgtgcaatctgttggaagttgttgggcttccatgtggtctctgaatgaaattcacttttcattacaaaaatctttttatactgaatcatatgctccattactttctaggaaatgggaaatcattgcccactgtattgcacaaaaacataccaactacctacaaatgaaattaagatcgagaggcattatttttttattatttctttattttattattattatactttaagttttaggttacatgtgcacaatgtgcaggttagttacatatgtatacatgagccatgctggtgtgctgcacccattaactcgtcatttagcattaggtatatctcctaaagctatccctcctccctccccccaccctccaacagtccccagagtgtgatgttccccttcctgtgtccatgcgttctcgttgttcaattcccacctatgagtgagaatatatggtgtttggttttttgttcttgcgatagtttactgagaatgatgatttccaatttcatccatgtccctgcaaaggacatgaactcaaccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctacttctccacatcctctccagcacctgttgtttcctgactttttaatgattgccattctaactggtgtgagatggtatctcattgtggttttgatttgcatttctctgatagccagtgatggtgagcattttttcatgtgttttttggctgcataaatgtcttcttttgagaagtgtctgttcatgtccttcgcccactttttgatggggttgtttgtttttttcttgtacatttggttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgttctgaatggtaatgcctaggttttcttctaggatttttatggttttaggtctaacgtttatgtctttaatccatcttgaattaatttttgtataagatataaggaagggatccagtttcagctttctacatatggctagccagttttcccagcaccatttattaaatagggaatcctttccccatttcttgtttttgtcatgtttgtcaaagatcagatagttgtagatatgtggcatcatttctgagggctctgttctgttccattgatctatatctctgttttggtaccagtaccatgctattttggttactgtagccttgtagtatagtttgaagtcaggtagcgtgatgcctccagctttgttcttttggcttaggattgacttggcgatgcgggctcttttttggttccatatgaactttaaagtagttttttccaattctgtggagaaagtcattggtaacttgatggggatggcattgaatctataaattaccttgggcagtatagccattttcatgatgctgattcttcctacccatgagcatggaatgttgttccatttgttggtatcctcttttatttccttgagcagtggtttgtagttctccttgaagaagtccttcacgtcccttgtaagttggattcctaggtattttattctcgttgaagcaattgtgaatgggagttcactcatgattggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacaggtacaatttgacttcctcttttcctaattgaataccctttatttccttctcctgcctaattgccctggccagcacttccaacactatgttgaataggagtggtgagagagggcatccctgtcttgtgccagttttcaaagggaatgcttccagtttgtgcccattcagtatgatattggctgtgggtttgtcatagatagctcttattattttgagatacatcccatcaatacctaatttattgagagtttttagcatgaagcattgttgaattttgtcaaaggccttttctgcatctattgagataatcgtggtttctgtctttggttctgtttatatgctggattacatttattgatttgtgtatattgaaccagccttgcatcccagggatgaagcccacttgatcatggtggataagctttttgatgtgctgctggatttggtttgccagtattttactgaggatttttgcatcaatgttcatcaaggatattggtctaaatttctcttttttagttgtgtctctgccaggctttggtatcaggatgatgctggcctcataaaatgagttagggaggattccctctttttctactgattggaatagtttcagaaggaatcgtaccagttccaccttgtacctctggtagaatttggctgtgaatccatctggtcctggactctttttggttggtaagctattgattattgccacaatttcagagcctgttattggtctattcagggattcaacttcttcctggtttggtcttgggagggcgtatgtgttgagaaatttatccatttcttctagattttctagtttatttgcatagaggtgtttgtagtattctctgatggtagtttgtatttctgtgggatcggtggtgatatcccctttatcattttttattgcatcctatttgattcttctctcttttcttctttattagtccttgctagcattctgtcaattttgttgatcctttcaaaaaaccagctccgggattcattaattttttgaagggttttttgtgtctctatttccttcagttctgctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacacggctttgaatgtgtcccagagattctggtatgttgtgtctttgttctcgttggtttcaaagaacatctgtatttctgccttcattttgttatgtacccagtagtcattcaggagcagtttgttcagtttccatgtagttgagcggttttgagtgagtttcttaatcctgaattctagtctgattgcactgtggtctgagagacagtttgttataatttctgatctttcattcattattttcagtgcacacctgaattgagaaaagcacattaatgaacttgggttgttgatgtcaacccattttcctgtatttattaaaaattatcatgtattctgagcttaaaaattgttttgatttcttcacttaaaaaaggttttcagctgttcacataatttaggaaacagcaaaacaaaacaaacaaaaaaaaaacctgccttcccatgagactttcatggtaagtccacctggatgaccaaaaatactttttatttgttagcattcttgctgcagaaataacatattgttatgcagatatattcacttcaaggcaaaacaccaaattattttctagtgtttttccctttaggagctttcatgattctaaacctttcatgagatagataaagtaagtctttctgaagattggatactgtaaaatccaaaactattctaagccaccaggtgaatatgatcaatctgagttgtgtaagcctcaactcaagacaataaaagctgtttgtagccttattgatgccaagtatatgtcaatataaaacaacagcaacaacaaatctcaaaacattgtgatgaaattagacttaagatatttaatttggatttttaaaaaaagatacacatttatttttttaaataattaaattgataaaaattatacatatttatggtacacagcatgatgttttgatatatgtatccattacctcacatacttatttctttgtagtgagaatatttaaagtctactctcttagcaattttcaagtaaacaatacattgttattaaagagtcatcaggctgtgcaatagatctcctgaagttatacctcctgtttaactgaaattttgtaagcctttcaccagggtcttcccaatccctgtcacctgcccaccccagtccctggtagccatcattatactttctgcttctttgagtttgatttcttttttttagattcatccacttggattaaaaactaaaacataagacctgagactgtgaaactactagaagaaaacataggggaaaagcttcttgataatgggcaaagattttctggatatgacccaaaaagcacaggaaacaaatgcaaaattagacaaatgcgattgcatcacactaaaaagcttctgcacagcaaaggaaacaatcaacagagtgaagagacaacctatggaatgggagaaaatatttgcaaaccacacatctaataagggataatatccaaaatacataaggaactgaaacaactcaatagcaagaaaacaatccaattttttaaatgggcaaaggacttgaaaagacatacgaatggccaacaggttcatgaaaaatgttcaatgtcactcactaatcatcagggaaaggcacgttcatttcagtatcttttattaatgacattatggtatctatatatatctgttagtattgatttttaattatagcatccaaaatattcagtttctgcttacaaagctgttttaagttattttgattcaactgactcatcaaatcaaacaaatgatttgatatcattttccaatgaaattaaatttcttaatttctgtttttgactgaatgcagataaaactcttggtcatacagaaagtctgttcccacaccattgccctcattccattatatgcattttctactcaatgtcttcactgtagtattgatggtggatggagagataaagtctgcattaactgaaacaagttatttgaatatcccttgctaatcagtaaggtaattaatgcattgtaactaggatgtagagcctgtgaaaccctgttgtataatgccatggtacagacatatctaaaatagaccaacagatgttttgagaaacttcttaaaattttctttgcttctttggagtttctttaccaaattataagtaagaatacaaatgtagttggtgatgatgagataattctttgagcaaaacaatagagctgtagatgaggttaaaaagttcatattaatattgtcaagaattttttcatatagaagtaattttatttttcagatttttgaaagctggagagatgaggatgggggaatgaaggagcagtaaggtttgcccaattgatgacacatttatgtataattttttcatgctttggaaaacaatttaaaaaaaattgttccaagaagttttaagcacattatagatatgaattaactgcatagtattagtttaaaaattattagagcatttgttaatttcatatatgacagcattagataatactaagttctaatcttttgatttttctagctcatagccctattctgggtctccttttcaagttttttaatatattcataatttaatacattaccttttaaatattattttattttagatttaggggatacatgtatatgtttgttacatggatatattgagtattggtagtgattggacttctaatgtacccatcacccaaatagtgaacattgtgctcaataggttatttttcaaccctcacccttttcctctcattagtaatttttttgcagtaggtatttttgttaggctatcagacgttgaattagtggaactcttcttaaaatgacccataggtgactcagttcatttctgtgcagtactcttaaaatagagatttttctgactttctagttgagaaagatcatgtaattcattgtcaaaacttttaaatcaaaatgctagccttaatataaatttccaacactgcagtggagtcagggtaccatataaacctgattactgtggcaaaaagcttgaagctttcataaatgcagaacaatgctggtaaagaggaacctgattttaaaattattgcttaaacctaggttttcaataaagagcggaaattgatgagcgtttgagggaataataaccaatggttacagtcaaaatggtaacttctgtgacatttctaagtatgcaagtgtgagatggaagtatttggagggactgagagctcttcactacctctaatttaggcagctttcactagattgggagagttccaatatatatacctagttgcaggtgtccatccttgaagaaagtgaaaaaggtcaatgaatgaacagattccacaagtcttgtctgctactaaaccaactggtcagtgttgttgtggaaataatgtgtgaaaagcatagagcacaggtcctggcacatagtaaataccaaatacatggtggatattactaaaggaggtagcaatgcttattagctaaaagcatagattctgaaatttaaccatctgtgtttttgtcttgcttccacaataacagctgggtaaacttgggaatgttatttaacttctctgaggcttgtgagataaaaatagtactacctcatatggttgtcaaggaaataaacgagaatatatataatgcgattaaaccaactcctagtatgtagtaagcactcaatgtaaatatcagttatttctactacaactgcaactatgatgagggtgatgactatgactgctatcaccactgccttctgcaactactgctgtctggcctatcttattaggaattggctgggagcttgtagaaaagctttggaaaagcagaattggataagtcaggacctgactaatctgaccaatttgggcagagctgaagcttactttgtaacgccctggaagcaaatatggaaaaacagattatcatgaggattaaactatctgataaaacaaaacacttttagcaagattatcaaattatttataagtaaatcatgaaatggtgctattttaatcacagatttaaggcacaccaaattcttaccccacatgaaaagacctgaaccccaagatttaagaaaaaacttatatacactttaaaataattttctaacagttattttgtgtgctgcaaaagaactgacatattttcttattgtgtaaaatatatataacaaaatttattgctttaaacatttttaaagagtttggtgacattaagtacattaacactgttgggcacccatcatgaccatccatctccagaatattttcatttttccaaactgaaactctttacccattaaacaataattccacatttccagctgccttaagttcctggcaaccaccattctacgttttgtctctacacacttggctattctagacactgaatataagtagactcatagaatattgtccttttgtgtttggcttatttcccttggcatagtatcttcaagcttcatctatgttgtagcatgcattagaattttattgttttttaaggccaaatagtatatttcattgtatgtatatgccacattttgtttaatccattcatccgttggtaaacatttgagaagaaaggcactgtcctcaacttgatttcagctttctcactggccatggatctatcagtgatacgttctataagatccatctattttggcctgatttgtagttgattaggagtcatacttctttagattaggtatttttgtcttgtctggttatggtttcttaccaaaaataaacaatgccagggttcactataatcattgtttcttaataatgaagcaactaaatggtaccaggttctttggcaagactaaatgttttatattggaaacccacaatttatgaatctaaatgaatctggagctctgacattttagaacctttgcattttgttcaaggatgaagatgaacaaaattaccaaagagcaatgtatataaaaagttgattaatttatatacattgagtacttgttacaggcaaagaatctcccgaggtgctgggaggattataaaaaaactgtaactaactgagtcaggcttatgaccttacattaatttttggagaacaggaagacatccctgaaaaataaaagtactaataaaaaggtaaattttttttctaactcttccaaatttaatgttcttgtattgcttgcttttgtacttttcatttagatcatttattacaatttataatttatatatttggagaaattattgattgaatgtctgcctcaccccagactataatgaggacagaattgaggtcacgtctctaccagtgtgactaggaacattggtaaatgaccattgaattaattagttaagtaaccacatgagcacaaatataaaatttaagtcatgggtcagtagccgaaagaagataaggaaagatttactgattgtctacaatgagccagctgctttacaaaggtacagatgacaattacaggctaggcagtgagaacatatctaactctgcaggaccctctgccattgatgctgcctgactgttacacagattgagtctctctttatctcccttgtcacttgtgttttcctgtgtcacctgtgttttccttctgtgcctctatcattattgcctcaacaccttatcatatttaataattttaaattgtttttcagtttaccaatggcttcatgtccatccatcagcaaatcatcatagcaactctccactttacaaaggaggaaacagactcagagaaatgtgatgactatcccaagataccacaaaagtaaatacagaacaaaacttaaaactgggtcttccacttccaaagctagtgctgccccaagcgatgggattatattgcactttgtagtgactgtgacagcttttaaagtgaccaagtttctttttggttccttttctctcttggtgtagagtttttgagacacaattgcatttagaattctcaagtactgaaaggtgcttttccccatggatttgaatcaagtgtgcgaattgcatccaaaaaggttaatctgtttacccaactagaacattttgcactgcagaaataaaactagaagttgcattgctgggctgctccagatgtcctgtgctttgagctgctttatttgcatttggtatttcaaagcttgtgatcaatttacaattataattgtcaccaaaattttactttaactagcactttgggaaggaaaacatcaatttacattattttgcagagtttgaaaatatctaatgatttataaaacaaaaatgggtttcatcaagacaagtgagtacaaaattgctgttgctgatctatgttgtaatcatttcctaatacaagatcttgttattttcatacatgcattttgtattcactatgctagtccataataagataattttaatcactgagttatacagctgctctaagagagtgaagagcataaacatgaataagaaaatcagacagctgattataaaaatgtattattggatatctgtcttggcggcacatgtaactagattaacagtgagcatgattccatatgtaaggtgtttcttacttttcatatctcctttaagatatgcaaagatatatttactttatatactatcaatagaattcttgtcagtggagttagaggaattcctagaaatagctcagtttctttaaactataatactaccagaaagaaaagacgtcataaattatgtatcaaatatattgttttgagagtcaatagataatagcaaacatttattaagtgcttaccttaagctaggctctgtgctaagaacattatgtgcataaggtcatttaatcatttgagagtaagcacttctactattacgaattgctatggcctgaatgttcgtgtctccctaaaattcacatgttgaaaacctaattaccagtgtgatggtattaaggggtgaggcctttgggaagttattagatcatgagggcagagctctcataaatgggattcatgtccttataaaagaggcccgagagagttgccatggcccttccacgatgtgaggacacaacaaggaggcgctgtctatgaaccagaaagcaggccctcaccagaaaccaaattagccagcaccttgatctcggacttcacaacctccagaaccctgagaaatgaatttctactgtttatgagctactcagatgatagtattttgtcatagttacctgaacagactaagacatgaattctatctcaaagatgaggaaactaaagttgaaagtggttaagtttctgaaggttctgcagccagcaagagatatataaagtaccaaataataaaataaattttcaaataaaagtcaaatccaagaaaaggcagaaaatactaattcttagttcagaattttattattagtctgaaaaaataacgtaacttatatgcaaattatacaagcttagaataaaaagaaaccccttaaagactctctgaaaacacagactatgtcttacttattttttcatctccttgcatacagtagcccacaatttttttttttttttttttttgagacggagtctggctgtgacacccaggctggagtgcaatggcacaatctcggctcactgcaacctctgcttcctgggttcaagcgattctcctgcctcagcctcccgggtagctgggactacaggcacacatcaccacacctggctgatttttgtacttttagtagagacaagagatcaccatagtggccaggccggtctcgaactcctgacctcaagtgatccacctgcctcagcctcctaaagtactgggattacaggcgtgagccaccacacccagtcatataaaaaatatggagttgaattttatccagtgtcagaaccttccaaaattggggagtttacaatccaatttattcttgagaagttccaggtatcaaaaaattcttttatcttttaagtaataatgtttctctccataatttccctttgttgaaattgtgtgatcatggagcctaaatgaccattggtaatataatattaatattcaaaatggatgatgcaattcatactgacctgtcagcagcccaatattaatttaaactactgacctacattaatttacctcagagcaatggttctcttttcttgcttactttcgggtcagcttcaaacacaccaatgccccgttttcacgacagataaattggtctgcatatctggagttgatctgaacataagcattttttaacaactccccagatagttctaatgtgcagccaatattgagactcactatgatagagaaatgcacactaaatacagagggttgttgccaagcaaggaactacctggctgcccagccaagacaatccagaatagcattatttttatgaattcatcaagcatttgggtccagaatttgatcttaaccttgcataaaagttaatcagaccctaggaaattgataatatgttaatcaaacatgaaattgtctcatatagaatatagaatgccagactatgggggcgtcccagtaggcacattcgctgtctgaaaacttgttcctctttttcaattagttgtgtggacaaatttctcagatcattgcactgaagagctagaatctgagtggaaatagttgatagtgttggtatattttgctgaagatgtgaagaatcttgataaaatgtccttgttttgatgataatgctcttttgtttaaattctgatgtcctatagattcaaggtcctctggatattctaaattaatattgccaagttaacttatttgactcctgtttttctatgactttgtacgtaatcctccttctttctttatatataatactttatcttacagttttagcattggcaacattctatttcttttatatttcttgattgtattagtgaaattctagcactccttaagcatggtttacagaatgcttatccaatgtgtggaagacagaaaccttagagggttagaacaaacattagaagagcagttcgttcttaacctacttttctgctgagatgctcattaaagttgatgttcacttgcatgggcatgcccggattttgaaaaccttgtcaaattatctctatttctgggtttttttttatctgggtctctctcatgttttaggctttcctcaaatgtctgatgattcttgattgtctgtttatatttaggaaagggtccattaaaaagctggtttggacctctgtgttcaagggtagtcctagctttagcataatgagacagagaaagcagacagggcattcaactaggtactttgtgctgggctcccttcctccccccaactcccaccacacacatcctggaaggcagcaatgcttctgtttcatcatacagcatagtcacatcctttagaattcttccaatttttttgcctcaagattggactgagggtgtcaacatccggaggtcagtataaagacccccccagcccaccaccccatgcaagatcttgctctgtcacctatgctggagtggcagttgcacaatcacagctcactgcagcctcaaccttcttggctcaagctatcctcccacctcagcctactgagtacctgggattacaggcatgtgccaccacacccggctgatctttgtatttttttgtagagatggggttttgccatgttgcccaggctggtctccagctcctgggctcaagcaatcctccatcctcggcctcccaaattgctaggattatgtgggtgagccaccgcacctggcatatataaagacttctagacaagggttcattctggttcccttttcagctacagccccaggatgtcacctggctgagtccatctctgcccgccctcattatttgccacccctccaatccagctttggtcttccaaagtgccggtgactgccccataccctctcttgatcattgtgtattgattgctttctcaaaaattccattttttattttttaaatatctaatgaggagaaggagacaattacctgtggataaaagaaaaacagacattcaggaaaattattgaatgtggactgcagcataggtaagtaggttgtagattattcacaattccattggctcaagctatattccatcactttgttttctcaagaaaagtcttactagttgccagaaaaaaaaaattgatgatcttatagagattttcttaaatcgaattcatgggccaagatacttgagtgttaccgagaaattacttcccaccctcttcacaactgtttataagtgaacactctgttgtgtcactgatttaaaagtgtcattaaaagaattgggagtccagaagaccttcacaagccataattatagaaattatctgggaaggtaacttttaatactggtggatataatattatgcttgagtgcagttggaagagatgtggtagaaacagacacagattttacctaggttttttttttctaagtttccagggccacagttatttctaaagtatttttgtatgttcctcataatacccagcatatagctttatccatagtgagtactcaatttttcattgataaagtgaggtagtttctgggatcctggcagcccacggacttataaaatattagagctgagtggaatttatcagcccatctgagttttctttggttctggtacatttttcttttctatatgtcattattacttaaaaagaggatgcatatgaaaatggatatgtacagataagatgtgattgcttctttttcttaaaaaaccaaaccctaaggaatcgccacactgacttccacaatggttgaactagtttacagtcccaccaacagtgtaaaagtgttcctatttctccacatcctctctagcacctgtggtttcctgactttttaatgatcaccattctaattggtgtgagatggtatctcattgtgattttgatttgcatttctctgatggccagtgatgatgagcattttttcatgtgtcttttggctgcataaatgtcttattttgagaagtgtctgttcatatccttcacccacttgttgatggggttgtttgtttttttcttgtaatctagaactagaaataccatttgacccagccatcccattactgggtatatgcccaaaggattataaatcatgctgttataaagacacacgcacacatatgtttattgcagcactattcacaatagcaaagacttggaaccaacccaaatgtccaacaatgatagactgaattaagaaaatgtggcacatatacaccatggaatactatgcagccataaaaaaggatgagttcatgtcctttgtagggacatggataaagctggaaaccatcattctcagcaaactattgcaaggacaaaaaaccaaacaccgcatgttctcactcataggtgggaattgaacaatgagaacacttggacacaggaaggggaacatcacacagcctgttgtggggtggggggaagggggagggatagcattaggagatatacctaatgtaaatgatgagttaatgggtgcagcacaccaacatggtacatgtatacatatgtaacaaacctgcatgttgtgcacatgtaccctaaaacttaaaatataattaaaaaaaaaccaaaccctattatttcattgacagattgtcttagagttgatagcatttaataattgagtaagtacagtccttccttgttcctaacgtgccctattttttctttcttctctacttttgcatatgcattttccctctttcttgtttcttggtgaattcctaaaccttttttttcaaaatcacctcaaatgttaccgctttgaagaagccttcctggattctcacaggaacagctaatgtcatctcttttaacatatccccttcttcatctctatgtatactgttcttcaatttcattttataagtagcaaaattcatccagagagatgaaggagcatttacaaggttaaacatcagaagagccttagagatccagaggaatctatttcagatccatgtaatctccatgtggccagctgggccatgtggcctagtctcgattttggttgaatttcaaaggtgttttatgaagaaataggggagtaaagaggtcagaagttcattttgagagatgctttcggaagacctctttaccacgtaatttgtgtattcggtggtgtgttttccactgtgattttggccagggtgcagctgtactgagacattcgttacattgagtcttgtagaatcaggtagggcctgaccttttaagaccattattatggagtagaacacagagaagctgcctctgcagctggcaacatgtatgggtaatggagcgtatcttcagactgtagagagaaaagaagtgcgtgtattcacttcccaggagaaataatattgtctctagcattctctataaaccaaaatacaaaagcagtcctgtgttataggactctgcccataactgatgttattgccacaattcccagttctgttttctgggcacaagcttctgctgggatttccaattagcagagggagctctgcaagagttttggattgtggacattgtcactgttctgggttaaattgtgtttcccccaaaagatgttgaagtcctaactcccagtgaatgttaccttattcagaaataagggtctttgcagataatcaagttaagatgaagtaattagagtgggccctaatctaatatgactggtatcttttaaaaaagagagaatttggaccttgggacagatatactcagagggaagacaacatgaagacacaatgagaatgccatctacaagccatggaatctctgaggtgaggctaccagaagcttagagagaggcatggaacaaagattttcccatatatccctcagaggggatgaatcctgctgacaccttgatttcagacttctaacctccacaactgtgagacaatatatttatgttgtttaagctactcagtttgtggtacttttttacaacagccttcggaaacgaatacagtcactaatttgctttcatctctgtgtcacctctccaaatgtcagctccttgtttccaaaatgagggaactagataacatgatctccagctctaaacttccctgatctttctagaagtttgataagctggttctgcagctgtgcctctcttcccacttcgtctttgattccttgacctagacccttggtttggatggggtatgcctaggagtagctcacccttctctgatctcctgggggaatttaattgaagtacattctcctcctgcccagtagtgatgtcaagaattagaggaaagacgtgctgtgtctcatacatcatggatctctgactccttctttccatcatatctcctgaaagtttcaggccagatattttacattagagatcacaacttggactcagtacacaaatgggttttatttgcctgtaccattttttaattttttaattaaaaaaattatttgccaggatgaaaattctaaggtttcacatcaaaatctgaatttctgacatagcaggccaggattcccacacaataacaatgactatttccagctcagttctgttgaaaggtggttgcctttgaaaaagtctgcactctctattttgcactgcctctacccctctctatttttccttcaccagctccaattctggcttctctcatgaatgctatctccatgggtcccacaggcatttgagtttgggacctctgtggacattatgatgagaactatttatttccctactattttatctgggagtacagaatttaagtcattttatatgtctcacatgttatatcagagtacattatatatctacaaatgtatatgccctttaatgattatgcatgtgtccccatagtgtcatgtacattgtggacactaaacaggtatgtattttaaatgtttttgtccactctctaaaaaccaatcttttggtaccatgaggtccttaaggatagaccagaaaatagtgctgcctcagggggttactatcctctctgaggaagtaagatatggagtcaggcaggtaaaggatcaagaagaaagtgaaaagtgcgaagacaaatgcaggcatagcatgaggataattcaggggaaggaatgagcacttctgagtggggccatcaggaattttgcagtggtaatgggggacattttagctgagacttggaaaaatggtagaatttgctccaacatgaggaaatatgagcattgagtaggcaggtatgggggcaattttgaaaacaaatagttcagtttgactgaactaagggaaatcgtgggaaatgagccagaggggataatttagaactatctaaccatggcatcaacatcaggtgtaaggagtttagacagcactgagttattaagctcctggaggagctatatttattctttgtccgtgagtaagaactagacaagaaagatgtgccttgcctctgttgttccaaaaggaaaatggccatttatgtttgcatctactctgagtttcgaggtagaaaatcttcctttttaattttcttcattcttgtatgagtagcaatttttagggaaagcagctgaatacagttcttggcagtatgttctaaaatagcaacacagcatccttatctctgctataacttcgtatcctccagctttctaacaggagcatattggcatctttcacagaattatgctcaacaacttattagctgttcattgagaaaacttatttgtcattttgaaacttgagtcaggtaaaacattttctttcacattttttctttctccttttcaccctctcaactttctctacttctttctgtctcatatctctcattgtctccttccgtccctgtctttcttccttcctcctttttcttcctttcctccttctgtccttcctttctcctttctccctcactgcttccttctcatctttataataaagcagttaagagcaacaactttgaagtcacatggccgaggctataatcctaggctactgactgattgtagaaccctgaaatagctacttagcttctttgagcgtccatttttccatctgcaaaatgggatcatgataataactactgcataagaatattgagaatattcatgtgttaacacatgcaaaacactcagaccatgtgccagggacatgttaagtgctcagtaagtgttgtctatttttattgttattatatctgctgatttttttcacatttatcctcactgagtttgggttcttttaaaattgtgtagaaaaatacattataattgttctttgtttaattttagacccaagagatatattttgatattaaaaagattttttgttattgtggaataacatatagaatccacaacctagatccatataatttgttaaatgtattattggactatgactgattaagtgggttaattttatacatgtaaccgtaagatcacttttagaagactatggccatattgtagatgccttcttctatttgctgattgagatagaggaacatgacatattttatgtataaggagtcagaggatcttgagtttctttaggatttttttctttctcttcttttcttttttttttttttttttgagacagagttttcctcctgttgcccaggctggagtacagtggtgagatcttggctcactgcaacctctgcttcccggattcaagtgattctcttgcctcagcctcccaagtagctgggattacaggtgcctgccaccacgcctggctaatttttgtatttttagtagagatggggtttcaccgcattggccaggctcgtcttgaactcctgacctcaggggatctgtctgcctcagcctcccaaagtgctgggattacagatgtgagccaccatgcctggccaggattttttttcaagagctctatattttgaccatttatctgtttctcttttctttttcctttattgggtgcttccagtctatcatattttgacatttgaaaagatcagtatttttccacacgctagtaagcatattttacttgaaataggtaggcccatgaaattttgattcctttttttgaagacaatgattttaacaagagaaaatggcttgctttatgtcttttctaataactgagttcaacgtgtatgataagtgagattctaacagttttggcaaaagtgcacaaatgtaactttcttgacagcattttgaatgttatccctccacagtagcttttatgtctgtccaacttgctttctaagacacttactttcatcggcactttcagatttttgaattatactttctcaatttgatttttcaagtgagttattaggatataggtgggagtggagaatgcctgcctgcctttcttcctttgtcattccctctctcctttctccctcctcccctccctccttttctccctctctccctccctccttccctccctctcttattcttttatttgtcttttttttttaaaggctttaatgttattctgcttctgttaagctggcaaatattgcccttaaataatcatcacagacactttcacccttcttaccctcaattcatcaaataaaaacaaattaattatggttagatgcatctactaaattgtgagtgcctttaggccaagagcagatgcttttcaaaatacgtagaagaatgaatttactcacagtacttgtgatcattaaatcccttagcctaccagtggcttttttacttgacttgtacactgggttaaaggctcttgctctccctgtctacttccataggttatcatatgacaataatgataataacaatacataacttttgttcagctcatgaaagtttttaaaatgttcccatatacaaagtgattaatgagaaagctctttagaaatacaaaaagcaaagcaaatgcaaggtattgttttcattagcaagtttaaagaaaacttctacactgaaatgtctgtgtggtgccattaagcatttaattttatttctcaggttatggatttgtctcatgagaggcgatgtgcttaagaacatcagtttgagtgaagcaggactggcataatgcataaatgtacttccagggaagtcgggaagacaccaaaaaatgtgcttactgttgccatagcttgaaatggaaaatgatcattttcctttgttagttctgaagagctagcagattgacagtaatacgaaacaggatctaattttacactgatgcaaattagataaaatataaaaattctggttctagaaagaacacaagtacttgcttataaattattcaattggacactttgaaaagagtctgcagtgctcctatttcggcaacatccaagtagatgttagaatgacggaatgtgttatttttgaaagtgactttatggatcatctaatcagttgatttgatggggaaactgaaacacataaaggcaaaatacttttgctatgaccatgtgactttttaatggctgaactagactctttcaatatatcatcccccatattttgcctataatatttcaaattctcactagatagagctcactgaaggtaggtacagcaggtcctctagtaatgcagttttgttcaatgttgtttcctcataacatcaatgaggggaaaaaaaaagttaattcctggctcaagccactgtctgggtgcaatttacgttctccttgtgtttgcgtgggttttctcccagtactccagtttcctcccacatcccaaagatatgctccttaagtgaattggcttctgtaagtggtcctagcctgaacgagctgtgtgtgtgtatgcgtgtgtgtgtgtgtgtgtgtgtgtgtgtgccctgcgatggaatggcagcctgtccagggctggttctcaccttgcaccctgagctgccaggatagactctggtcatctgtgtgcttgaagtggcataattaccttactatttttttttttttgagacggagtctcaatctagtccatactgatatttctttcctatatctctaaatgcttggactagtcattttgcaattcatgatggcccatactattcctttttttttttttttgagatggagtctcactctgtcgccaaggctggaatgcagtggcgtgatcctggctcactgaaacttctgtctcctaggttcaagcgattctcctgcctcagcctcccgagtagatgggattacaagtgccagccaccatgcccagctagtttttgtatttttagtagagatggggtttcaccatgttggtcaggctggtctcaaacacctgacatcatgatccacctgtctcggccttccaaagtgctgggattacaggcgtgagccaccacgccctgccccttacttgttttaattactttttctgaaatgtatgtatatatagttcacatttatttcaatgcttaatatgagaagtgttttgggctttatttagaaatttggtgatgttttggacactgtaggaacttcactcttgtttacatcaattagcctatggtaaaattggtttccttatctgggatttcgcttaaagttgcagtttccaagaacctattgatgacattaagtgaggacttactgtagtcatgaatccattaattcatccattcacccattcatccacccatcagtcaaaaatttgttgaacattaattttaagccacatatattaacattgtgcttttgtgttgttttgtttttgagatggagtttcgctcttgttgcccaggctggagtgcaatggcgtgttctcgactcactgcaacttctgcttcccaggttcaagcgattctcctgcttcagcctcctgagtagctgaaattacaggcatgcaccaccacactaggttaattttgtatttttagtggagatggggtttcaccatgttggccaggctggtctcgaactcctgacctcaggtgatccacccacctcggcctcccaaagtgttgggattacaggcgtgagccactgcacccacccaacattgtattgttaagtgataaaagttcagggataaataagatgaggtggctgatctcaaggagcttatagtcttagtcactaagggacaataaaaaggagtgaattaattactctgcagagtaagtcagagaaatattttgaaaagagatatttgagttggaacatgaacacaaaggtcagttcctaactaacaaaataatcaagatgataactttctactaagcttctgatattactaatatgaaatacaaataaattatttcagaggtagaagctttcactatagtatttactctatgtacccccctacacatttttaaactttaaacttcttggtccatgatgccattaactcatcccagccctgccttattaagatgaaagctttgacctaaaatatatatgtttcagaaaacctagaacaaaaagtaaaatgataatttattttcaaaccaaaccaacaaacagaactgtccttaaagcttctccttttagaagagtttcagttaataaataaatgtagaaggaattagagaaatacaaagttgccattagaacccaggagtaataatagttgcaggcaagatccaccagtgaatgataaaattattggtgaaagtttgagaaatgacagatatgtctatagtgataaagtgtttatttcaagatacttttaattacaaaagcaaaaatactaattttgtaatggagacaccaagcagattccaccttaacaaggtgatacatttaatatcaacagtaagaagacaggtgggcatcagcttttacctcacaggatatacttcaagcgtgcatcacttacaaggacattctgcaaaatgactaatctgttctctttaaaaatatcaagatcacgaaagacaaagaaagaggggggaactattatagactgaagataaataaggcaattaaaaaactaaatggaatatgagatactggattggatcatggaatagacaaaagccattagtggaaaaactggcaaaataccagtaaagacagtagtttagttaatagtattgtactatgacaattccttagtttttaagattgtactatgaatatgttctaggaatacatctcgcatgaaggtatggctctgcataccttaggggaaacaataggggagctggctgaaggatgaatggtacacagcaactctctactctttctgtagcttttttgtaagtttaaactattttcaaaataaaaatgatgtaaataattgtctttacacgttagggatacttctaactgatttgaacttttaataaagggtatataatgttgaaagctgatccaaatcattgtgttaaaggaaatttgaaacaaagggaaaaagatggttgtatttctgtaacatctttattctagtactaaagtatagaatttaaataaaatatatgatttagttatagattagtcttaactaatgtcagaattagtcttaacctgtcttgtgccccacctctgtttacattaccctaaaaatagtatataacacaaaacagaaagcatgcgatttctcaagtatattcaggaggttgattctggggtgtaaaaaggtgtagggctatacggcccgtcattagcaaagaaaacaattttcttttaatttagaaaacatttttttatccccaggagatattattggctcaagattactggcatcatagtgttgactttttcattatgaactttctaatagctaatatttttattactccaattatgtctttctcagtttcttctttatggctgagaagattattttagtcagcttgtgactttgattgggggattttctaagctaaagtgtaagagttcttaggtaattctatttcagtgtttagaatgctagatgtctatactttaaatcatgtaaatgtttatatgtttgacctcaactgatgtaagtgggttttattgagcattatttctaataataccatgtgtttgaaaatcccactattttaacataggtagattctgggtttaattactaaatttttttcaaattctgtgcaatcaaggtgaaagggtttgtttccaaggaaacaaatgcattccatttttatcacataaaatgttttctgcaagaaaattccataaccagtctccagggagataccgtgtcataaaatagctctcattggagatttttccaaaggaacactttattttatttttgttccctgaaaataatactgtatttgtgtaattttcattgtattgaatttttaaaaaattaacaacagagttgttgccatcgtctcattagagtcataaaatgtacaatttggggagaatgtgattttcctctgaccattaggttgcatttatatcggagtctaaatagcatgtattcaagatgttcacttgagaagaaacagcctgttctaatgatgatatttgtcaccttgaaggcttcattctttattggtatttatttgatgttggacataacttcttcttcttaagaaaatttgacagccacataatagtctggctttgcatatctattagtccattttcacactgctgataaagacatacccgagactgggtaatttataaagaaaaagaggtttaatggactcacagttccacatggctagggaggtctcacaatcatggcagaaggtgaaaggtacgtcttatgtggcagcaggcaagagtgaaaatgagagcaaagtgaaagggaaaaccccttataaaaccatcaaatctcatgagacttattcactaccatgagaacagtatgagggaaaccaccttcatgattcaattatttccgacttcctcccacaacacatgggaattatgggagctacaatcaagatgagatttggttggggacacagccgaaccatatcagcaaactattatgattgaattaagaaataaggaaactgagggaagtagatttgctttacacaaatctgagggattcttcttatgtacttctttttgtagtagttggccttgcccatgtgagtgtttgcatctagagacgttgtgttattcctcttgtagcttggacctaacatattaagtgctacaaaatgtttgacaatagaataaaataataaaacatttatacattaagaagacacatttttgaaatagaaaacaagataacagtgaaattacagtgggtggggatagcataatagtcaaaattagaagtcatagctctgccccttacgaagtctgtaacttagcatatcatttaaacctctctgtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaacaaaaaaacaaaaaaacaaaaaaaaaacctctctgtaaaatggggaaagacatatctatttcataaggttgtatattaagataatatgtgtaaaaagtgtgtgtgctagaggaatttctttaaaatatgggaactattccataaaaagcactgtgatgctacacataatatgactttgtcttaattcaggagatgtattacatttttcttgtttttaatgcaaattccatgcatgggccagctaatgtgaaataatttaattaccttgctaggttaacactatcatctaaaaaacagaagttatttttaaaacattctgtgagagtttggacttctctcagcctaaccctaattctacaaatccccaaaattccaactgcagagatccaacatgcagctatctaactcatcccacatggctcaaatctttacatgacttagaagtatagattatcaatcaaagcaaatgggagaatggattgatttgtgaaatggcaacaggtccctcatgggagaccaagtggagcctccttaaaaagtttagcttgggcaatttgtgaacaaaagggagacactcatgactcatgacagacagtagcgtacaggaaacagtaaatactgacaacaaaatgtggcatttgtaaaacgttcattcatttattctttcattcattcattcatgtgacaattgtttatttagtggtgagtgccagggactaggctaaatgctgtccacatacatgatctcatttgaaatcacatgaaatttgggaaaatatgatcaatcccatgtagtggatgctgagggacacctcacagacccccacttaaggaccgaactacactcactctcccagctgtccccaaatgttggcagtcaaagcctcttatatgattctctatcaagatatgtgctctcaaccaaagatagacacctcacccagaatcatggtccttcctgggggcagcctgcatcccatgactgatttatgtaggctataccctatactcaattttgaactatactcaattttgaacatcgctgaagggtcatcccagctccagatcctcggtaggctcacctgaggcccctgttgcaacagaatcacagatcatctccctctgtcaaatcctgtttttctcacttcttatgggtgtgttgttcctaaaaccactagccaaataaatctgtagcacacaaatcttaaagattcagattctatttcttggaaattcattttacaagtgaagaatctgaagttttattatttcacccaagcccatgtaggcaatatgtggtgggattaggatgctgtctccaaatgtcatgcatgttgtaaaagcccagcaattagaaatggggttcaaggttggaaatggcccttataaggttaggcctttaccaggtttaatttttcaatttcaggttggcagtccaaagtctcaaaattagtcaaaagtgttgtgcaaaggtaaaaaacatataaaggtagagtggatatgtccaagtgtccccattagcaggaagagggtaagagctaatgagcaaatgaagcttggtggaagtattgacaactagaagaagattttcacaccatttttttatatgggggctttgctaataagtcaattccactaagcagctacttatttgaccttattatttccaatatgtaataaaaattggaagatcaaaataaagaactataaacaacataaaatatttatgagaaatcatgtttaaagaacgtattaatgacattgaaaacaggtcctgaatctagaatggctgtacataagagagaaaatgagtacttatattaaaaatatgtatatgttggctatgaaaatggcaaaatcagataatgctaatattaactttcaatattttcaatattttctgaatgccagtatatatatatatatatatatatatatatatatatatatatatatatatatatatattactaaccagggaaaggatgatgatttaacattttgaactcttttagtaataacacattaattcaatcaacaatatttattgcgaacctactatgtaccagacagtgttctaagcaatgggaatagaacaatgaatgagaaacatggtccctgtcacaagaccgtatatcataccagaggtagggagacagtcaacaagcaaacacatatggaaacaaggcctctctgtcagctgacctctaagcagtgaggtttcaaccacttcaggatctgtgagaagagccttctaggcaaaagaccaatgtagaaccctatgagggaataggaagaactttggaaaacagaaagaaaagcagtatggctgaagcagagcaagtgatggggaaggtatagatgaggctttagggttaggtaagagcccatcacttgtgggctaggaaagagaatttggattttattctaggtgtgatgataagtttttagtgtgttctgaacaatagaatgacatgatcctttttttataagatcattctgactttagagtgtccctgaaaaactgagtatattcaatgaacattcaggcattacttattgaactgaagaggagatagttggagagcactacagtatagctgggagaacataagctttgtagtctgatagatctacttcaaaatccatctctgtttctttctaactggaagttatcttctgaattttaggtttcttttttatttgtaaaataggataataaaacttagtttgcagggctatttttaggattggcgactcatgttcagtggctgacacagtgttcgtgctccgtattttgtgatggcaatgaatgtggagtacaggaacataatataaattatactgacttttctctgatctcatttgttgttggtgctataaaggcctgcagataaactctgacccttcttaaagagacaaataattgttttattggccttttagtttcaaaggaagttagacatgaaggcctgctgagactgcgtgactggattatttctttcgtattatttctccctcttttttccccattgtcttgaaattgtgtacctcagacctactgtttttgttgtctccagatcacacagagcaacttttgatggaaacttgggctcaccagcatacatttttgcagtgtgtgcatttgcacttaacaattctcttcttggctttagcaatgattcaagaaaaagaccccagagaagaccaaggtcatccaacttgtttaacaggctttttaggactaggggactcagatagagctcagcagtggcatatcttagaaaatgttatgtttggaaattcttttcttctgaggtggcagtgagatgcaagagttgatataccagggctacttgctttgagggcatgcatcaaggacaaggaaccccagcaatctcctccaatgttgcatttttaggattttgtttaaagtgaaaaaaataggaggaagaggaggaaattgggagataaggactcagatacagaagcaggaaggttgcctctgtttttttcagtgagtgattctctttgtacagtgctattcacattttcccacaatataatggttcacaaaatttgtaaggtccaggtgatcctctcaacttcccatatattagagacagctttgggtatcaccatcaaacaagtatctgaagaaatctcaatgaatgttattattattattgcttatttatgaatctcatttcacaaacttgggaataaagtaaatattactgtctttactttcactaatgtatcctaatttctgtctccgagtcctattttgcttacctagtagaaaacttaagcttaggtctttctggcattctcaacctcaagagtgaatcacaattccttgggcttactgcaaagtatgaatataggacaaccttgtcttgagtcattgagcctacaggctgacttgaccataagaagtctgttgtttctatcctcatagcttctttaggtttactataacagcatgtgttacctccttgtaatccttggggcccaggaatcttaagcaagtcttcctttgatcctctctgcctagaagccatctccttcctggtgtcttgctaccttctcaatatactttggggaagcagagcccaggccctttgtactcttaggccccaaacctggaaggtggggagtaggagggagttggtagctggagttgggctttcactctctatatgtcccttttatctactgtcctaaaagctttctgactttccctatttctcccctgggagacaagtgagctcagggcctgcctcttgcttcagtggaagagaagggaataggaaaaaggcagagagagaaatgcataggttgctatctcaaaactatatacacaaaactggaaaaaaaaaaaagacttctaaggctgcccttaaagagtggaatcttttctaagatgagatagagattacagatgaatatgttgaaaccaaaagaacagttttcttgttgtgccagaaccatgctggcttcctagggaaaacatactctgattcagccagagaaacaattgtgtcttaggcagatagttacaaagctggcaccatggagttgctttgaataaaccaatgcaattatgtggtcatttaaaaacttctctattttataattgaatgcactaagatagaagtggtacctagaagagcagaactctcaaaggtaccacggccttttaccacatctctcctgagcctctcttttatttttacagtatttgattcttctctttttgatatttcagggctggaggaaactcctactcatgttatcagacactgtatgccttattttacatatgtgcttagactcagcgtccaaagggtaccattgtggcttgttgggctgaacatgggtccttgacttgggaagcataggtacacgttccttgctacacttaattcatttggtggtctttaacaggttgcttatgctatctaaggctatttccttattttaaagagagaagtgaaaaatatctaatgcacgattttgttctgagagtcaaatgaaacaatgtgatgagaggttgtttgtaaaatactgttttatacaattatttccttttctccaaaactgtttattacatgtgtgccatgtgccaaatactttgtttggtctaggctttagagccgtgtagataaataaaatgtagtcacttctgtcaagcaatataatctggtgagggagataaaacagaaagatacagcgtgaagtcatatctgtagggatagaactatgtcatatcatgcataattacatagtcgtacaaaaggataatactagaattggcttcctgaagaagttgattcctgggttgagtcttataggatgaagaatttggtggtatgaggtagatgaatgagaaagacatgccaaggtatcaataacagaatgaacagacagtgaagcagcaagcacccatgtgttggtgtgtattggtggaagcagagggtggacagacatatcaatatagctggcacttacagttggaagcaatatgtagcttgagataaatataggcaggtagttaaagaacaaagattactttgatgaagaactcagatgtaattttttaggtgatgagaaatcattgaagagttttataccatcagatttttactttttatagataaccctaatgaagggattcgcagtgtcagcagttaatttgagttatcaggactagaatcagagagacaagtcagtctcgccatcaggggaagcaatgatgaagatctgaattagcacactggcaataagaatagagtgtgaagaatagggcaatgcttggagattgacttggctcttggagataatgattgaaatatggaaatcaaggatgattgatgccaatgactgggaacacatatagagatagaaacaagtttaggagtggataaatttagtttggggtgctcaatttgagggctatgtgaggcattcagtttgagatacacattcagatgctggaattatgaacatgaacctcagagaagagatctgggccaataatatagatgtattcatatacttaataagtacagcttgagagactgcaaccatagaagtctcgtggtcaatttttgctctccaatactctcattttgataattaaaatatctggtttcatatggtagttaaatttcaagtttgcattttaagctaaagaatctgccctcccaaactttggacatgaaaaagatggaatgagggaggaaaaattgggccatgaaaggtctctcttgactaataccaatgtaatctggtattgggttgatctggttgtttcagatgtttcaaggtgattctttctcttgtgggtactttcatgggctcattgaagaattgcctactgaactatgctaattatagctcccttgatgtcagcagtgtgtatccttaggctggctacttacagccccttcccatccctcccactcaccatgcagttccactttttaatggtccactagtaccaccctaatctaagatatcctttctactttaagttctgctcaggtgctatagcatttatcctgaaacatggactagttgatatttgttcttccagggcttcaaccaaaaccaaagtagaatgaaccccatttttatcttctatttcagagatatgtgaattgttcaattagaagtggtaattgaaatgatgagatcctttttcttcccaccttcaccctcgcagtaagaatgctcacaaaggggcagggcacagtggctcatgcctgtaatcccagtactttgtactttgggaggccaaggcgggcagatctcctgaggtcaggagtttgagatcagcctggccaacatgatgaaaccccatctctactaaaaatacaaaaattagatgggcgtggtggcaggtgcctgtaatcccagctactcggtaggctggggttgaacccaggaggcagaggttgcagtgagccaagattgcacaactgcaatccagtctgaacgacagagcaagactccctctcaaaaaaaaaaaaaaaaaaaaaaagaatgttcaaaaaggaagataactggaatgcaaaatacaaacagattgctgggagacaaaccatcattcagaaagtgagctaaggcagggaaggacagagacagagaagcaatggttgagatagaaggagaacctggagagtaaggagtcaaataaattacagagtaaagaggtctaagaaggaggacatagtcaatatatgggatgttgtgaagagatgcaatattatgaggactaggataggaaaatattagattttgctatgagatcaattgctatccttgcaaggaaatccagttagagaaagggaaatggcaagggtttttgagaagtgtggatgaaagaggagaaatattagatattagatacaggagatgtggggtcaatatagagtttttagaattggagaagccagcaatgttcacaggctgagggaaaacaggcatagtgagggcttatttgaagagccaggaaggaagaaggataattgatggtagatggttaaagctgattatttctcttttgggcacttttgatgtctcgtggggtgtaggaaggaaggagatcaagagcatagtgaagaggttaggactgattagaaggaggggtagctcatccgctgaaaaaggagaagtgtgacataagcatgcattttgatttgtttgttcatagtggcagaaagctgaatgagatcatgtctgatggctttaattttctcactgaaataggggataaggctctgtgctaagtgtggtgaaccaggatctgagtcacttctaatccactcatttagaaattataaagactgaactgaatggagtggtattattatacctaacatacagatctggaatctgtgattcagaacacttaagtggcttgcttgaggctaccctagtggctaatgttagagtctggacagaatgaagagtccccagatcatcaggttattggcacttgacagtctcaagaaattcttatgttccatctttatcggcccatcaaagaataagaggtaaaaatagaaaattgcaaaaggagttgtaaatttatatattctttatcacctttcccctctcctttttataaccaaactttaacatttactgaatatctaatatcttctagtcactgtgataaacgctattctgggaaatcaaatatgtagctgatttatagtgagcacttattatgtatcaggaactattctaagtattttatgcttataaatgaatgtaattattttatgaatgtaatgaggctggagaactcttgtctccatattatagagaaagaaactgaagtccagtgatgttagctgacttaaacacagatattaaatgacaaagctaggcttgtctagctacagttcccacagtttaaatcattacaatatacgtagtttctactctcaaggaacttaccttcttttgggaaagcaaaaggaaaacatggttggttttaacaaatcaagcaatcaaaagccagatgatataacactacagaaaaagtaatggcctggcactgtgggtcacgcctgtaatcccaacactttgggaggccaaggtggttggatcacctgagatcaggagttcgagatgagcctggccaacatggtgaaatcccgtctctactaaaaatacaaaaatttgctgggcatggtggcgggcacctgtaatcccagctacttgggaggctgaggcaggagaatggcttaaaccctggaggcggaggttgcagtgagccgagatcatgccactatactccagcctgggcaaccaagcaaggtcgagcaagactccatatctacagattcaaaagaaaagtaataatatgggccatcatgaattgcaaaatgactaggcatttagagatacaggaaagagatgtcagacggactagattgtctgacaggtaggattaatacattttgttaatacaacactaatggctaacaggtgtttgttgaatttagttgatcaaagagaaatagtccagtcagccttatcatttatgtgcacatatataaaactttagacctttatattaaacccaaatcaccaagctggactttgccttctttcaagtgttttcccttagaacttttattgccagcaaacctaagctataacctttccagccactgggataggttctactaacactgaactccaaaaacacctctccaagtgggagagggccttgatctttttccttttagctaaggaagctctttgaccaccataaaaatttgctggttttctccctactttatcaacatatcaaaggtatactgagaaaggcagcttatattgggacccaaaaggtctaattataacctctgtatttgttttctattgttgatgttacaaattaccacaaattaagtggcttagaataccaaccacttattgtctcatggttctattcatcagaagtccaagtacagcatggttcaactgcttgaaatctccaagccaaaatcaatgtgtcagcatgtctgccttcctttctggaggttctaaggatgaagttgctttaagttcatgaagattgttggcacaattcagttccttgtgcctgtagggctgaggtccctgttttcttgccgaaaaccaaccaggaaactctcttagctccttaatactggccagtttcctcatcccattgttccctccatcttcaagccagcaaaggcacgcccttctaatgcttcaaatctcctgggctttccacatcgctctccctccagtaggagaatgttctctactttaagagctcatgggattagattgggcccatcaggatattccaatatcgtcttcctatcataaggtctgtaaccttaatggtatctgcaaagtctcttttatcatttaatgtaacatatctatgaattctaagggattaggggatcagcatcttctgagatccttctgcccactctaccatccccctagaaacaagggagcattactcagaatagccacttaaataattccccctcccccctcaaaaaaaaaaaaaaaaacaaaaaacaacaaccaatgggccaaacatacaaaaaccacatctgcaccagagccaggtatctgctgactctccagctctagtcagagaagaggtgaacatgttttgaaaggaaatatttttcatcaggcatcccattgtatatgttggacgttagaccattctttacctatatgaggtacttagtaaatagtagctgctgtgatggtgatgaaggcagtgatcccactagactcaacttaagacagaatgctagctactgaagcagattcaaagcaatcaaacttagcttttgccttagggaaaatgacaggtacacaaacacaggatggagcagtaaacgccttgaaaagagggacctttttttttccttttgatggctgttcttgatgcttgttttaaactgttatcacccaattaaaaatgatgcaaagggtggaaagcagggtttgttaacacgggatttaccccaactgccactcacttcctgtgtagtgccaatcttgcaaatccagaaaggccagccactcgaaaccgcctcagagagggccaggaaccaggaaaggtcagcaaagcctcttggatttaaagtaaagaaccaggaaacaaagggctcaacgcaacttttacaactacaaattaaatgcaaaaaatgacacatcattacataagcagcataaaatataatttaaatgtcaaaagaactgaagattcttgaatcatgtaagaaaaacttgcagaatgtgttaaatgtctcaatttgtactataccaaaaaaaagtaaaaagtaaaaatggcattgttttataatgcaaaaatacagaaatcagtcttgttttcctgctgtttatagaaatccttaggcttattttagccaactttaaaaatattcatcttttaaaaattctcatgactttcagggactgtggatatatttgaggataagagggtattatttaacttaagacagtgcttaaatgtgatatgtgtgcctattaaagttacagttaaatcttttatatggatgcattttcattgggaggagtaggcgtttcacagattgctctactacttggaatatgatttcacatacatttttgctctcttgaaaattagctttgtggcaattggtttccctacttctgccacccacttacattttagatctttgttttgaagcttgtgagatatatttaacaacatcatattaacattttaggtctctgtctgaatacagtagttccacattctttggcagatgcagaatttttctagtttttggttgtcaaagatatcaatgtaaacaaagctaaatgtgtgtgtatgtctatacatgcatttgtatgtgtatgtgtgtagtataagctatacctagaaaatttactcttcaatcatttattaaacatttattgagctcttactgtgctccctgccattacctaagcactgagaatactaaggttactaggacacagtaccctggattcagagagctctcagaatattggttgagggaaacttggagcagtatattgtggtaaatggcagccagcagtgcagatagaaagctttgagaatatatatatatatatatatatatatatatatatatatatatatgaagaaacttactttaaactagggcagaaagaattgagcaaagtttcccgaagatgactttattttagtgaataagtcttatagaagtaatttgtttattcaggtttctaatacttttggcattttctcagattggatgaattcctccagtttagtggaggggacatatgaaggaaaggagagtgagttagggaagaagagagagtgaggagtagtctcagaaagcctcctcagaaagcctcagaaagttatagcctcctgggctcttgcctctgggaagagtatacatacaatacttgccgggcctatgaaaggctggacctgaagggcatcttaggtcagtttcctttatgacaacattttcctggacagtcttcagtagtgctacctgaagtcacataggcttccctcccaggtcggtcattcttcaaactagggcaccaacacaatgtattctgcacctgaggtatcatgaaaacagcaagggagtagaaacatagttgactcttgaacaacataggcattaggggtgctgaaccctcgcacagttccaaatcgaatattacttttattccccccaccaaacttaactactaatagcctactgttgctcagaagcctcgcaggtaacatactcaattaacacatatttgtatatgtattatagactgtattcttacaataaactagattaaagaaaatgttattaagaaaatcacaaggaagaaaaaatatacttattatttattaagtggaaaagggtcatcataaaggtcttcatccttgttatcttcatgttgagcaggttgaggaggaagaggaagggggtggtcttgctgtctcaggggtggcagaggcagaagaaaatttgggataagtggacctgtatgctttaaacctgtatcgttcatgggtcaactttaattctacataacctctaagaaagtcaacagtagtgctaaaagatttaaagtcacttctgccagtttacatgttgctttgcttggctcacttcaaaattaggaaacctataatcctttgccaagaattcagtatgcaaatattttctaataaagaaaatcataggaggaagttgaattttgttgcagtatgccaacacactaacagtggtttttttttaaatttttttgacagaatgcagtgttagaaagcaagcataatagagttcatttacaagaacacctgctttaaaaataaccctactgttaggaggaaacaacttctggactagttcttttgaatggaaaaatccagaaacgaacaggaaataaagttgttgtgtgttacatacagagcatttgcatcatgggaaaagctttatattccttttgaagtgccacaattatgttctcatttaataatattgtaatgtcggtgctttgatcttttgttatctgtccacatttggtaattttgtgtcttacagccttcagttcagaaaaaaagttagtcagaaagaacagttgaaggtttccttcaatactcagttcagctaccagaaaaggtctccacagaagatttctctcccagcatcagagaatgggtgggtaatatagagtaagctaagggagagagaacagttcagctcgcatctgtgcttcgcatctgtgttgtaacaggcatttataaaaggctgtagatgcagtacgaagaccatagcacaggagccacacagctgattagagtaagaagcccagaaaatgctggaagaatcagaagagcatcagtttagttcaaaagatgcttatgaaggacttctcttttgctagacactgaactgcagtaaaagtgaagacaagggtttgtctttgtttctagtgagagaaacaggttcattcacaactaactgtattatgagccatttatacaccaaaatgcagaattcattttagccaggggaagtaaggatgattcattgagtagataatgtttaagtggagacttgacaatagggacaatatttgcaggtagaaaatggaaacgtgggaatggtaggtggatcaggcgttacatctggaatccactgcaacaatctgagcacggttgaagtaaggagtaatgcagagagatgagactaataggactttggttaattggaacaggacagtgaagtcagaagatccttgatgctgtgccagccagggtgcttctagggtgggaggtgatgccatatagtggaatagcagacactgctgggcatacctccttatgaacaggactctaattctaatttgaaagccaatgtgcttaacataaaatcaccattttctcagaactaccttgtagcaagggatggctatgtaacatagtttaggccattgagacataagcagaagttgaaatataagcagaggacattctgaaagcctcttgaaaaggagaaagacacagctgacatctgcctttttcatgttgccctgcacccttctttctactcaatttgtaggaatgggcagccatcttgtaaccacgatgacagatgtcttgtgggcagatgtcttgtgctaaggatcctagagcaggaagaaataaagagcttggttgagtatctgcaataactcaggtctgcctaccccagactccttgttatgggagaaaaataaacttcttatttgcttaaaccactgtaaccaggtttctgctagagcagctaaattgaatccttactgatatagttggcctgtggggaaaagtgaaaatagttgagcagaaaagttgaatggaagttacaagccctaagaattgcaaggagggagaaaggaaaactttccagattttcccaagtcagtaccgtgcaaacggttccaggtttttttccattgaagaactgcacgttattacatccatccattcaacaattaaacaaatatttatttatttattgtgccactgttatgtgtcagacattttactggatgccagggatacaaaaaggtatatgatgagacccttcaggacgcacatgatctaatagaaacaagcgcgtcaaagttaatcataaatagtttggatttgaaaactgtgatttataaatttataaaaattcctgaaactctagtagagaataaattattttcttccagctgcaccaaagatttggaatgtaaattggttactgatacaaattgagcatccctaatgtgaatatccgaaatgatccaaagttagaaactttaagcattaacatgacactcaaagggaatgctcactggagaatttagacttagattttcagattaaggaggctcaatcattcaacaggtaagtataatgcaattattccaaaaatctgagctccaaaagacttctggtcccaaacatttttggaggataagggatattcaacctgtacattagtgctgcggaataaaagaggccatggtactttttcaccagtgactttgagttaaaggagcacaaaattagtgtctttctaaaggaaaatgaattgagtaactggagaggtattctcttgggagacacatacataccaccagtggacagttatggatggctagtctactttcatacacttccaaaagttcccatctccacttttaaaaaccactgcatcccatcaaaattctaactttttacaatagtagaatggactgatgtgtgaaatagaatctctttatgccttgatgaacctatggtggccgtgagtagcaatctacaaacttgactgctagcttctaaaacaaacatttaatatcagcattaacctattcctttccagacattcatcaaacattattgatcaccccctatatgacagacaccatggaaggtgatgagaaaacaaagtagggtggcatggtgcttgcccttaattttctgggaggctgtgtatcactgcaaaaggaaataggcaaggagcaggctctccagtgcaggcacctaagggaactgcagaaaatacatggatggttaattagtaggaagccaagcagatttgatagtattagagtccaagagaaccttgtagatagtataactagcaatgctggagagcgttgcaacagtgggcaaggctactatttctctgccctgatatttggactttacaaataggtggataaaagttcccaggtatataactgacccttaggtgctatgggctcttatgggctccaaaagccaaaacataggccttttctggggataagggcaccccatcatttatctttgtatgatgaatgcagttatgttttgaagtcttgagtctcagggaactttggaggtcaagtcatttctgagctttttattgaagtagcaatcctgtggtcttcagatgatgggaagtgatttccgcaaaagcttttatgccttaattgcttgtcctttaagaaatgtggtatgagataaaacaaagaaggtgcctttccagccagttcattacagctttgcttcccacagtgcattgttgtgcttctctggataaatactaagtagtgtttttctcctaattatttcctcaaagtgatagtatcagccctgatgttgaataatgatctctgctattattaagattttgtgtgtgtctgtgtgttttgagaattgtgtgactgctatatgactgcaatatttgcttcgcttcacaaaagtcagtcaggacaggaaggcatttgacaggttaactagtccacccctcacttctggaagtaacctttaacatctgctgttagatattcttcttcttttctgttcacagcctaatagaaatatatcaacactactcatcctgaacaagtttaggagaaggccattgcctgggtagcatgcttttttttttttttttttttttttttttgagacggagtctcactctgtcccccaaactggagtgcagtggcgcaatctctgctcactgcaagctccgcctcccaggttcacgccattctcctgcctcagcctcccgagtagctgggactacaggcgccggccaccatgcctggctatttttttgtgtttttagtggagatggggtttcacagtgttagccaggatggtctcaaatctcctgaccttgtgatctgcccatctcggcctcccaaagtgctgggattacaggcgtgagccaccgtgcctggcctgggcagtgtgattttatggacttagtctaccatgactttttcccttggatgagcagctaaacagttaccactgttgcacaactccactgttcaaatcagaatctatgtgaatggtggtcctgaagttgtgcaataaaaaatgcacagagtcagacctcacaactctgagctaagatatagatatttgaaatgtgtccaccacatttcaagcatcacactgtttgggagcctgcttgctattctgaagactcaaagttaaatattaaaatttcatgtaaattttgcttctattctattatttgtttaagacacaaatcctattttaaactacgtaccatagaggaaaattagtgttccattaaaagtgaccatgtttaaaaatctgtactttcttgttcctattgcacactaaaaatgatgggtaaacacaaaggacaaaggacagcttctctaatgagctgtatgcaactctagggcctggaaattcaacccattttgaatttgtggatctatgctctcaagggtttatatatgactacattaataaatcagccaatagacttcaaataggttgacagcatgtgaaatccaagtgaaaaattttgtgcagtgaggagcaattcatgtggaagaaaagcaaaaataacatatttgatcaatatattatacttcagaaagcacttgcacatgagactgtgacctttgtcagtcaaagaccattttcaaattatttgtgttcccattgctataagcaaaagtaaattcctaataaatatttcctaagttaattcttaataaatattcgttatcatatttggcccacctaacagccccgtaaggtcaggaatactatcattttgcaaaggatgaaactgaggttcaatattgacttgcccaagataacactgttagctgatggcaggattgggaaagggaacctgaaccatgtcccgtgattcatcaacagtgcactgtctatgacaccagctaccttccacatgcccacactcacagtttcctcttaataaacacacaatttcaggggagaggaaaaacagtccatgcattttgagttgctttttctggttcaaatgcctggtgcagagtaaaagctattttctaaatctggtaaatcttcttgtctgcttggattcagtcagacttcagaatggaatgagcaaattatagatggcagtaatagggtgcttccagtggggcgtttcttagccactttattctgcttcttggagctccacttggagatgttttaaatcactcaggaagagaaactagagtgagaaagccagacttgtaaggagctctgtcctaacaggtgtctttaatgatttgctattactttatcacttgaggcactaattatttggaacgtacccaagtaaaccctaccaagtcttgcaaaaagacaatagaaatgaggaaaacatgttttctcttctttggggcatcactatttcatctgtatcattaaaagaatacattcttgggccaggcatggtggcttatgcctgtaatcccagcacttagggaggtggagatagatggattcttgaggtcaggagtttgagaccagcctggccaacatggcaaaaccctgtgtgtactaaaaatacaaaacttagccgagcttggtggtgagtacctgtaatttcagctactcgggaggctgaggcacaagaattgcttgaacctgagaggcagtggttgcagtgagcccagattgcaccactgcacttcagcttgtgtgatagagtgagacgctgtctttaaaataataataataataataaaataaataaaataatacattcttaggaacataagaatttgcactagcttccccaaggaattttctatgatctgctcacttgttatctaaatcctgtctattcttgaaggatgctgaaagctttctatgccgattctatttcacacaataatgtccatgtcttactttctatagtttgttgttttttaaacatctttattgatttataatttgcaaagcataaaatttatctttgtaatgtttacaatttaattatttttagtatatttatggaatcgtgcaatcatcaaccacatttaagtttaaaatttttgggtatctcccctaagaaaccctttattaacattcactctccatgagcattcactctctactaccaccatccttagccctaggcaacactaatctattttctgtctctacagatttgcctattctggatatttcaaaaaaatgaaatcttacagtatgtgatcttttgtgattgacttctttcatttagcataatgtttttagggtttattcatgtagcatgtacctgtactttattcctttttattgttggataatattccattgtatggctacaccatattttgtttatccactcatcagttgatgaacatttgggttctttctagtttttgactatcatgaacaatgctgttatgagcatccatgcacaagtttttgtatataactaggagagaaatcgctaggtcatatggtaactatgtttaaccttttgaagaattgccaaattttcccaaagaaggtgtaccgtttttcaatcccttcagcaatgaatgagcattctgatatctccacatccttgccaatgctttttactgtttgcctttgttattttagctaccctagtgagtgttagtggtatacaattgtggttttaatatgcattgctcttgaatgatgatggtgagtatcttttcatgtgctaatggccatctgtttatattttttttgagaaacatctatctaaatccccatttaaattattatatttttaaactattgagttatttatatattctggacacaagtatgtctgattattgattatataatttgcaaatattttctcctattctatggattgtctttttactcccttgatattatcatttgtagcacattaattttgatgtggtcaaatttgcatttttttcttttgtcacttgtgctgttggtgtcccttctaagaaaccattacctaacaaaaggttatgagaatttactcctgtgttttcttctgcaacttaaggtttgggggtgctggggtgctagtaatcccagaactttgggaagccaagatgggaggatagcttgaaggcaggaatttgagatcagcctgggcaacatagtgagacctatctctccaaaaaagtgaaaaattatccaggtgtggtggcacatgcctgtagtcttagctactcagtaggcggaggcaggagcatcccttgatcccaggagtttgaggatgcagtaagctatgattatgccactgcactccagtctgggtgacacagcaataccctgtctcaaaaaatatataaaataagataaataaaatgaaaaataaagtttggactctgataaattttgaaataattttttaatatgttgtaaggtaggagtccaactgcattctttgttatgtgggtagccagttatctcctcaccatttgttgaaaagactgttctttccccattaaattgttgtggaacccttgtagaaaattaattggccatacatgtgtgagtttatatctggactctcaattcccattccattgatctctatgtatatccttatgctagtatcacactgtcttataactaagactttgaaatcaggaatagtaaatcctacaactttgttctttttcaagatggtgttggctatttaggggcctttgtaaccccataagaattctggaatcagcttttcaatttctgaaagaaaaaaaaagggccagtggaattgtgtcaggcattgcactggctctgaagatcgttttcacattattcattgctaacatatggaaatacaattgatttttatatgttgatcttttgtcctgcaaccttactgaagtcatttattagcactaatatttttctatcagattccttaggattttctatttacaagattatgacatctccaaatataaattgttttacctcttcctttccaacgataatgccttttatttctttttcttgcctaattgtactgactagaatcttcaatataatgttgaaaagatgtggcaagagcagacagcctcgttttgtccctcattataggggaaagcacccagtctttcactgttaaatatgatagtggctgtgggtttttcatagatgtctttcatcggattgcagaaattccattatatccctactttgttaggtattttttcatgaaaggatgtggaatttgttatatgcttttactctgtctattgaaataatcatgtggcttttattctttaatttgtaattatggtctattacattaattaactttcgtatgttaaaccaaccttggattcctgggttaaatcccacttgaccatggtgtctaatgcttttatatgctgctgtatccaattcgctagaattttgttgaggaatttttatatcaatattcatactggatgttagcctgtatttttctttccttgtgatgtcttcacctgattttactatcaaagtagtactgacctcagataatgagttggaaagtgtttcctcttcttttatttgttgaaaaaatagattttataaggatttgcgttacttctttaaatgttggatataattcaccagtaaagccatgtgggtttgaacttttcattgttgggtgtttcgtggaacaaaggacttacaggcaaagagaacagtaaaatgtaatagaacttttttaaggagcaattagaaagcaaaagcagctgaagctgaagtgactccccattgcctacatgttaaaatttaatctcattagtctggttaatggctcttcctaatgtggaacttgctgaacccctccagcttcattcatctcctgtcactatttctctcacactttaagcatcttccatgctgaactcatgataataatagttactctcttccaggcattgtgttaagtctgacaaaatctcaatcaaccattatattcaaattcccagaaataaggctgctcttatttcatgactttgttcatgaagctcttactccccagaatgaactatgcctttattcgtttcttctccctgtctgcctctgtcttgtgaggctgaaaaattcctatctgtggtttaaaactcaccttgagtgtcacctaaataaaacaccagtgaagaatgtctaacaatctgggtactttttgttaatctgtctgtttctcacctattgtaagtcttttgatggcaggcaccatatttgattcatctctttatttccgatcttccagagtgcctgtcacatagtagacactcaataaataattgttgagctaatgaataaacctggctatccagaatgaggctctccccagcattttggagagctgagatgttattgtacttctctatgtttcttatagcacctagtgcaacactgagaaacactcattgaagttaactcgactgaatgataaattaatattataatgtcagtagcacattttgaactcttcagtaaaaagacaccataaaaacctcaaagtagctgtaaaaaatagaaatgataaaaatctgtttagatgacatcttttaagaaaatacaaaaacaattctgttatgttttgatacataattacacttgaagatttttggtgtaacagagctgtgtttgagaattctagtgatcataataacagcactgcttgatgctaggggagggtaaatccattttagaagcttttcaatgacaagctttgttctctgtatctggaagcaattcccagtgctgtttacttaaatgctttataatatggaaaactcaggagcattgtaggatccccaaagacaggagaagatttaatgtttcttaaattctccctctgtcacaagatgaagatgagcaggcagggtggcagcactggctgtggcagcagcagcacaccaccacctatgcaaggtctgtactttttaacacagcattggaagccagtatcagtcatggttctccagagaaacagaactgatgaggtatgtatatgtacatatatataaaatattgtctgataagcgggcttnnnnnnnnnnnnnnnnnnnnatgtgtatacacacacacacacacacacacacacacactaagaagtttattgtaaggaaccagctcacatagttgtgggatctggcaagtccaaaatttgtagggcaagccaacagactagaaactcagtcgggagtcaatgttgtagtcttgagtctgaaattaataggttaggctagcagactggaaacttaagcagatgtcagtgctagagtcttgaggcagaatttcttcttctctgggaaatgtgtttttgctcttaaggtcttcagctgagcaggagaccccacatgcattattgagagtaatctccttaacataaagtcagctgattgtagatgttaaccacatctacaaaacatctttgcagcaacatacagattattgtttgattaaataagtgagtactatagcctagccaagttgatacatagaactaatcatcacaaggtcctttgacacatggaacatgcttccctctcccaccttgtattttccatgacttctcatgccccacaccagattgcaaagctgctctgaagaagccctgcagttctctgccttttggtgcctttgctgttttctccatccctactctagattctctctcctcccagtgtccaacccagttgtcaaattcctactctcatctcttggatcctgtgcaaatgtcattttccttcccaaaccttggctgctttctggtttaaatatcgtctcttcctctcttgaacccccaacagatgtccttgaagtaaagcctccttgctctgctttgcattatttgtaaatgtattcatggcaaccatcccctctcccttgtaacctgaggggggtcaagaacctcatgggtttttttgttttgttttgtcttgttttattttaatgtctttgttcccaaaagggtatagagcttccattcatatggcaatctttattctttttctgtgccctgtgctgtgctagcttctcaggaatatgaagattaattagacaagtttccagcactctgagactttatagcccagtgcggaaggcagataagtcaaccgtaggtgtccacaagaactcattgaactgaattaattctggctgtagaagtgcagtcactttccttttagtatctccttacctcaatactcctacatacagacattagccagaccagacagcaggcttgtagtgggctggaaaggtctgtcctcacaagacttatagaggagtagtgtgtgtgatgtgacctgaggggcatcaaggaggttcactgatccaaaaatatctctgttgctaagatgcctgatataccatcatttgtgattcattcatctgggttcagaattatcctatctctaaatgcacctgggaggaattactaaatgcctacattaactttttaaaattcttttcccttctttctttacctttttatcttccctttctcctttaaggcagctaaattgctctccctgaaagactcccaccacacaaaggagttaagagctcctccccttggtcccaatagcacctcgtgcctgttacagcagagatgttttatcctctaattcttatctgtttattgcttacctgagctcctccaccagactgagctcttaaaggggaaaactgtttttcatctctgtaatctgaacatagagcacagtgccaaacacaccgtggaatgttctgtaagattcctggaatgaccaggcggttctccatgaagatatacctgtttacccttcttctttgatagaatgacccatgagcatatgtaggggacaggcttgataaaagagaattgaagggcaaagagaagagaagagagataggaaaaaagggactctcgggaaatcacttctgtgcctagggccgtccttgatcctgctgtctgttgtccactttttggtttcattcatggataaaatgccttgtgaattaaacatgctgttttcttttgttttgcaatacatgatctgaagtaccatcagctggcaggggtttttccagaagcattttgtcaagtggaaaggtggctacacatgctccaattacaaaagcaaaaatgctttcaaatatcttttccttctgcatggattgagaacacaaacctcttctcatgcctgtctcttccattcgctacacctttgcctttgctcaaggaatatgcttgtaaagatatccaaaaagtgctttttccaagccccttgtggttgcagaatgcagacctgcaaaaatttcctcaagtaataggatgggaactataaaattgcatgtaggctggcacagtgtgtaatcttgcactttgggaggctgaggcgcgaggaatgcttgagcccaggaatttgagaccagcctgagcaacatagtgacacctcatctctacaaaaaataagaaaataaggcaggaggatctcttgagcccgggaggttgagtctgcagtgagctctgatcctgccactgcactcctgcctgggaaacaggagtgaaactctgtctctggaaaaaaagaaagttacatatagattggagctgaaatcaagatggaagccaaggtgcctttggagtcagctattttctgtttttctctcattagctgaatgagctctttcttctgctctccttccctccacagactcattccattttcctcttgctcctctttccctatatgtctcttctctttcctcgtgtcttctgcctacctacaatttctgctccctcacaacttcacaggacccatcatggctgccccagacactcactgcctcatgatttcagattcaaaaatatatgcctccacgtagataccccatggttcatacttattttaatctttccagaaatatgttcttaaaattaatttttagcaaggtcaatcaataaattggttcatttgccctaacataatctagagctgattttatattgttacctatcatttgtaaccactagattatttattttttatatatacatatttatatatacatgtgtatatatctatatatacacatatatgctatatatagtacctatagaatgccaagatttgtgctaggtactggcaataccatcatgagaaaacacaaatctgccctagtgatattaatttctaactgattactttccttctaacttgccctcatctaatctaacttcaaatgagttctctttccaacacatgaatcaaaccatgatattccctgcttaaaatcattactgacatttatcatctaaattcacataaggatgttttactacctgcttctgtttttatttctgacccctgcctgatttcttgtactttacgcttctacaaaaccaatgttaatccatgcccttgacttggcacatgacagaatcaggagaagtagaaaagggatgaagtaaagataaacttgagagacaggttgattcagtgtctaaatgttattatcctaactaaagtgtaaatatcacaaaacctaatattaccttaatatagtaaacatttgatatatttttgttagagtggattaaaaagtggcatttgtggttttatctggcttcagattcattaggaatgagtgagtgaaaggaacctaaaagggtgagttcattggtacatgaacaatttaatcctttttcggtctcaatagctattattgtggctaacaaagcaactcttataagttgcacacaaacaagaagtaggagagtgtttatgatgtcatcataaatatttataatagggacatgatacaatgttttgtgagacattgttgagaaaggttagacagtgaatgctcatttagatcaaaatcaaacacctgacacttgttgagcattttttaatttacaaagtatactcacatttattatcctatttaaactcaatttttcaatctacattggaccattatcttcactgggtaagcattctctaatatctccatccttagactccacattccccatcagaaaaaaaaaacaaacaaacctgtatatcttctttcttttacagcaaagcccaagagttgtctatgttcattatcttgactttctcacctaacattcttgcgtcagtcaagtcagatctggtttttgttcccacaacttcactgaaattgcttttatcaaggtcattaggaatgcccatcgtgtctattcactctctcctcctggaaacactcttcttcacttggcttcagacacagtatatttcactggtttcccacctacctcactgggttttgctcctccacacttttaatggtcccgctcctcagttattgtctctcttactcccaaggtgatctcaaccagaccctagttttcaacatgatttgaaagctgatggctcccaatttctatcttcaacccagttctctcccttgagctctaaacttgtgtagccaacagccttcttaactctctttagataggcatctcaaacttacaatcctaaaactgaaccctggaggaccctgctgtaatgccagtgctccccttctcagcaagtggtgctaaattcatgcacagatgccgccctagctgaaaatgtagatgtcatccctaagtcctctcttttctcattcgcagcatcttgtctgtccacacgtccctagaatctgactagttattactacctacacctctgccaacctagagaaagccacctttattgtcacttagacttctggaacagctttttaacttggttcttcacttcctttctagctccttttgcagtgcagccaaagtgatactttcaaatgatccagtggtattccctttacattctgatgaaaacccagttttttctagaacttatagaccttcatgacctgggccctacctttctgttcaaacttagttctaccttaaggtatttgcatttactggctctgtctagaattttcctctaccagaccttctcataattcattccctcaactccttctgattctactcaaaggtaatctctcttcctcatcctacagctttttgtcccttaaccctctttattttccttattcccttactggtcaatatagtatatatttgcttaattatttatgatctctctttctctcagtggaatataattccaagaggtttgttttctcctgtattcccaacatctagaacagtgctataatattgtaggtgtccaacaaatagatattgaatgaaagaatgagatttaaatataaaccttttaactagaagtcaagtgtttttttttcatgatcaaagcccatgtaaaaagtgatcatcttttcatattttttgatatctctagcatattctgaggaagtattttgagaacatgatttcagattcttttggataaatggagatacatgatattagagcacttgtgtaattgcagtttgtgttgatgaggtatgggtttatgatagagacatcagcatcatctccattggtacagaagcatttcacactaatattctactgcatagattgaggcataattccaacagtggcaggagaattgccctaaaaatataggaattcacaaattttaaacttttgacccagtgaaacttaaaagggcagcagagaaaacacaatggtattacaccaaacttaaaagctactgcacagcaacagaaacaatcaagagtgaggagataacctataggatgagaaaaggtaacttgcaaactgtgcacctgacaaggggttaatatccagcaaaagaacaagcaatgctatttcaaaatgggcaaaagacctgaatagacatgtaaatgagtgacaggtatgtcaaaaaaatattcaacatcactaattgtcagggaaatgcaaatcaaaaccacactccagtagagaaaggggaactcatatactgttggtaagaatgtaaattagtacagccattctggaaaatagtaaagagtttcctcaaaaaactaaaactagaagtaccatattatccagcaatcccactactagttatatattcaaagaaaatcagtatgtcaaagagatattgtcactcccatgtttattgccgcattattcacaatagccaaaatacggaatcaaactaagtgcctatcagtgggtaaatgaatacagcaaacatggcatatatacacaacggaatactatccaatcataacacaaaatgaaatcctgtcatttgtggcaacgtggttgaacttggaggacattatgttaagtgaaataagctaggcacagaaagacaaatactgcatgatctcactcatttgtggaatctaaaaaagatgatctcataaaagtagagattagaatagtggttaccagatgctgagaagggtagtgggtaaaggaagatggagagaagttagcaaaagggtacaaacttacagttaggaagaacaagttctgatgttctattacacaataaggtgacacgtaataaaaatgtattgtatatttcaagatagctacgagagagaattttgaaagttatcaccacaaagaatgataaatgttttaagtggtgaatgtgataattaccctgatttgatcattacataatgtgtacatgtattggaacatcacacttaccccataaatatgcacagttattagaggtcatttataaataaaataaaactttttttttttttttgagaaagagcctcactctgttgcccaggctggagtgtagtggcgcattcttggctcactgctttgcctcccaggttcaagcaattctcatgtctcagcctcccaggtagcagggactacaggtggtgtgccaccacgcccagctattttttttttttttgtatttttagtacagaaggggtttcaccatgttggccaggctagtctcaaactcctgacctctcacctgccttggcctcccaaagtgttgggattacaggcatgagccaccacacccggccaaaataaaacttttttaaaaaggagagaaaattcaagtattaaaaagccacttcagacaatctgtttgtaaagtgctatagataataggattttcgacatgggcttgagtaatcttgagggttttgcctggtgcctcaaatcctcgcatactggggtagtgtcttttattcctgtagaaataacgtaaaagctctaatattccctgtctttataggccatgaattaagtgttccctacactttcctgggaagcatttgaaattgcttcaaaatttacagagaatagagcagctgccatttattgtgcacctactgtgtgcccagcattttaagtctgttatcttatttgatctttaagttcctgaattaggtgtttgtagtagacatttatagttttgtcaatctggaatagcctcctccctcttctaggaaatgactcttcccattcacatgctggatgttttaatagggactttacatacagctcttgcctgctggccagaggagttgtctgggaccaagaatgaaccaaatagagtcctcacacaggatttttacagtgggtgttaaaaggggaaaattgtgccctctgatcacaataccataaggcataacccatgccaatgtcccacggtgtagaggagtaggactgagagaatttaccaggtatatggagaatagagacagaccagaaacaagagacccaaaggtgtttgaatcctttctgtcttctttgaggttggcgctgcctctaccctttcaatcctttcaattgcttctttatatgaaccaatggcttcctcatttgcttatgtccatttaattggctatttgacacttgcaattgcaggagctctacatagtgcagtaaattatatctcctttctatggatgcaacccccaacgcataaaaagttaaatcactttttaccagttacgtggctacatgagattaaattcaggtctgtgggttctaataaccttctgctctgtccagtgcattacattgccattctttttacacctctgaaagggtcgcactcagcagatagttaaatatgtgacccaatctatttgtttttttttaaatgtagacaagcatctaatgtagttacaagaataaaaagatatctaagtgtcctcacacacgtccttgcttgtttctttatttgtaaaatggccaagttgaaatctatgacctctgaattttgtttctcatggaaagttgtctaaaatcaaatagattcttagtgcctctgaagatctaattatactgactgtgcctctaggatttatttaaatgtgaaaacaaaaggaggtgcctctatcagacttcatgatcatgagccaagttggcttccagccctccagcaataactctagagtggcactctcagaacatcagtatcttattatttccagatcagactcctatcctaaaagacatgtgtgcattgtcaggaagaaattttaaaatacccagaaacaaccagtcttctggaagatgaaaggcatttttttttccttgaaaattgtagcatacaaccctaaatcttgaaaacgcattattttggattggttgctataagcaccttcctttggcattcaaattgggcatctaacaactcctacagaacatcagcagcgatatagatgattatgctgaaggtaaaattagtacagtgaagcctgtttcagcaccgacatgcacaaacaggtacaggcgtcaaacctgaacacacacacacacacacacaatcacacacaatggtctttttgttttctttttaatgtattctcagaaagggtgctaagaaattgtcccctttgtcagcttttgatactcactcagtctgaagtatcagaataatcttaccctaaatgcatttctggtttaatactcaattctttgtaaaagaaaattggttcactttttaagagcgtctttttccacaggtgctctaattatttttaagttcatattgatatgatattgtattgcttacgagatgttttaatgcaaattacctatgtaaattatttaagttatgtaccaaacctataaggttattattattattatttatatttctcctgcttgtctttcatcatcacagaagctctattattatttgcatttaaagatgaagacactgagggtctatggaacaaatgacatcctgggacacacttcctagctgtgtgtcccaggataaggcagagctaataagtatatcccagaataagtcacttaccccattgatactctactctgacttcagataatgcaaagagcaagggatttacaaccaaacatgtctgggttgaaatctcaaattcacctaccagctttgtgactttaagcaggtgacttaatctcttggatcctttgttctattatctttaaaatgaaggcaataatagccaaattataaacttttagtaagtattaaataagcaactatatgaagcccttagcactcatcagtgtagagtaggtgctcactaaatggtgctagttttaattcaagtgctcttgattgcagaaaaaaaaaagtcacctatttgatgttgattatctgaggatctacggaagctccaaatattcagtgaaacttttatagtgtaacgtggtcagtgctaaggtgccctgaggctctagggatgttctccctcctcactttatccctaattaaaaactaatgcagagggacaagacttgtgatttcataggtcctttggtggtaaggttcatggacttctctttttttttttttttttttttttttttttgctattctggtgacccattcacatatagcatctaatctgtgacttccagcgaagggaaagagtcaattccatactcctgtgatgctctcatttgggactggtgtccaacagagcaggtaaactctgtgagagagtgcatcagatcttgggtaagccagccagcttctctctgttccatgactacagatctcagcttgatgcccagcctatgcaggttgagtatcccttatctgaaatgcttgggaccagaagtgtttcagattttggattttttttcaggtattggaatatttgcatatacttacttgttgagcatgccaaatttaaaaatctgaagctcaaaatgctccaatgagcctttcttttgtgcatcatgttggcacccaaaatgtttcagattttggagcatttcagaattgcggtttttggatttgagatgcttcatctgtacttgcttctggtcatagtgtatgaatgaggtggtgctggacgtttgataaactgaggagtgagttaagtactatcagttgttacaataatggatcaattaattatcaattgtgtttttgactgtaagaaacagaagacccaagtcaacttttattacttgaaggcaaatagttctactgtggtcatggaaaggctactgagcttcttttagttcagttttccaatatcctaaatcagggtaataatgctaccatccttctagatttgtcataatgtttcttactgtaagagattagccttagactccaaagaagtgtgctcaactcctttccccgcctcttactagctacagtaatctaatccaattcttcccgagactcacctgcagaatggaattaacaataccttcctcaaaagatgttgtgagtgaccaataagatttactggtaggtaggattgcacagggggcaataccttgcatcacatcccatacactgatgtttgttgaaattaaatctgacgtctgtatatttagtctcttatctattaaatgaagataagggtacttttctcagaagattgtgatggggattaaatgcaatgatatatgtgaaaacactttaggaactctataataatgtataaaagtaattattagtactattaatctcttataattatttgtattataatattacataaccattatattatttttgtatctcttatgatttctaagtcaatagtatagattcttatttttcatattaaagaattactcatgtaaagaaattgcttagaaataaattttcaaatgttttagtccataagatattgtctagagacacatttattataatataccttaacaaaacagtcatgttttagcatgtaaaattgttgagtgaaataatttttaaaatgtcatttaaagttagtgaggttaaaaattagtgaaataaaataagtgctgcctgtttaagtatttaacagctgcccagcttcccatcacacttcagattttcagcaccaccctatagaagatcttcacctggtactggtgtgtgacttactgctaagtgaagctgcctgcttaggtgaggttgttttggtgtcttttatcatgttagctgttgatggacagcctatgtgcatttgtactctcagataacatttattccttgttgtttttcctctagtgagctttaaaaacaagtcttgtggtgcatttgtctataagtatgcaagtccctgccatagactttttccattatttcctgatgttacccagccctctcagctagaaaccaaaatttactccatcaacaagacatgctttagtagatagcaaaaagagagccatttgcagacataatcctagagtaatatatttcgtatgtgtgttcttttttccccaacccaagaaattactactactggtggttcatctcttatgaaaagaccagcaatcaggccgggcacagtggcttacacctgtaatccagtgctttgggaggccaaggtgggtggatcacaaggtcaggagttcgaaaccagcctggccaacatggtgaaaccccatctctactaaaaatacaaaaaaatagcccggcgtggtggcaggtgcctgtaatctcagctactcgggaggctgaggcaggagaattgcttgaacccgggtggctgaggttgcagtgagccaagactgtgccactgcactccagcctggacaacagagagagactccgtctcaaaaaaaaaaaaaaaaaaaaaaaaaagaaagaaagaaagaaaaagaaagaaagaaagaaaagaccagcgatctctattataggcagtagggcataatgcatttgaaatatagagtctaagaacttaaattcgagccctgactctggatattctgtatgagttactttgagcacgctctgtctctcagacttaatttctttttctttttcttttcttttcttttttttttttttttttgagacagagtctcgctctgtcacccaggctggagtgcagtggcgcgcgatctcagcttactgcaagcaagctccacctcccgggttcatgccattctcctgcctcagcctcccgagtagctgggactacaggtgcccaccaccacgcctggctaatttttgtatttttagtagagacggggtttcactgtgttagccaggatggtctcgatctcctgaccttgagatctgcctgccttggcctcccaaagtgctgggattacaggggtaagccaccacgcctggccacttaatttctataacttacatttgaattcctgcactgctgctatatctaattaaccatttccttggacaagtcatgcaatccttcttaggctcactttctgttataaaatgagaataaaaatttttcatacttcagagaattgttgggaagattaagtaatgtaaagtttgaaaagtatggtttctggtatttataatagctattgttattaatactatgattattttaatattaacatggtagaatttgataagagatgcaaattgcagttcattattttttctaagactattatctgaggggcaatggatttctctcaggaaactcaaagaaatgcatttttcctcctttaattttagtgagctaaataaaattcatcgtaaaagaacttaattgtgcagataatataatttttatagagacaattctaagaagtacacacatacacaaactaaaaaaaaactaataaatgagagttcagcaaggtggcaggatataagatcaatacatacaaatcaattgtaattctatataatagcaatgaataatttgaaaattaaaaaaataattccctttataatagcatcaaaaagaataaaatatttaaaaataaatttgccaaggcagtgcaagacttttatgctgaaaactacaaaacatggtgaagaataattaaggaagacctaaataaatagaagaacgtcctatgttagtggattggaagactcaaattttaagatggtattactccccagattcgtttacagattcaaaataatccttatcaaaattccagttgctttcttttttttggagaaattgacaagctgatcctaggattcatatggaaatgcaagggacctataaaaaacaaatcaaaccttgaggggaaaaaaaaaaaagaaattggaggattcacactttccaatttaaaaatttactaaaatggtagtatagtactgacataaggtagacatatacagattaatagaatagaattgagaggctagaaataaatctatgcctgtataatcaatctatttttgaccaagatgccaaggcaattcaatgggggagtgggggaatcgccttttcaacaaataatacagagacaactggatatccacatgcaaaagaatggaattggacttctaatttactccatgtacaaaaactaaccaaagtgaatcatagatctaaaagtaagagctaaaagcataacaatctaataagaaaacacaggagtaaatattcatgacctagggttagtcaatggtttcttagctatgacaccaattacataaatgacaaagaaaaaatagatgaaatggatttcattaaagtgaaaaactttttgttcttccaaggacgctattaaaacagtgaaagggggctgggcgggttggctcacacctgcaattccaacgctttgggaggccgaggtgggcagatcacgaggtcaggagttagagacaagcctgaccaacatggtgaaaccccacctctactaaaaataaaaaagttagccgggcatggtggcgtgcacctgtaatctaagctactcaggaggctgaggcaggagactagcttgaacccaggaggtggaaattgcagtgagctgagatggtgccactgcactccagcctgggcaatagagcaagactctgtctcaaaaaaaaaaaaaaaaaagtgaaaggacaacccaccgaatgggagaaaatatttgttaatcatgtatctgataagggacatgtttctagaatacacaaagaatacttacaattcaacaacaaaaagccacagaccgtaactaacaaatgggcaaaggatttgaataggcatttctccaaagaagaaacacaaatggacaatgatcatatgaaaatagactgtcataccattagtcattaggaaaatgcaaatcaaaaccacaatgagatattgcttcacacccactaggatggctatggtcaataagacagccgataacaaatgctggagagaatgtagggaaattggaactctcatacatttctggtgggattgtaaaatggtgtgaccatattggaaaagtttgccagtttctcaaaatgttaaacataaagtacaacatgacccagcaagtttacacctatgtttatataccagaaaaatgatcacataaattcatgcaaaaacctgtacatgagtattcataaaagtattattcatacataatagctaaaaagtagaaacaactcaatgacaatcaacataaacaaaatgtgatatatgagtacaatagaatttattttggtagtaaaaagcaataaagtactgatatatgctacaaaatgaatgaatttttaaaactttaagtgaaagaacccatgcaatgtgtgattcaattaacatgaaatattcagaatgggccactccctgttagttaggagtaaatggaaatggagtttccttttggggtgatgaacatggggtgatagtggtgatggttgtaaactgtgaatatattaaaaaccattgaattggacattttataaatgtaaattttacagcatatgaattgtatcttaataaagcagttatttaaaagggaacttaagcattttgatatttctatggaagtgaaaaagaaaataggttacttcctttccattttcaagagtacaagcaaagtctctccctgtggttatggtggtaaattagcgtgaatcatgtggtgaattagccacatgtcatctttaaaattctccttatccaatattcctagatcatctttgctaattttatattttcttcataatctaaaaacaatactttagtagcattctcaaaagtcattgtattgccagattagattaaatgtaacatatgcaccaatgcctctctcttttctgttcagtccttctcaaaaattatattactctccaaacaacctgagaaaataaagccttttcctgtaagagagttaccttgaacattcactctgacccaaaatattattttcatgaaaatcacttctatttattatgaactagaccaactatcttctttctcattagctgaaaacctccagactggcatttgcttttattcatttataaattaattcatttttcaacaaatatttattgagttcctactttgtgttaggcactacagtaggcactgacaataaagcagtgaaaaaatacagaaatcctctttctcctggagtcacattctagtgcaagggtacagatgatacatataataaatatatggtatattagacagtgatgttgtgagaaaaaaaaagcaaaataaagagagtgctgttgtggtagggtggtcagacaagaccttgataacgaggtgacatttgaacaaggactgagtaagtgtgggagtgagctatggagcaaactgggtaagagcacatgaggcagagagaaaagccactgaaaaattccagaggcaggagcatgcctggcatggtgtagtaaccacaaagggtcactgtggcttcagcagtgtggggaatggggagaatgaggaatgaggaccgtatctaccgtcttggagaccgttgtaagaactttggctgtcattgtgaatagaagggaggccaactggaagatgttcagctggttaacgatgtgtgacctgagttacatttctaaagagttatcttagatgctattttgaaaataaactgtagcaggacaagggcataagaggaagtccagttagaaactgtttttcacaattaagtttcgaccatctgtgtacctgtattattttttacacctgttcctactattgcacaaaatgagtcctgtcctgaggtcagcttctctgagacattgtgaggtcaagaagatgagttatgaggcaaatctgaaataaggaaataaggcatcccttccaggaacacagatccaactaaaatgcaggattatcagcatccagaaggaagataaatgacactgtgccctgaaaaacagacaaaggggagaccattcaaacatgccttctcatttgattgcaaaccaatctttttcagtatgagtcatctacattttactcagaaatccagaatgccaggacccttgtcctctctgttgaatgcctttggagtataatttgtcactctgggaaatgccatcagttcttcagggatcagaggatctttgaacctaatactgttgtgtcgggttaattgtgatttcagtggcctttaagtgctattgtatctgcttagaggccagtcttcctgggccagcggtgaaagtttaaatatacaccagcatgcttagagcagtcaggggagttggcaccaaatctgaaagttgaattcattattccagtcacactgttatttctttgtgtaacatagatattttctttgctctctaatcttctgtgatgaaaaagacctataatctctccagggttttcgcctttgttgtggtctcacatatgtcattcaggaaatctgaccccgtgtgttaggtgttctctcatggtgcactgaatgagctaaacaacgcagaacgagtcagacaggaggttggatagctccaaatgcaatgcaaaccagagaaggggagagaattgtatttgattaatcagatcactgtgaactttggctaaaagaaactccagaacatgctgacatatcaccaggaacagaggagaaaatgcaacatgagaatgaaaacagaggatactgtttaaagggagatatttctgcaatttgggaaactcaaattatttcttttttggaggcatattggaaaaaatcctacacgcatcatgggaagctatcattcagatttggctacagattgattttctcactgatttcttaagcaaactattgacaatgttcctgttgaatgcttacatgttgattgttaagtcatttgtatttatatagaaaattatatttactctgcaatagtaagtggcatgccatcagaaagaaaaataaaaggacaaagagttaagtaataattatgtagcagcaagaacacagggaagataatgaaaatgaactaagtccctaggagtgggatatgaatagcgtaccagcttttcaggatgttgcacattagttcctcaacaacattcgtggatatggtaggtgttggtgatgctatgaacatcaaattttatctgacagttcaggaatgaagctgggagatggtgttatatttaaaaacactgaataatgagaaattttaaataaaatgtttagggaaaatactatgctttgcaaaattatatgatttttaggaaaaatgcattgagtacatttacacattaaaatttccttaccttttcaaaaattataggagtagcttgtgaattgagtggagtttttctgtaagaataaattatctgtttcctcaggtcaggctaccatctgtgaatgatatttatttttgtctacttgaaatttaaatatgactattttaaaaaagcttttccctgttggattcttactaaaagaaatagaagataatgagcagttatgacaaattgtaaagattttctaactactcctagatatatatttttgtgtggctaatgaatagttgatgagtatgtcttttatcctctttttagagctatcagagagatttaaaatagttcatattgcttaaaatatttctggtgtccatgaactgtgtctccattttgaagattaacacagcaaaaacatggaattatgggtggtggaatgcaaagggtatcacaaactagaaccaagcaataatttgtgtagtttttaaactgatttacccttttgtaatattatagtaccaggtttacatgtataacaaagcagaggagtatggccatacattttaaataggagcattgcttgtttggagattaaactttgaactgctctgaatgtcaaggctttttggagagcagaaatcgtggctggcataatttttgtgtgcagtgcctacctggcatgatactttcgggtggtgttgatgagtaaatcagaaaagcaaagcactcttaattaagagttagagttacttactcttaattttgaacataattaattctcataaatcagtccacaattttgcctgctcacatttttttttctaggattggtagaaaatatcagagacattcaaggaaaaggaatttagaatttttactattcccataaaaagtggaattcaaaagaggattttgagtaattgggtcgaaaatgaaatcttttcttcccattttaataacttaagttgaaggcagtcatgtactttatgggatggaatattagtcttctgtaacaaaatataaaaggaagcatttccttgaaactagaaaacatggggttagacagttaagaaggttcttgttggctttcagacttttgatatataactaatgtcattgtaattttctttaaaaagaatatattaaaaagggaaaaattatttaaatttatctgatcacaaaactctttttggaggtgaagtgcctattaatatctcagtggacctctggaacagcctgggtggtgtgatgttgcttcagtgaaacaaacactgcctagagaaccagatcaatactgttgaaaattacagcttgtttaccagctatataacctcaagcaggcctgagctttaattttcttgtgtgtaaatgagtttataatgcttcccttgaaatattgtgaagattgtgatgtaatatgaagcacccagcatagttactggcacatatgaagcactcaataaaaactaaacttgtattgagaatgaaatataaaaaaaattgatatgtgactcattgtggtgtttaaatgagatgtaaaagtacttagcgcaggaccttgtccaaagaattaactcagcaaattctagctttctttttaaaaaatttcaacttctgtttaagattcagggagtatatgtgcaggtttgttacactcgtatattgtgtgatgctgaggtttggagtacgattgatcccatcatgcaggtaatgagtatagtacctaatgggttgttttccagctctacccttatcccctgcttttggagtctacggtgtttattattcctgtctttgtgtccatgtgtatgcaatgtttagctcccacttataagtgagaacatgaggtatttgcttttctgttcctgcattaattcacttaggatgatggcctccagctgcatccatattgccgcaaaggacatgacttcattttttcttatggctgcatagtattccgtggtgtatatgtaccacattttctttatccaattcactgtgaatgggcacctatggtgattctatgtctttgctattgtgaatagtgctgtgatgaacatatgaatggatgtgtctttttggtagaacaatttattttcctttgggtatatgcccagtaatgggattgctggattgaatgatagttttgttttaagatctttgagaaatttccaaactgctttccacagtggctgacctaatttacattcttaccaacaatatataagtgttcccttttctctgcagcctcatcagaagtattgttttttgatgtgttgatgatagtaattctgactattgtaagatggtagctcatcatagtttttgtttgcatttttctgatgattagtgatgttgagaaatttttaaaagaattaatttagtaaatatcagcttctttccttttttcatctcctcatcttcacattatgtataagttggcaagctctttttttggaaatccagatcctttcagttataatatgatgtttaaaggaacttttaaaaattacacttatccattgaaatggttgattcactcatctttttggtatgtacttagtactttctatgtaccaggtactgtgctggcttctggaatctgaagttgtataattatcagatagagtgaacccccaaataaatgaatgattataaatcagcatgttaaaacaattattggtgtgtatacagtcttctttgggcacatggatacacctgtatcagattgggggtaaaggaggtgacccataatcagaattttgatggataagtaggccataagtaaacgaaaatcagaaggaagactttccaggcataatatagcatagcatgactcatcctggagaataactattgatgttctaagacacgagaaggaaaatgattgcttgtgacaacgctgaaaaggcaatagggctggataagccctcaagagaacttcaactttctcctgaaagctgtgagggaccataaagatattaaagcagagacgggcataagccaaaatatggggccaacctggagtcagaaactggtcagggtgtttcccatagaagctaagggtgcttccattgaaatcgaattgtattctattttaagaggaaaaaactcaagcaagtgctgctaaacccgcaagagtctatttgaatttacctatagtctttgaggtggcccaatggcttggactactcttatatggcaatttgcagtgatcaaaatggaacatcacaattaaactgttgaattgttaagtggtaaaatgttttcaagattcaacagctgaaggcttggaagcctgcctagagtatccttataagccctctacctgattaagatttatctgtttttatgtaactcactaagagttaagaataactttttattttctccagttgagctaatttgacttacttgggtttttttgtttgttggtttgttttttgatgcagagtcttgctgtgtcacccaggctggactacagtggtttgatcactgctcactgcaacctccacctcttgggctcaaagcaatcctcccacctcagcctcctgagtagcaggagccacgggcttgtgtcaccacacctggctaattttcatatttttggtagagatgggtttttgctgtgttactcaggctggtctcaaactcctgggctcaagcagtctgcctgccttggcctcccaaagtgctgagattacaggtgtcagccactgcacccaactttacttttttaagttactttacctacaaattttttcctgctgaactacagctaatggtgaattcaggtgagaaaataaaatggaactctacattttcaattacaccacgtcaattaattataggttaacgatcacttaaatgcagtaggggagctaaattttatgaactctaggggaaatccttgagcaaagagaagaattatgtttatagtaaaactacttcttaatttatttgtgttatatgtattcattttgtactacatgattctctaaagcaaggcacacttacatttagtaaatttagtaggtggaattatgtatgggcttaacctaaaacagtgttgcctactatattcatccattctcacactgctataaagaactaccttggccaggtgtggtggctcatacctgtaatcccagcactttaggaggccgaggcgggcggatcacaaggtcaggagttcgagaccagcctgaccaacatggtgaaaccccatctctactagaaatacaaaaattagccaggcgtggtggcacatgcctgtaatcccagctactcaggaggctgaggcaggagaatgacttgaacctgggaggtggaggttgcagtgagccgagattgcactccagcctgtgtgacagagccagactccatctcaaaaaaagcaacaacaacaacaacaacaacaacaacaacaacaaactacctgagactgggtaatttataaagaaaagagatttgatttactcgcagttccacaggctaaacaggaagcaaggctaggaggcctcaggaaacttacaatcatggcagaagatgaaggggaagcaaggcgcgtcttacatgatggcaggagagagagagggaggaggtgtcacgcttaaaccatcaaatctcatgagctgtccctcactatcaccagaacagcatggaggaacctgcccctatgatccaatcacctcccacctggtccctccctcaacacataagaattacaatttggattacaattctagatgagatttgtgtgggggcacagagccaaaccatatcacctaccaaggcaattatattagaagctaaattatagatgtgtaaacatttccagaaaccagtaaatacttctttattgaactagttgaaaatccatggagcccaacagagtgtatttgtcactgccaaacactgagaagaagccaagtttcagactctgcaagagctcattttgacaaccattaggttacagtcctatgtgtagttctgttgtgaagaatattttgttagctaaaagaagactcattgctttaattatctaagccagtatgagaaaaattgtgcctgagaccaggtccctgtgatgaaaataaaaccggtaaaatagtaacacttggacaaatccaaatatattatctctgactgttagtccctgatagatacagacagcggaaaacttcattccaatcaacaacttttttatttataaacatttaagactttaaaaaaagtattcttttttgggcaccgtggacatttttcttctcttgagatgtgagccttagcacgtgcagtgtgagtgaaatgcctgtactgtctactttggtgaggacaatgtatgtaacatttgaagaatgacattacttcttcctctctatgctatataatagaactgcatacatcctgctccagcagaacacacacttaaaagtcagtcttgtatgaatcatcacatatttgctctctttagcatggaactatgtattaggagggtacaaaataagtgtggtgcacttgcctcaaatttgggacagaaaaacaaactctttctgttaatgagattatttccatgaaatgtcatgcaaaagattttttaggagaaaaaaagattgataaaggacacattcttattcagtttaaaagctatttagtacttagaagctggttaaaggcagatggctcaggctatcagttcagtagacctaaaattgacctgagagctgatttcaggaagggatgttagcttgctcctaagaccttcctccctgtcagaaatgcagcttcctctttgattgcatagttgactcaacaaaggcaagatttcccacgctgaagacagatgggaaaattccaaggttggaggtcgactggcaagaagcaggcagctaatctaacggatagtgtcttgagagaaccccgcctacaaaaccacagatctaacacagcatgggggctaggcatcgcctaaaatctgcaggtccatccactcttggaacattccctgcctgagatcacagctacccaaagcaagctctgttgtgccaatcacagtgaattagtcagatagctaagacttccctcttaaataatgcagtaatttaattttcttgtgataattagaaggttgaaggaaataaatctcttaactatagccctcaatttattcaaatataagtgcagattatagcacagatgaagctatcatattaaaagataatcaagttataaaactggtatttctatcaaggctatttgtatcaactaattaaaagttatcttttgaattaccatgcctgctgaatcagctttcagtaaataatgctaatgtacttcacataaaatagttctatttaaagtaaactatttcttaaatatatgaattattcagactttgttgtggatggtatgcaaagaaacatcctaatcacaactaatctcacaattaatctttattttccttatgtagcataaaactgcattcacttcttaaatgaacacttattgagagtgctactctcttttgctctctggtcagtggccctggcaatacagtacttactaagaattagtccttgccaggttcctgtctaggttcctcctctaatgggagggacagatatctgccaataagaagacaatctgagaaatggcataaaagggctatgcataaagctgcatgaggtcccgaggagagctagcacctgcttcacagaggaggtgacatttgacttcagtctaacagtgtgacaagggaggcagtccagacagagagaaaaacaaatgcaaatgaatggagacagaaatgggcaggactggctcagagaaagataaaacctacagtatggttatgtgtattgtttatttccgtctccctcttgtcccatgttacccctaccacaaactgggatgtgaacaccatgaaggcaagaaatgttgtctgttttgttaattaatatatgccaaatggttagaatggtgtttagcacatggtaagggctcaatgaatacttgtgaaatgagtgaatgcatatgtgtgtgttagagagagttgtaactgtgtgacttgggacttaggcatatccaggaattcaggtgactttgtagaaataacatctgacaagcgttggtctttgaccctcttacctccttgagaatacttgtcctgaaggaagattttatttgaaaactaataatcactctgtaaactttattctgacagcagcaaagtttcaaagcctaaaagatctcattgtccttgagcagtgtcataagctgcaggcaggaaaagtcaagtttaggttgtgtccacagcgcattgaagccagataataaatatgcagactctgtgacattttaggaaccttagttcaaggatatttactgttaggcctctggtgttttattgatttccaagtaagccacaggaatgccctgaagcctttcctaaaggtgggatcatcatggttcagtaaatagtcaaagctttacaggagtcgatacaggctttggtaggcattgttttttttagtaaaaatctagtgaaattccagtcacatcatcaaaaatcactttctaagatacaaaggaccaagtgttagaattggaattataattcacattttaagataccatcaggtagcctcacaatgcctactattccttaaaaaaaaaaaagaaaagacaatgaaaggagaaaattatgtatacatctcttattctaacttagtatttaataaagctcaggataggtaacatattttgaagttaccaagtaatgtttttttctcttctcccccccaaaaaaagaagtcaaaataaacaaaaatttattatattgtttttaaaaactactttaaatatctactctatgccaatttagggtaccttatacccactactttattcttcataacaatctattagataggaactcttatccctgtattgcatattaaaaacaggctgtggcagtgttaactttttcattttcatgaaaaaaatattgagcagaagctgaatgaaaactcggttccgtgttattctaaaactctttctaccatatgataaataaatacaacttttataattactgatttcttgattgctaatggcagtgattttaatttttaagttgttatttataaagtttataaatatttaaattttagttaatgaatatgtttaaattttcttgtggtctttaaaaacagaaaaatgatatttatttcccaatttatccagagctatttggtgctcttaactaaaaagattttcattgtttacaaatgcaagtcaacaaatttttatggcactcatggtatgggcaaggaggactatataagatatgctgcgtgctgaaaatgttgtaaataagtgaaatatcttcaaggaccttttgattacatttggataatgaaatatacatgctcaatatctagtctatgaatgtcaatcaactgttcagaaaaagatctatcttaactttttttttcttttttttgagacggagtttcaatcttgctgcgcaggctggagtgcaatggcgcgatctcggctcactgcaacctccacctccgggttcaagctattctcctgcctcagcctcctgagtagctgggattacaggcacctgccaggaaggactggataatttttttatttttagtagagacgaggtttcaccatgttggccaggctggtctcaaactcctgacctcaggtgatctgcctacctcggcctcccaaagtgctggattacaggcgtgagccaccatgcccggcccttaacttttcatgactttgattgattcaaagttactgattttttcagtttgtcagccttaccatggaaactcactcagcatatgaatttgtaatctcaaagcaccatcatatagtgaatgagcaacaccaggctatataagtgtctgtgcatatttagaaagcaatgataattttttcctttatttgtcaatggtcagtgcaggctgcatatgagatgggtagcaacacagaaaatgatggagggtaggaagtgaacacagaaacagaagttatgtgaagaagatccaggagagtgagaactactcattgcaaatatagccctctttatgggctgctcaaacatcaaaaatgtatttgaaggaaaaaaaagtatatcataataaatactcagtcaatataaactaacctatttgttccttactgaatttgcaatgtgtaggatgacacagatgccaatcaatagttgctgaatgatgaatagacaaatggtccaggacattcaggtcatttgaacaattgtagttgtcaataaatgattaattagcttgctgtatagactgctgtaggcttccacctctggcttcactgcaatttctggactgacatggtagattgtacacttcttaaaaacacagggaaccctcagagggtgggaattttaaataagtctaagtgtgattctagaacttctagaatcctttcttacgagttcggaatccaatgcttgtttcttcaatgaaaacaaggtccagggaggaaggaaatggggcctaattgaccaagagtccccctaaagatccatccctattctatagaaaggattttaaaacctcattgacaaggtagattaactgaaataataacttctaatgctcatggattcatttaacatttttcaaacacagcatgccattgtgtgcctgtttagtggaaacagaaatgagtaacatgttaatacttttcaggaattcgcagtcaggtagggaggaagccaacatgtgaacgaatacatgtattgcaatctggtaagtgtctgtcatgataaagtatttattaagaggaattaggagatacgtatggaggaaaggggcagaaaatatgtgaacatgtgaaacaacacagcaagttgaggaaatggaaagattatgacacaggtggatattaaaagtcacatcaggaaagtaaagttagaatgtgaatcaagctacgtatcatatagggtttgttgtgacatgttaaggaacagagttttttcataaagtctttgagaagtcctggaggtttgtaagcagggagtggcatggcacaatttataatttaaaaagataatcatagaaataaagctcaagtcagggaactgttcagaaggctgtagcagtaactcaggaaagaaatgataaaaagacatgaattagggcagccattgccagaaaaagagaaaattaattcaaaaaggcaaaagaggtggaatactccagggtaggtaacaacttgggcagctattcacttgtttatgacactggcaagatttgggccgaccactggcagataaaacagattgcccacagttatgaaggggtcttatttgcttttattgttagtggtagtggtgatcagatgtggaaggcaagaatgattctcaagttgatagcttgatttactctgtggattgagagagagagagagaatgtgtgtatgtgtgtccactatctagcactgtgcctggcactgaaacacaataatacatattttaaaataaatatctgaaactaatagctgtcccatttagagtgtctctgaggtgttttattcatgtgtcatttcattattactgtgcatatgcagagtaattcaaggacatgtctctactaagagatgaagctgggtacaaatctgcatgtaacaggcctcaatgcccatatcaataccattgtgctgagtgaaaggaatgatgaatctagtcatggtagaaagtttagggcttgctcagttaggaagttcagacttgtaaataatgtacaagatatttggtagcttgaactgtaatttattgtctgtttcacagctaaatgaatgggagaggatgaaaacaaaacttattgtttaaatccaagtactaaagaacactttagatacccacccttgggtaaatattacccgattggcaagaagtttgttattctagctaacctaaactcttagtgctgacatttaaacacatgttctcttgttcgctcctcattgaaaaagcaagtctcctgcacaatggcctttcatatttctggaacctttttattaatttagaggaatacatatcatatatactgttagctaatgggataacataatgagctgatgatactgtttcttggacaatagacaattactgaagaatattgtttctgtgtttcttacccttggccaggttgactttctacattgaatagctttagattctattgagtgtggctacataatcttgagattgacattggtgttttcacccttatttttactcccaatcttctctctactccactttgtagttattttaccaccagcattgtttgccaacaaatactccagaatgaaagggaagatgagattgcagtcagttccctacttttcactctggttagagtgttctatgcctagctttcctagggaactttaaaaacgaacaaaaatctatcttcagtgcatttattagtttgatttgctatgattggccttggatagccttagtagtttgaagttcccttcttttaaaaaaatagagggaaaaaaagatagagcaaagacctttactttaaataattatattaaatgctattttttttgatttcaatatattattatttactcaggcaagaaagaccattcctcaaaaaagggcttaaaaagtcagtaaataatatgttatgcctagcaagcaaaaaagcagttggctctgcttctttctttttggttttattttgaatgtttttgaaataaatgttaattcgcagagcactagcttccttcctgtcagttgtcacagggtttttcggtgtggttgttgtttgcttcctaaatgatggtaaagcttcgttatatctgtacctatttttttctgaacatttggacatttcttggaaacacgtcagaattcatcatttggctttattattgttttggggaaatataataatttgtttagaatttttatacaaaacatatatagagaatgatctttaataattttttaaagagacattaaagaaaattgctctcctatttaagttaaatgttttagtaagcattctcttatttaattcagttttaattgcattattaattatcatgaacaaaatattgctagggaaaaagctgaagagataatctaattgcagcttttactgctttgaatgataaagtacctttgatttggtgctgagccaggagggcttgattgataatatctgtctcagatgtcaccctgggagaaaagaataaaacctcagtagagttggtgcattgcagctgtctccgctgctccaatttttctgccccattgacgtcattgggaggtttcaaaccagtccagggtgtctagtaaacctgcacataaatgaaatgaagaaacagaaaaacagtgattcatagccccactctcactccaaagaggtggctgttatagcctttcagataatgggcagatgttttctcctttactgaattttaaaaagagaaaaaaatatcatcagctatccagaaatgtgggaaagcctcagacaaggaatgtgaattgcgtaagcccttctgaaatcagattatatcacaatgagccacatttgtccaaagttctcagatatcataacctgtatccagcttgtctttaaagtcaggaatatctgaagcagaatgtggcatgggaaacagctttctttggagacaagactgctctcaccacccagaccagttcccaacaccatttcctccccttctgtcttcacaggcagccttttgtgctgagttctaaatgaggggcccccatagacaatgataggaacacagagtagaattacagtgttttccagtaaagatttttttgtttccttgtttggggatatgtcttttttatcagcttaatacattaaatacatgataaactctaatcctccaaataatatcacaaagaaccatttctaaatgctatcacatagcaatttagggatacagctgagcattaatgataaaatatgttcagatgctaatttttcatctgctgggcaatttggctgctgggagcaaaagaatgttctccttttcccctcccctcatttaacacgagcaatgacaggaaggactcataataactgagtagctttcatttcttatttatccgacaagttccatgaaatacagttgaaaaatacctgaatctgtatagcactttaaagtttgcaaagcattatcactttcactttttccagttgcatttgttagacaaaactataaggcagatgttatatttatcaccatgttttccaatcctgtgccctatcttttgaaatcacttcaacttagcagagacgtgttgaccatttattacatgtggtaaattatttaaggtaaaagatacataagatatagttgtcagtcttagtgagcttagagaactgaggacaaaacaagcatccacacgtaccttaaatcacaaggcagaataacataggtgcataagacaaagtgttggcacctgacagtgggtcttgaatgaagggggcatttcagagcaatattcaaagactgataatgtttcaataggtaaagatgatggatgtggccttcgggagtcaagggacctgcatgaacagagtcaaataggcaagatgatctgagggatgatgggaatgacacaaacaatgtttggaaactgaaggcagggatctggtgaaaggtaggtcaggctattagtggctgaccctaaatgccagggtgagaagtttgtaataataatgagacatttaaatgctgaagctagggagtaaaacaaatctgtcctttagtaaaatccatcaagcagtcaagtgtaaggtacatgagagaaaagaaaatctggctcatggtgccaattaggaggttccatataaatccagggtagggaggtttgaagaaacagaattataggaatttatttgtttaaaaatatttattgagcatctattatctgccagccactattccagaaatgagaatatggcaatcatagacaaactctctgcctttataggtctttcattttagtaaggaagaaatgaaaagcaaagaaaaattttaccaaaagctatgggttagaaccaacagcacttagtaacaggtagttctggatggaagaagattcaggattaacttagtaatttctctatttgagagaacatatcccttaacctgttagctaaaagtgcacttactctatgaatttagccttcttcacgtgctacagtaacacttcacatggataccacatagcttaaatataacgaggtgtagaagcacacttggcaaagcaccaagtaatacataaatattatccttattagttgtgaatggttgtttttactgtattgttattataagaaaatagtaatacctcagagtttttctttttttttttaactctttaactttattgtgccccagtttacttttttttattgtactttaagttttagggtacatgtgcacaacgtgcatgtttgttgcatatgtatacatgtgccatgttggtgtgctgcacccattaactcgtcatttaacattaggtatatctcctaatgctatccctcccccctcctcccaccccacaacaggccctggtgtgtgatgttccccttcctgtgtccatgtgttctcattgttcaattcccacctataagtgagaacatgcagtgtttggtttttttgtccttgcgatagtttgctgagaatgatggtttccagcttcatccatgtccctacaaaggacatgaactcatcgttttttatggctacgtagtattacatggtgtatatatgcctcattttcttaatccagtctatcattgttggacatttgggttggatccaaatctttgctattgtgaatagtgccacaataaacatacgtgtgcatgtgtctttatagcagcatgatttataacccttcgggtatatacccagtaatgggattgctgggtcaaatggtatttctagttctagatccctgaggaattgccacattgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttatcttcttcccccactggttgatggagttgttttttcttgtaaatttgtttgagttcattgtagattctggatattagccctttgtcagatgagtagattgcaaaaattttctcccattctgtaggttgccttttcattctgatggtagtttcttttgctgtgcagaagctctttagtttaattagatcccatttgtcaattttggcttttgttgccattgcttttggtgttttagatatgaagtccttgcccatgcctatgtcttgaatggcattgcctaggttttcttctaggatttttatggttttaggtctaacatttaagtctttaacccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttttccatttgcttggtagatcttcctccatgcctttattttgagcctatgtgtgtctctgcacatgagatgggtttcctgaatacagcacactgatcggtcttgactgtttatccaatttgccagtctgtgtcttttaattggagcatttagtccatttacatttaaggttagtattgttatgtgtgaatttgatcctgtcattatgatgttagctgggtattttgctcattagttgacgcagtttcttcctatcctcgatggactttacaatttggcatgtctttgcagtggctggtaccagtttttcctttctatgtttagtgcttccttcaggagctcttttagggcaagcctggtggtgacaaaatctctcagcatttgcttgtctataagtatttcatttctccttcacttatgaagcttagtttggctggatatgaaattctgggttgaaaattcttttctttaagaatgttgaatattggcccccactctctgctggcttgtagagtttctgccaagagatcagctgttagtctgatggcttccctttgtgggtaacccgacctttctctctggctgcccttaacattttttccttcatttcaactttggtgaatctgacaattatatgtcttggagttgctcttctcgaggagtatctttgtggcattctctgtatttcctgaagttgaatgttggcctaccttgctagattggggaagttctcctggataatatcctgcagagtgttttccaacttggttccattctccctgtcactttcaggtacaccaatcagacgtagatttggccttttcacatagtcccatatttcttggaggctttgtttgtttctttttattcttttttctctatacttctcttctcgcttcatttcattcatttgatcttccgtcattgataccctctcttccagttgatcgaataggctattgaggcttgtgcattcgtcacgtagttctcatgccatggttttcagctccctcaggtcctttaaggacttctctgcattggttattctagttggccattcatctaatttttttttcaaggtttttaacttcattgccatgagttcgaacttcctcctttagcttggagtagtttgattgtctgacgccttcttctctcaactcatcaaagtcattctccatccagctttgttccattgctggtgaggagctgcattcctttggaggaggagaggtgctctgctttttagagtttccagtttttctgctctgttttttccccatctttgtggttttatctacctttggtctttgatgatggtgatgaagaaatggggttttggtgtggatgtcctttctgtttgttagttttccttctaacagtcaggactctcagctgcacgtctgttggagtttactggaggtccactccagaccctgtttgcctgggtatcagcagtggaggctgcagaacagctgatattggtgaacagcaaatgttgctgcctgatcattcctctggaagttttgtctcagaggagtacctggccgtgtgagatgtcagtctgcctctactggggggtgcctcccagttaggctactcgggggtcaaggacccacttgaggaggcagtctgtccattctcagatctccagctgcgtgctgggagaaccactattctcttcaaagctgtcagacagggacattgaagtctgcagaggtttttgctgccttttgtttggctatgccctgcccccagaggtggagtctacagaggcaggcaggcctccttgagctgtggtgggctccacccagttcattcttcccagccactttgtttacctactcaagccttggcaatggctggcacccctcccccagcctcgctgcctgcaaccttgcagtttgatctcagactgctgtgctagcaatgagtgaggctctgtgggcataggaacctctgagccaggcgtgggatataatctcctggtatgccatttgctaagaccattggaagagtgcagtattagggtgggagtgacctgattttccaggtgccatctgtcacccctttctttgactaggaaagggaattccctgactccgtgggcttcctgggtgaggcgatgcctcaccctgctttggctcatactcggtgtgctgcacgtgctgtcctgtacccagtgtccaacactccccagtaagatgaacccggtacctcagttggtaatgcagaaatcacccgtcttctgcgtcactcacgctgggagctgtagactggagctgttcctattcagccatcttgactccaccccctggagtttttcatttggtaaattgtttctcattttaattatttgaaagcaaagagttgaaatatatttatattcattatgtgtcttcaaataatctcagaaaagtttggaccttaccttaccatataatcttttgattttgttgctgctgtgatttctgcttacatgttagtgtagtatacattatgaaaaatggtatgtattgtctagggagctcctaaaacttgtatctaggactccagtacctaatggagaaagaggtcaattcagcaaagaatgtgttttatgtattgataaattttgtgagctacatcctcataagcatttaatactttaaacacttaagcatcttctttgaggttatttatgtgaatgatttattagagagtttaggttatttctcctatacattcacaagtctcataacatttaaaagactgatctgttgctcctgttattagtaaaattcattttacaatgtatatttaaaaattagcagaaattaaaatcttaattcacatcaaagtaaatgtgagccacataatcagattactgtcgagtcaatagactacctagggttatcaataatgaccctacttatgtgtctgcctttttgtcaagttaagaataagaatctacatgcaagtggaaggggagaatcgagagcgttacctagataattgtctttaaggagtattagtcccttttcacgctgctgataaagacatacccgagactgggtaatttataaaggaaaagaggttgaatggactcacagttccacgtggctggggagacttcacaatcatggcagaaggcaaaaggcacgtttcacatagcagcagaccagggggaatgagaaccaagcaaaagggaaaacccttataaaaccatcagatcttgtgagacttattcactaccttgagaatagtatgggggaaaacaccccatgatttcaattatctcccacgggtccctcccacaacacttgggaattatgggagctacaattcaagatgagatttgggtggggacacagccaaaccatatcagaagtctttttaggaaaaataagatgataataaaatgaacttcttacattgataactatccctgatgtactaaaaaaggcttacttggtaagtatttactaatatatatgtgtatgtctagggccttgtgtccaaaactgttctatctctctctctctgtgtctctttgtatcaattgaagactcttttgtgatcctttctacccaactgaagatcaggcagataagcaaataatttgatcagtgacttctttttgcctataaaattttaatttaaaaaaaccatttggtaatcataatcccctgttgtcttttcacttagaatttagactcaaccgaactgatctcaatctctgacaagcccttcccaattctgcccactgcccttctgcatcctcctagctcttctcactgtactgtccttactgtttgcttgtccatatcatgctgtgcttacctatttatatgattctttcacctcttggccatgaaaccccggaagatcatgactgtttccttcatatttatacccattacccctagcggagtctcagtcacctgtgaggttctcaagaaatataggaaatatccgttaaagtgaatattcttttgacaatggagacatggctttcatggtttcggggaaaacttttattgtcctaaaaaagagtccctttatcctttatgccaaatacaaaggctgtatctctcatcaagtcttagggtaatttctgagtcttgagacatatggcaattaataataataataatagcaggagcagcaacagtttactgagcacttggtgtttgccaggcctgtgttaagcaccaaacatataatcatacctcagtctatctatattttgcagatgaagaaacaaaaagtttaaggtacttgcccaaagtcacacaaatataaagacttggtaaagtcaagattaacccaagtttttctgccattaaagcctacttttaacagttatgaagaattgctaaattgacacataacaaatccatttaaaaagatatggattttatttgtacacagagctggaatatgtctgtcagtgtgggaaggtacctgacttcatgatcatatatggaaagaaagtaagatgtttccacaagaaaggaatttcatgttgtttgtctagtcctttaaacatctggatatattttgaaactaattttttaaactgcctttggtttgagtctttgaaaatgaaaaatatattttatgaagcagtcactgttcagggagccaaaatacttgaattctaatctcaactttgtattttaccaaaccagattcctgaaacatcctaggctatttcttggttgtcaaatcaatgatggaatgatattgtaggttcaccatatcccgttccttcctgttcctctagtgtgcttcacttacttcggagaagtcactgaagaccaatttcaaattatttttggtgagaaaaagcctgagacctgtgagggatacttcagggaaatgttatcatctcagagctttaaaataatcatctcccctgggttctccgtggtttggaattcttatgaagcttaatgcgtgaaaaggacaacagttttcaaaatgttggcagtttcctacatttgaccttttaacatttagaaacattggtcaaggtatgtttaaattctttaaattgtagctgacctttggagaaataaacataaattaaggttattacctacatggaatgcttatatggaactattagcaaagtaaaagtagtacgttaagtacaccatggaaaaatgcttttagagactgaaatcattatagtgatagagtcactgagctggaaagaaacttgggaagccatctagttcacccttctgtctgaggccatgtcacatttgaaccataacaagagatttgaaatcttttttttttttttttgggagattcaacaacttctcttggtatctagttctagtaactgacaatctcacctgtcagcaagtcgtttttcatagctaacctaaatccctagggctgcactttgaactaactcactttcttctgttcttagatgtagaaaacagctcatataatgactccttttgcacaggaagattgctatcaagatgttattcagctctcatcctaaagccaaattccctgaacctttcttcacaatttctttgtgtctaaccttttagtaacttaccttttgcacatatggctctacccaagtcttcatcttctcaattgtgagacccacaatactatctaatagcatacttagctattatactcgatgaattgcttagttgaatatgctatgttaacatcataacttggatgctgtttctgtttaacaaaacatataatgaaaacttttcctttaaacaatagaaacagaaaacattgtattgacagcaagaaaggttacaagggtgtccatcgccttaaaattccccaatttataaaaatcatggactaaaaatgaataaattaaggaagataatttaacaaatgtttataactcctttacatttctactccatgctgagcagaaggttaatgaagtaaaataagttttggtatcaaacaactccaatttcgtactccatgtaactggacttaatgagcaagtatattctaatttctaaggtttattggcctgatcttgcagaatatgaaaataataaaaaaggtgagttccttgaggacagggtcattcttatttatttttgtatctatgtgagttccttgaggacaagggccatttcttatttatttttgtatctctagggccttccccaattcataacagagattaacactcacttatgtttgaattttactgaaaggttgctcgtgagaattaaatgagattatatatgtgaaaatatttggtcagctgttaaactctatataattgtgagtcattaccattagtaattttaaaagagtgatgattagtaatgagtttttaaaaattaaaccaaactttggtttacagctgtctttccaggaacatttgttattcatttgttgcaaatctacacatgagtttcctaaaattaataatcagtggtacaaagctggccatttggagtttaatgcttagactcttttgagcaaaatgagaatgacaagggaactcagatgtgaccaaggtgacctcccagagccaatccaaattcactctggcaccagatgaataggactaccctgaaaaatttataattttccagagcttccatgaccttgtgttcatttccctatgtgggagagaaaaatcagtggtatctttgactgacaatagcacccaaaggtttaaataacattgcttcatttattaacaacatgactaaaaggagtctttaagtacttgaccttctttcatggggaacagccaaagggccagaggaatacacggacttaaaaagcagtgtttatgaataatactttagatctttctaaagagcaccatcccctgttttgctatttggtttacaaatacttagtttaagaaagaagaactttggaatcaaagtagttcagattgagatcttagctctgctatacaagtaggtccttgggacaattacttagcttttctaacctcaattttgctttctgtaaaatggaaaatatattacctagctcataagtttcctggcactgttgggttcttggtaacttcattacctcctacaccttctgatctccttcttcacctattttgttagtggcagttggctggctgatatgatttacaaagctagtatgtccaatgtatatgagacccctgcaagaagcagcaaaaactatttgataaacattttattgaatttatttccaagagtggtattgattgcatgataatgacacaaagctataaacctccttcttcacctattttgttagtggtcgttggctggctgatatgatttacaaagctagtatgtccaatgtatacgagacccctgcaagaagcagcaaaaactatttgataaacattttattgaatttatttccaagagtggtattgattgcatgataatgacacaaagctagaaacctcagagaatgtattgctttttgaggaattaacttaaaactagaaaaatacagctttaaatgtaaaaattgactagcctgccaagggcaaatagcataggaaggagttctggaagggcaactggcggccctgggtttaggcccacctgtgccacaaactagaaaaccctggacaagtcacttttcttctctgaactttacttgcttcatctttaaaataggaggatgatgccctaggcctttttctgcatcaacagtctacagagctgagagtcaagcattgatactctcccaaacagatgctgcctaggcacagaagggttcaggctccatcttgttttgctgtcaaaccttcaaaaagtgaggactgtggcctttaggccagcacatctctgtagagaaaacatcagttgccccactgtgaagattctgaaggcagtttggtccctcctcccccaatttattttctagatgaagaacatgctatctcatttagtgagaaagtttgtcacaaaaaagaaaagtcagccataaaaaatgatgagttcatgtcctttgtagggacatggatgaaattggaaatcatcattctcagtaaactatcgcaagaacaaaaaaccaaacaccgcatattctcactcataggtgggaattgaacagtgagatcacatggacacaggaaggggaatatcacactctggggactgtggtggggtggggggaggggggagggatagcattgggagatatacctaatgctagatgacaagttagtgggggtagcgcaccagcatggcacatgtatacatatgtaactaacctacacaatatgcacatgtaccctaaaacttaaagtataacaataataaaaaataacaaaaaagaaacataagagctcaggataaagaaaataacaaaattggaatgcaaaccataccaatttgaaaacaggcaaataatttattttgctaaatcaaatttcagagattgaagtctggatctgtttatgttgccgcagtccctcttgaaattaccaaataggagtatcactcttggtaatttaatttttatggagctggaaggtgtagatatttgtgaatctcccacttaaggcctaaattagatttcttcatttagaataagaaatatgtttaaaaagcatacattttatttttttctccacgttttctgcacctgaaaagggatcgtgtctaattgtatgctcagcttagagccatattcttggcttaacagagataaatcaactcactccactaaactaaaaggcaaaataacttatagatgttaatctctcatagcttgcagcagtctttcctattattagagggagcaaaaaaaatcagccagagacacacatgatatttatacgtatttaaaacggaatattcaggaatgttgtttctcacagttaaacctgtgctgaaatactttacagatatgcaacttaaactacagtgaaaaaccatctttgctgttttcctgtgtgctgatgagaaagaatatacatctcaaagagtagtggtttcttcaaaatccccaatctacatcttggaactctattctgtgcaaattcatttctcctcaaagatgaaaataaataaacttatttaagacttaagggtaaggcaaacaaaaaatgcatagacaaaatttagaatacctaataatctgggatttaacctgaaagtctttaaaatgcactagcatttaatttgagagagagaaaaaaaagaagaccctactgctgtatatttctgttcaaaatttactgctgtttctctggaatagaaaagaagcagtttctgttgagttggcaaattaatgtgcttgaacagaataaagagagcaggccaaggaaatcacactgcttttaatactttctttgcaaagagcttttttggaccaagtccatgactgctacaagtaagtactcagttgcaagaagaatgtgagtagagatcaagtaggctggagctttttgttaattcactcttaatgttactaatgttaatttgaatctggagacttaagatcaaaccaagcggctaatattctgcaaggccccgttccctttcctagtgattcctgggggtagaaatcatttcttaaacctaatataaaaatctactcttctgagtgattgcaaaatagctggtgttagagttctgtatcttacctttctattcacttattatgtgcacagctactttttaaaatattttttctatttataaaagaagtgcataaccatcatggaaaatttataaaagtaacaaaaaacataaacaaaaaaatcatttgtatttgacaaaacattcataaagcatagtcaagctagataagcaaaaagtggcatttattttaagtataattcatcttagagaaactacaatagaaatacatgtgtttccaaagcctcaaagactgttaagattcacttggggcctctttctgctcctctctgcacttctcctgtgtttttattttattttattttattattattatgctttaagttttagggtacttgtgcacaacgtgcaggtttgttacatatgtatacatgtgccatgtcggtgtactgcacccattaactcgtcatttagaattaggtatatctcctaatgctatccctcccccttccccccaccccacaacagtccctggagtgtgatgttgcccttcctgtgtccatgtgttctcgttgttcaattcccacctatgagtgagaacatgcggtgtttggttttttgtccttgtgatagttttctgagagtgatgatttcaagtttcatccatgtccctacaaaggacatgaactcatcattttttatggctgcatagtattccatggtgtatatgtgccacattttcttaatccagtctatcgttgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgactgccacaatggttgaactagtttacagtcccaccaacagtgtaaaagtattcctatttctccacatcctctccagcacctgttgtttcctgactttttaatgatcgccattctaactggtgtgagatggtatctcattgcagttttgatttgcatttctctgatggccagtgatgatgagcattttttcatgtgttttttggctgcataaatggcttcttttgagaagtgtctgttcatatccttcgcccactttttttgttttgtttgtttgtttgtttttttcttgtaaatttgtttgagttcattgtagattctggatattagccctttgtcagatgaataggttgcaaaaattttctcccattttgtaagttgcctcccattttgtaggtttctcccattttgacacgatcccttttcaggtgcagaaaatgtggagaaaaaaataaaatgtatgctttttaaacatatttcttattctaaatgaagaaatctaatttaggccttaagtaggagattcacaaatatctacaccttccagctccataaaaattaaattaccaagagtgatactcctatttggtaatttcaagagggactgcagcaacataggttgatggtagtttcttttgctgtgcagaagctcattagtttaattagatcccatttgtcaattttggcttttgttgccattgcttttggtgttttagacatgaagtccttgcccaggcctatgtcctgaatggtattgcctaggttttcttctagggtttttatggttttaggtctaacatttaagtctctaatccatcttgaattaatttttgtataaggtgtaaggaagggatccagtttcagctttgtacatatggctagccagttttcccagcaccatttattaaatagggaatcctttcaccatttcttgtttttgtcaggtttgtcaaagatcagatagttgtagatatatggcattatttccgagggttctgttctgttccattggtctatatctctgttttggtagcagtaccgtgctgttttggttactgtagccttatagtatagtttgaagtcaggtagcgtgatgcctccggctttgttcttttggcttaggattgacttggcgatgagggctcttttttggttccatatgaactttacagtagttttttccaattctgtgaagaaagtcattggtagcttgatggggatggcactgaatctataaattaccttgggcagtatggccattttcacgatattgattcttcctacgcgtgagcatggaatgttcttccatttgtttgtatcctcttttatttcattgagcagtggtctgtagttctcctttaagaggtccttcacgtcccttgtaagttggattcctaggtattttattctctttgaagcaattgtgaatgggagttcactcatgatttggctctctgtttgtctgttattggtgtataagaatgcttgtgatttttgtacactgattttgtgtcctgagactttgctgaagttgcttatcagcttaaggagattttgggctgagacagtggggttttctagatatacaatcatgtcatctgcaaacagggagaacttacttcctcttttcctaactaaataccctttatttccttctcctacctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgagatacatcccatcaatacctaatttattgagagtttttggaatgaagcattgttgaattttgtcaaaggccttttctgcatctattgagataatcatgtggtttttgtcttcggttctgtttatatgctggattacatttattgatttgtgcatgttgagccagccttgcatcccagggatgaagcccacttgatcatggtggataagctttttgatgtgttgctggattcggtttgccagtattttactgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtgccagttcctccttgtacctctggtagaatttggctgtgaatccatctggtcctggactctttttggttggtaagctatttttattgccacaatttcagaccctgttattggtctattcaaagatttaacttcttccttgtttagtcttgggagggcatatgtgtcgaggaatttatccatttcttctagattttctagtttatttgcgtagaggtgtttgtagtattctctgatggtagttggtatttctgtgggatctgtggtgatatcccctttgtcatttttttattgcatctgtttgattcttctctcttttcttctttattagtcttgctagcggtctatcaattttgttgatcctttcaaaaaaccagctcctggattcattgatttttttgaagggttttctgtgtctctatttccttcagttctgctctgattttagttatttcttgccttctgctagcttttgaatgtgtttgctcttgcttttctagttcttttaattgtgatgttggggtgtcaattttagatctttcctgctttctcttgtgggcattgagtgctataaatttccctctacacactgctttgaatgtgtcccacagattctggtatgttgtgtctttgttctcattggtttcaaagaacatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgttataatttctgttcttttacatttgttgaggagtgttttacttccaactatgtggtcaattttggaataggtgtggtgtggtgctgaaaagaatgtatattctgttgatttggggtggagagttctgtagatatctattaggtccacttggtgcagagctgaattcaattcctgggtatccttgttaactttctgtctcgttgatctgtctaatgttgacagtggggtgttaaagtcttccattattatttcgtgggagtctaagtctctttgtaggtcatgcaggacttgctttatgaatctgggtgcgcctgtattgggtgcatatatatttaggatagttagctcttcttgttgaattgatccctttaccattatgtaatggccttctttgtctcttttgatctttgttggtttaaaatctgttttatcagagactaggattgcaacccctgcctttttttgttttccatttgtttggtagatcttcctccatccctttattttgagtctacgtgtgtctctgcacatgagatgggtttcctgaatacagcacactgatgggtcttgactctttatccaattttccagtctgtgtcttttaactggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctgataccggttgttcatttccatgtttagtgcttccttcaggagctcttttagggcaagcctggtggtgacaaaatctctcagcatttgcttgtctgtaaagtatttcatttctccttcacttatgaagcttagtttggctggatatgaaattctgggttgaaaattcttttctttaagaatgttgaatattggcccccactgtcttctggcttgtagagtttctgccgagagatctgctgttactctgatgggcttccctttgtgggtaacccgacctttctctctggctgcccttaacattttttccttcatttcaactttggtgaatctgacaattatatgtcttggagttgctcttctcaaggagtatctttgtggcattctctgtatttcctgaatctgaagttggcctgccttgctagattggggaagttctcctgggtaatatcctgcagagtgttttccaacttggttccattctccctgtcactttcaggtacaccaatcagacgtagatttggtcttttcacatagtcccatatgtcttggagactttgttcgtttctttttattatttttttctcttaacttcccttcttgcttcgtttcattcatttcatctttcatcactgataccctttcttccagttgttcgcatcggctcctgaggcttctgcattcttcatgtagttctcgagccttggctttcagctccatcagctcctttaagcacttctctgcattggttattctagttattcatctaattttttttcaaagtttttaacttctttgccattgatttgaatttcctcctttagcttggagtagtttgatcatctgaagccttcttctctcaactcgtcaagtcattctccgtccagctttgttccattactggtgaggaactgcattcctttggaggaggagaggtgctctgctttttagagtttccagtttttctgctctgttttttccccatctttgtggttttatctacttttggtctttgatgatggtgacgtacagatgggtttttagtgtggatgtcctttctgtttgttagttttccttctaacagacaggaccctcagctgcaggtctgttggagtttgctagaggtccattccagaccctgtttgcctgggtatcagcagcggtggctgcagaacagcagattttcgtgaaccgcaaatgctgctgcctgatgggtcctctggaagttttgtctaagaggagtacccggccgtgtgaggtgtcagtctgcccctactgggcagtacctcccagttaggctgctcgggggtcagggacccacttgaggcagcagtctgcctgttgtcagatctccagctgtgtgctgggagaacctctactctcttcaaagctgtcagacagggacgttaaagtttgcagaggttactgctgtctttttgtttgtctgtgccctgcccccagaggtggagcctacagaggccggcaggcctccttgagctgtggtgggctccacccagtttgagcttcctggctgctttgtttacctaagcaagcctgggcaatggcaggtgcccctcccccagcctcactgccaccttgcagtctgatctcagactgctgtgctagcaatcaacgagactccatgggcgtaggatcctctgagccatgtgcaggatataatctcctggtgtgccgttttttaagcccattggaaaagcgcagaattagggtgggagtgacccgattttccaggtgccgtctgtcaaccttttctttgactaggaaagggaactccctgaccccttgcacttccagagggaggcaatgccttgccctgcttcagctcgctcacggtgtgctgcacccactcttctgcacccactgtctggcactccctagtgagatgaacccagtacctcagatggaaatgcagaaatcacccgtcttctgtgtcgctcatgctgggagctgtagactggagctattcctattcggccatcttggctccaccctctcctgtgttcttaagtattttggtagttcagccttttccaacccatgtgactgaaagcatggccatgcctaagttttagaatttatggctcatctatgcagagaaaaacttaagcattatactccctctcctttcatacttagattatttagaaagagactcatgggcccaactgaggtcaatagcccaccctagcacagtcatatacagcacaggctggggcagaacagtaaaatgtcaagacatagttgcttctactctactcaagtggcctagggaatggggacaaacttcctcaaagaaagaggctgagcaaactttgtaataaatctcccttttaaacttgggatttcttcacccagagataactactgataacatttatatattttttcttctgattttctctttgagcttatgtattctttaatgctgttaaggtaattctgtttgtaattttgaatctagctttttccaatccatctttcttcattagccctcatccatagtttacttttaacaataataactacaaagtaacagcagtgacaataggtagtatgtagcaagtgctgcattgctgttaagaactttgcattatcttattcactctcacaatagaataatatatattaaacctgttcacagtttgctatggcttacaacacactttcatagatattccatttgatcatgccaacaatgttgtgaaagatggcattataattcatttccctttttatgtctaaaatagattctgtctgtgctagaaaggaacattcactaaaagttatacaactagtgaatggtcctctctagccagattttaaatcctgtttccttgagctcatgccctgttgcctcccctggcatttttctgcattcaggtagactgctcagctgttctccatcatcttcatttatgcagtcctgcccctccccttgccagggactttctagacactcacagtgactatagggacaaaaagggaaggtggagaggtgcgctgaagcaatgtgctaggaatcaggggtttctacactatgatctcccaggacactcatggagtggcgatggaagtgtggcttccaagttgtcagacacagtctcttttccctcagaacctgtactgctcctcaccatggcctgccactgctaggcactctcgggcctggatattttctctcagggtcacctttttttcttcttccaatccagtttccttcagggaaacttggaatttaccctacaggagtgatattcaattatgagctagcttcagaagatctaccggaaagcttctgattcagtgtccctgaacgttcagcaacaggagagtgtctaggctggagcaaaaagagaatctctagcggggggatacagcctaactccaccctccagcattttatcccagatatagcacaaagaccaaagattagaggtaatctgataatcttgaacaggaaggtagaggaagcagcaagaaggtagaagacttggttaggctaggtataccaaacattctgtattacttcctattttaaaaaaattctttgggtgggataataagagatactgtaaaacgtggatcacatactataatgaccttcattcattttgtaagcagttggcttggttcagaaatgtgcttgccagtaataagttgcaggtaaggaaactagtaagtgacagaactgggacctaaaccaggtgatctgggtgtggcttgagtggacgtgggcagccagtcacccatggaacacagagtatggacctgacatcattatgtgtggaagttcagagattgcatggtccactagctcaggaacaggtttcatttgtctttgaatccctagcatgtaagttaaacaaactgcagatatattattagggtcaacatgaggaaaattctgcattacagcccagcttatcatggactgattacttctgctgccctttagtgctgtactgtttgttttccccaggcaaaacatccaaggctgagtccacttggtgaaagattaccaaatcttgtactgaaaggaaatactacatttcccctgtaaatagtaatggaactgactaaataagcccaacttatatggcaaaatttttcaaattcttgaatcaggctgaggtaaatggagttaaaagattaggattttatttttgtttccagagtaacttgtttatactcatgctgtttctttatctattatatttctagtcttcaagtgccattatttcttacaaatcatatgtaaatttataatgatattgttataatattcattaattaaaactcactagcaagattaaagccaatttcttaatgcaatttatagtgttaacaaagatttcagaaactgaaccccaattatttacatagatgatattttgatgttgtaaatatttatgacccatgggtcactgaagatataaattaatttcccatcagttaagaccagcagtttaaggcaaatgaaaaacattttcaaaacaggaatttattgtatttttaataatagctcaactttattgctaacctcgttactggcaagaacttgagagacaaaatcaaatttgggtttctttctaaaattttttaaagttactgggaaacatagtctgtttaatttctcatatgatacacaaaggggaaaaaaactattctaggatgtagtcccagtcgtaatggtgagtcattggctgcagcagtcataatgatagaggattctatttattgctgttctctaagcctcacacaatgaagccaggcagaaattatataattattcctcctggatggatcttctcattcgtttgtaattacaaaatactctttgagtacttttatatcctgaaattaagtcttcagaattgcagaaagaaccgtaaggtttgatctcaggcttgtttatcctccttatattttattttgccaattaatagtgtagcttcccaggtgctaaaatgtgacttctttatcttttgtgtggctcaattacttagactaattttaaataaatcctaagggaaacctcttattttcacaattacatggtatatttttccactgcttataacttcttcctgtatcaattaagtagcttaagttgctaatgttccatgctctctaggtgtgcctctttcaatatttcctgtccttttcgccactgctcataaatggtttctaatcattcttataattgtaccttcttggagccttgagagacaggcacaggttctcttacataggctattattgatattggttgcttttattttccctccaacccccactccagataacaactgttgagtgcgtaccatgtggcaaacaatgggaatgaagagattaatgagccctcaaagaattcatgatttacgtagcacatacttctagctaactgttctagctacaccagccagttctagagaggtacccatggaggttttggatatgtgcttaactccttgaagattcttctggaatgatgcctaaagtaattgtcaagagaagctatgctaatcttcctcttcagaatattcccatttctttcttagttataggtatgaggagtctaaaatatgctttaacatagtaagcttattgttataactggaaccatgcaaaatcttaatttcctataatataatttcttgctcctccaaagtcattcaaatattaaattggacttattctatatgttgcttagtggaaaggtatcacaaataaaaagtgggccacaatgagtaggtcaattaaataaatgcaaaaaatatattgatttattaattacaatataatactgtgctaaatgcttagcttgcattatctcatttaattcttaccaaaactctttgaggtgattattgtatacactcccatttacagatgaaaaactgaggtttaaggaaaagatgtgtatgcccaaatttcttaatgactaaatggcagcagaccaggactgtcttgactccaaagaacatgttctaatactgtacagcttcagactccttcatgagagctgtgatgctcaataatatatgtcaggatatgaatacttagactcatgccagaccatgtcataagccttagacctttttcatttgtgtttatagatagtgaccttttagtgcagtgacaatttcttaccacacagcaatctgcatgcaaggaattgctaatatctgctttgctcagaaggaagcttgtatgtagcattaattatggcaccattaatccattcagttatttattgaaactattatttgttgagtttctgctacatgcttggaagtttcatgtgttatctcctttaaactcactgtaaaaggcatgaggataccaattttctatatctgcagtaattttcccagggttacgtagctcctaactggatgtagtgtcttggattcagacccagctgtttgtctccgaagtctataccaaactaccctggtagtttagagcttatgtttaccagaaatttatgtcccaccagcacgtaatttttaaaccaactctgttgaggtataatttaaataaatgaaatgcacatgttttaagtgtgatacatttggtaagatttgattatgtatatacccttgtagctaccacccccactcaaattatacatttccatcactcagtaaattgctttgtgcccttttgcagtctctcttactccttgccccaggctaccattgatctgatttccatcactgtagactagtttttccaattctagaagttcatataaaaggaatagtacagtatatactcttttttgcctgattttttcacttaatgtaaagttttgtgagattcatacatgttgttgcctattcaatagttcattcttttttattaccaaataatattccattatatcacacatcacatttgtttttccatttgtctcctgatgtgtatatggttgtttctagtatggggtgatgttgaataaagctgctatgagcgttcgtatcccagttttattggctcatccactgttgtccaaaagaatttcttgaactctgcatttgtcctgaaggattctctgattgttcttcatacaagaactctaggaatataacatggaatccagctaatttctgaaactcatgtatttaattatacatttacactaacggccgtgtgcactgagaaaaatcctcctgattaatggcattgcttttagagtcagtgatcttttatttctcatgcaagtcatagtcaccactgtcagtcaggcttctcagttccaagcaactgaaaccaatcctggctcccttaaaaagtagatgaatctggccaggcatagtggctcacgcctgtaatcccagcattttgggaggtcaagccgggcagatcacgaggtcaagagattgagaccagcctgaccaacatggtgaaactctgtctttactaaaaatacaaaaattagttgggtgtggtagtgcgcgcttgtagtcccggctacttgggagactgaggcaggagaatcgcttgaacccgggaagcgtaggttgcagtgagccaagatcgcaccactgcactccagcctgggtgacagagtgagactccatctcaaaaaaaaaaaaaaaaaaaaaaaagaaaaaggaaaaaaagaaaagaaaagaaagtagctgaatctatgaacaggggagagggtagttcatacatacaatcacaggaacctatagaacgaggtttgccaaacaggcaggagcaagaaaaactaggcagctgccaggtccacagccaaagtcatataaaaaaaatcaatctgttgcagacactgctgtcacagctactgacattagactcatcgtttctgctcctgatcataagaccatattagttatgcatgactcactttccagtacctattccatttcttttttgccttcagatggttgtgtctaagaaatttccagaagtcctcaacctgggtgggataagagtagtagaacaagagtagtgggcagcctagaggtgtggaccaaaagcacttgccttctaattatgacatcagggcttgcttaagcagttcctcctgatgacagagcacagcagggcagggtatgcctgactgtaagaagtgtaaaaagataagatgtaccattcatggacagccttgccacatggtcacctgaattccgcgtgatatgaacataatattacaaggtttatagatttaatctctcctaatactcagacactatccaggtgcaacttatttgtataaaagacatggctttctccagctaatcatattatacgttccaagtctcttctctctccttaaattctggatgagtatttcacacctttgcctctctttaaactctcaaaacctatccccactctcagctgatgatgcttctttctaatttactgagtagacagaagcaataaggactttcacagactcccagttgataggacctgcactcaaatactctactttcctgcctatagattaattatctatgctcctatctaaggcaaattaaataataatgctgtataatggagtaaatgattttggtttattaataataaaataacactctgctaagttctatgcatgcatcatctcatttaatcctctcagcattttcacgtgggtgctttaattagccctggtttataaataaactgtaacttaggggagcgaagtaacttgtctaatgttctacaactagtatttggcagcagaccaagtttgcgtaactttgaaagcttcagaaaatttttaatcccaactttgtgatgttttcagtgtatcatagaacatagcattgttgatcatcaggtctctcattccaggttacccgataagccttcagcctgcatcccagctggcggatattcttacccagtgtgaaacccaaacctttatacttggtgaatctaacccttgagaccctgaatgcatttcacaaacagagatttttcttgctttctaccaccaggcatggagtatccaaaagtactccagcacattccttggatacctcaatattattctctgccctctttgtgcagcagcaactatttaccaagcctatgaacaaacttggatgtggaccttagtctcctcttccaagatatatcacacaaggttcagccactgggaaactttctcttccccactgtccttcatggccaactctaggtgacctcccctatttcatgtcacagaatctgcttacagttggtaccaaacctttccatcctctttctctcataacctaagtaaaggcccaatgggcctgaccctccattacttttctgacatccactttccttcttactcttttgtctttctgtacataggcatccatacttttcctcatgccatgccagcctttgctcttgctgttattctgtctgaaatgtccctcatcccaatatccacgtgaaaactccctcctcttctagcgtttgcttgaatctcacattctccaggaggcctagctttcccctcctctctcaccagaactcctgatctactctactcgttttacttttttgtaaaagtaaaagtgcttttcactttctaatatactatataatttacttaccatttaaattttattgtctttccccccaccagaatgttaactcctcgatgtcatttcttttgtgcccacaagcacctagaaaaatcctggcccatactggactctcattaaacattcaatgaactgaccctaatcttagtgacctccatcatgatatatgctccctgagatctgctatagactccatacaacccccgacatggcatcacaggacaagcacaataacaaggataaagtggaatagctgcttgtgctgcagcacaatacagcagcgagacctctcttcctctggatccccctcaaagataacagctgttcaagtcacctggccagtgagtccaaacagcacaccataatgtggtacataccgcctccaaagtctatggaggtccactctagttttgttcctcctctttctcagcagtggctcagtcaagccttcttttctttttcttttttttccccagttaggttcttcccatttattttgtctccagagactctatgattaattagccaatatttctttatgtgtcattaaactcttaaaggaagactcctttctaaggaagctgtaggaatctcctggagatgatattacagtggcataatgtgaataattgtctcaagaaagaaccaagataccttgactttcttcttctttagagtgtttttgctcccttcagagagaatacctttttaggtattttctttcagactttatggtgaaaattattagtcttaaaatccttttcaagatttaccttaagatgcctattaagtacaaagaatatctttggtgcccagacctgatatccaggtgttccatggaatatcttgatccctagatctttgctacatacctatagcatttctgtctttatagcaatgtaaactaagcactataatcacttttactgcaaaatcgtaggctacatagagtctcttgaactgccttaacacagtttctgcatttttttacttttaggatttcctctctgaaacctgaatatgtaagcaatcaccagctgtatatattaaagccattgttttttctacttgatggagaccacgtgtatggctggatgaccctgtgttaaactgcatttggaccattgctcttgaccatatatttattttcacttagaattttagattgtttgtggattttggctccagtatagatttagtgctctactttttcattcatgcagtttttcatcacattgcccctgaatgattttttggaagtggaaatatgattacctgattatctcattcataactacataaaatctttctatgttctcccatcactttcaggagaagagtttgaattaattagcatgaccaaacgcttctttataatctagtactgtttatctttccaaacttttctgccagccatacaggtgcctacagtaaaaaataatatttttgtatcaaaaagatgagacatcaggccaaacatacctgtggcaagaaacacactatgatcttgggcatgtgatgatgaaggctaagcaacatcccatttttctcaagtgaaaaactatctttgaatcttggttcttgaaatgtctactagctccaaaagtggaacaagcattttctacaggaaactgtacatctgggattagtactatttagactttaaatgaagaaaagcctctgtttaagcaaaaggaaagatcaaaagtattctcagatcttttattcattcattactttcccttctggcttttttttccctgtaactttgagagatttttgaagaggaagaaggcagtaaggtcagaataaggcacacacaagggagttggaggtgaattcttgttttctcagcacttgctcttggttaggtattgggctgagggattgcacatatattattgcatcaattctatgatacacattgcttttatattttaatatctcagaagtatgtgttgaaatcaatagtattttagatttgatgaaatatgccttgcttgatctgaacaccaactttattaacaaatttatttatttttatttttttaacattaactttattttacagattaagaatctgtagatcagagagattatttgccctgtgtcacaagtggtagaaccagaattcaagcagaggtctgaattactccaaaacccattaacaaattgtagacattactttagatttgggataaatacctaatgtttattatgacaaattcaggatccaaaataatcttgactggcaacagcagcctgagacaaactaaataaaactgaaagtgatcccctctcatatcatgaccttgttggaagaagtaaatagcaatgagagagtcaggaattagacagaagtagaacaggtactggagtgtggtaggggttaaaaagtgaagagcagtgggtaaagatgagagaaaaaagtctagactctagaaataggcagtagaaacttgctatgacaggtgagggaaagtttagtatgaggtaatggggtgttttgacaggcagacagagcccaggaggtgcaaagctcagcacaggaagtacaaaaagatgcaacagaatgcctcagaaatctctttcaacagctagcaggtcataggcaacaagccaatgggaaggttttagcattagccaatgctagcaaatattttcactgtagaagcatatagttttgaaagtcagtgaagaacatcattttttctaagatggttcataggtcaaaatcctaggcctgggagatgctagaaggtgataagagaaccagcagtaacataatgccaagatgttagatgttagatgttgatgttagaactcctagtttgtagctatgctatactagaaaaggaagaagagtgcttcagtagctcctatgactccacaagagggtaaacatacaatattacagaggagggaggagttgtaagctggccatgttactgctggtcaagtaacataatattctaccctcagctgtacaagggcttagattcctttggggatggaagagcaatatgatggcttctttctgcaggaggcttcagagacaggagattgagtcaaagctgaacatgcccccaggtaaagcaatgccccatccacatggaggccatgaaccagagagaggccagggagaactcttctggaccaatgagtgaacagttacctaagtatatctctgcctcccctattctttctggagttaggccttgaaaggagagctaaagggatgatacatccccagactctgtccccatctcacaaggggctacactggcaggatgagtaaaagagcaaaggccaaatgttgagccagtggtgaggggaagcatgacatttggtatgagattggagttttaaagtggcatggaatgtagttccaaaactgaaagtgcttgcaaagtcatgggatttgcctgggatgttattgaaatgtaacagcaaagggaaactcaaaaaccatgtgaggtttgattttatgtgtcaattgactggaccactgggtgcccagatatttggttaaacattattttgggtgtgtcggtgagggtatttctgattgaaataccctctattttattttttaaaataaataacataattatgtatataatataatataaataatttttatttattttaaaatatcctatctatttcaattgataggttaagtaaagcagtttgccctcctcaatgtgcatgggcctcatttcctgttggttctgtttctctgtagaactcctgatgaatacagtatatttgaagaaagcaattcaaaaaataaaaagtcgttcttaatttatctccaacagagttgagattttgcaataaactggttacagttttgttataaagaggtattagagtactcagttgtgaatgttcaactacacctctgaatttcctgcatcacttttgtggactcattttcagtagacctagccaaacagtctttaaatgaacatattatatgttacttttgtcaaaagcacatcatattattagacaaagcaatgcaatttggccatgagactgctctcttaagacacctctgaaagtgtctcaaagcatagtcagctattagctaggaacagaatttcacatatttacttccaaactagccagtgcatggtgtgcaagagaataatggaaaagagatgcagaaacaactcgtttcaggcacagggaaggggaggctggttggaaaagaaagcagtcttaatagcacagtcattaatttgccaaattcttttctggacttgactgtgactctctgggtagtgtgttatcaatttcagcctcattacctatgcacagcaagggaaactgaggacaaatcatgtccctagacttcagcctgttataaattcccttgcatttgagatcaaataaagcctcgaacttaaattactctcttcttacatcatcatgtctgcttcatttgctccaagtttattctcccagcataaaaaataaggaaagtcattaagtacaagaagggaaatggagtggtttgtagtggtgtcagcttcccctctccagatcctctcccaagtgtgtcattagcctcagatgaaggccatctgaggctattatacttagtcattgtgtgtttaccccagcattgtagctgtcattggctaggcaagaaaaaaaagtacatctggctgggattgtaaatgacacttgataaaggtattcacagaagtgtaggcaaggatattgagatgcgcaatgactagcaacagtgggaagtggtcactactgctaggcctgaagaagcaggaggaagaaatgattaatgtggcataaaatgcagcagccacaagagctgcagtgtcaagcaggaaggagcaagaagagaggtgcactgccatctttctccttctgcctgtctgtctctttttgatgtctcctgttggctgaactcgaccaaaagtcaaagggcaaaggaacccatggtcagtcccttaggtcacaaagatggaaaatggattggagggtggggatagggagaggcaaatggagaataattagctcagttgttttgcatatttgtatgatttgtttaattatttttattagttttgtatttagtaaaagaaaatttatttatccatcaaggcctaggttctgttgcgcaattattatttattatctactgacattcctggtactgcaactgtatctgggatctttcaaacaatatttcaatatattatgctttaagtttagggagaagagacatgcacatacaaaaagtggggctggaaaagtagcttgagacgagatcattgagaacttttactggctggtgagaattttgataggcagtaagaagacattgaaggatgttgaggaagggagtgttttacttagaaatgtgttatagaaagattaagctgacaacattatagcagatgatttgatggaggagaaattgaaggcagggaaaactggggaatcagcattagcctggtaattgattatccttccaacacctctgtaaagctgttgggtgcaaattgttagtggtttactatctagtgcatgggaactgcaggaagattcaatgcactccaaaatagtagcttctaactaccaaattaaggacaaggaggaagctaggttactcctaagtgatgtcggccgatatctcaaatgcagtgacagagagggcctcatgtcatgaagtccaaggacagtgtcattagggcaggaatttactggcctccatgagtgggaaatgaaagtggtcccaggtgttcactgtgaaacaaaccccaaagttacacaatctctttctaaactgtttggaaagtacaaagaagggaggtagggagatgactccagccatgctttgggctcagtgattactgctgtttctgctgacagctcgtctctcatggagatgagccatatccttaatgatctcatttcattctgttttccaaaaagttatactcctcctagataatcaatccttttcaatatcagtgctcaccagccacccccagcccagaagatgttaatctttccatgacccctctgggacctctttcccacccttcagaaatgctatgatcttggaagaaatctgctgttagatccttgtacatatgctattctaccactagactacagttcctgagagcagagatgatatttattcattttagcactcttaacacttattacaaggcctagcattcgatagagttaaatacattttggttggatggttgcatccagctacagatggatagctgtagctatctttaaaaaagctgttttattgggttttaattgtgggatttaattatgttttgtttatagaaaaaaatcatgttctcatcgcatttactaatctgcattatttctgccaacagtatttgatagcatcagtgttcctgtcttctcagtttgaataaataaagtcaagttaccactcacttagggtatataaatatgtaggggtcccattctcacatggttctactataatggagagcttagccatgtatggcttctcaaatacaggctcaataaagataagtaactcaaaatttttctaatatgatttctcctggaacatggtgcagtggcgagggcaacatgatggcaggggttagtggcagtataggtagacatgtaatgcatgataatgtgaaggtggcatgtttctcattcagctctgttggctgctactaagaattcattgcttttactttgtgccatagaagtttcacagaggttgaaacttattagtaaatcatcacagagagcaactttatagttgatacaaatcaccttgcacattacagcattttcttacattgtggtttcagttgtgaagatgtgctatctgtttccattctgcctgtggtgttagagaacaagtcatgggaaaagttgaaatccaaagaaatgtgcaaagcacaacattatcccttcctgttgttcctggtctctacctttggattctgcaccatgtttttatgctgaaaggtgttttaatgatggctgggttgggcaatgacatgtgaagaggtgtcacttcacctggccaacacagagttcaaattatccaaataaaactactaattgggatcttcagatcaaacactgtcaagaagactattattgaggaaggattctgcatgacctttcagagaaacaagatcaaagagtagggatgaagatgagccacattgttaacaataaaattagagagcaggaactcagcaggacttgtagttaccacatctgtaagggagttagaaatgaagcagcagagacaacatactgtgtacaattctggaaacatttatcatttctccagtttattatttttatgatttcttgacagtttttctatagtgattagtatgacaatgtataaaactagaagggcctgccaatttaccctccaaggcaacaaggaattaagggcaagaggaaaatttccaagagctggaaaaagctacttaattacaggacaaactaagtaaaagaaagaagagggaagtatctggaggcttggaggtgatctggggctgagcagccaaaaagttcacaagattggatgtttcacttgctattgggaagaagagaggagtagctgataagaagaatgctctttgatcccctctacttcaaagcattatggatctagattaatattcagtacttctttactcaggtacttttctttaagcttcacctcccttccattagagcgagaaaacattttgtagtttctaaattgtctcttcataagttccaagggataaagtgggagacattcaggagcctggtacattagcatcctcttaatgcagtatgaagttgaggggcttttaatgtggatatcaaaactgattattgaaattgcaaagaagccttgtatgctgcttgcaagctgagatggatgatgacagtggagccttttgcattataaattagaatggctcctccctttttaagtcattgctcttttaggttgctaatttatctttttatctgtgatttatccttccttgctcacattcttaaacgtttttccctctgctgctatgttttaatagcatagacttggatttactgtgactgatttggcaaatttcaagctttagaaaggtgccttaaaactgttgctgagagctttctggagatgggtaataacattgattggaattgatagtctcttgaacaagagaagttgaaaatgttgccagggctccaaggaatgacataaagttgatatcttcatttatttgtccaatcaagacttggctatttctgtctaaagtagtaaacagacatattatttttactgctattaaaagtagcagtagcaataacaatatttatataacatatattaatatttcagttaggattttttatttcataccacataaattatctttgataaacttaaacaaaggagaatttattgaaaagattttgggagcacctacaatcattgcaaacctggagagccagccctagaaataggcaagaaccaaggcagccctagagagaaaaagcaggacccttcagagaggcttcctaaccaaaaccattggaaagtggccaccctcctaggataaagagaaattccagccatttctagcctctttgccctttagttgggatttaaattccacagatagggcatcttgtttgacctacctcggatcacatgcaagccccttgtttaggttgtgtagaccccctgattatttattatgtcagcagactttatgtaataggaaagacaattgctcaagggcatagagagatattgttaaaaatgggaattgaatgcccagcaaccaaaaaaataaatccatggtactttactttttataaaaaatgtaaaacatattcaacttaacctttgcagcaacactctgaaatatacaggcagtattaaaactgtgttatagattaggtaatttaggattaaacatatcaggtaaattctcccaaatcacatagtaattcagtgacagaataatattcaaaaccaagtgtcctcattatatattttatgtttttctttgctttctttcctattctttggggctttgatacacaaacagataagatcattgaggaacttcagttccaaaatattttctccttttatccctctggccctcccaccctctgtcatcactccttgtatctttctttgttccctttggctaatattattgaaagcttattgaatcctcttcccttaattaatttgaaaagatgaacttcaggtactgagtgtattgacttttttttttttatctccatgtctgtattaattaggatgagttttggctgaatatgctggaaatcctaaaataacagttgtttaaacagaaaaaggtctattatcccacataaaagccaaggaaagccaggtctggtgtggctgggtcatcagtaacccagcctcctctgtctttttgttctaccatattagctctggcttccaatttccaagtctttttagaagttatcatgacggctggagggccagccatctggccagatgttacagattggagtaaggagtaaaagcagaaaggcaaatgagggttttctctcgctgtacgtggtcttcctaaaacatcttagagtttcttcccaacaacttctgcttatatttcattggccaggacttaatcacatggctacactagttcaagggtaaatgtaatatctctttctgaactaaggtttcttgcctttaatgacaatatttaattcttggtattgttgtgaggattaaatgaggtaatgtgtgtgcattttctaacaaaagggtttggtaaataataagcacctagtaaaagttgattcctttctactatcttcctgaggcctagcgttcagagcacccatgcagcctccagttgttcatttcccattgctttttgtagaatcttatggtctaaaggagaagataaaagttttaaactcagttaggacttcatccaaatgttaacaattatgctgactagctgtatcatcttgagcaaattattcaacctctctgatcattcgtttcctcattgttcaatgtgaataatattataaaacctatcttgtgaattgttgtaagaatgatatgatatatgtaaaaatatgctcccagtttagttcctgacataagaatagacgctcaagaaatgtgagttgttcctctagccctctctccatcacaaagatttgcagtcacttattagtaaaagcctttctccttgggaaaagaaaaattggcatcttaatggcttttcattattttttataaagaagaataaagtaaatgaataataaaagataatttaaatagttttgtttttctgcttgtgaactcagaatacttcaaatatgatagttcctcattattattttttaacgaaacgttaactctagtgtatatccattgagtgttcacacaatgtgtgccaggtgtgttccagatcatagaaattcagcaataagcaaaaaccgacaaggtttctttctttcctgaaacacattttagaggcacaaataaatgaatacataaataatatagtttcaggtagtgatgcatgtggtgaagaaaaatgcacaggaaaacgagatagagaaggatggctagtgtcatgtcagataagattctcagacagaacaccctcaaggaggtgatgtctgaactccctgcccaccacaacaaacagcctacaggaccttaaggaaaaggctgtatttaggttgattactcagtttccctgagaggccatcagaactagctccaacttgcttcatattcaattttccctcagttatcctcagtagtccaagcctcccataatcattttagtattttgctccataaggcttgacacatttcctaagataaatgaatcttccctaacctttccacagtgctgctgaaattctgaatctggaaatcatggagatttcctccatccctagactcctagctgattgttccctttccttgctccaactgacacctggctctcccttggcctctgagctacacttgcagtgttcttttttcattcccccccagccccacattcaatgcactgcagtgcatagagaaagaggagggccctccacttagagatcattttattccctacctttctcaaaaaccttgcttttttgaagtgcatgccatcagactatacacctgctacccttctttgatgtagtcagccacagatttctggatcacaccctcgaattcactgaatattgcagcatctgactcactctttgtctccgtgacaaatggtggcatcatttgtgataacttctacgtgcatgtagatgatgcattcaataccctggtcttatagttatttgctatcattttgaataaccttttcttccacatcaactaagccatctcctctcccatgtttaccttacaccttttagcttaccagtaactcaactgtctccaaaatcttgatgtcaagcatttccacttgatgcctgactcttacttcccatctttccagcgcatctctttccactgcttagatttctactccattacgacttccagctcatagactctgccacttctcgctgctccccattcccctcaacccctctcacacacattctccacttctttctttgccaagcttaaatgtaagtatttgtcattaaaattactccttcctaaacacacttaggtgcccaccaaaattctgggcaaaatttcggagctggtcagatcaattcttgcctacccagaattggcacaagtgcagcaaaaaatggctggagaaaaatagtcaagcagccgggcacagtggctcacacgtgtaatcccagaactttgggaggccgaggcaggtggatcatctgaggtcaggagttcaagaccagcctgggcaacatagtgaaaccccgtctctactaaaactaaaaaacttacgtgggcactgtggcgtgtgcctgtaatcccagctactcaggaggctgaggcaggagaattacttgagcttgggaggcagaggttgcagtgagccgagattgtgccattgcactccatcctggcagcagatcaagactctgcctcaaaaataataataataataatagtcaagcaaacaactcgagctcattctaaactaatgaccacaaatctcagatgagctgtcaatgttactctgcaattttattgcaaattctggtcaagtcactctcttagtctccagaacaactattttatgtcatctcatctctacttaaacctccaaaactatgcccgtctgtcgcattcttactgagaaaatagaagaaatcacaagagagctaatttatctgtcaccgaatctaccaatgtgttctgccttttctttggacacaattcatgaaccatatccagcatttccactgtactctggacaccacttcaccttggctcctcgaggactttgcacctgcatctgtctcctccctcaccttgatcatcaatttctctctctctctcaaacataaaaacatgacattaaagaagcctacatgggctctgcaacctcctccagttactgtgtcatgtctggcctctgcttcacagtcaagctcttttaaaagttgtttttattttctcaccccccgttctcacctcaactcacttcagccaggcttgggtctgctacgcccaaatggaaactacattctcaatattctcacttttgccaaaactcatggcacaatatcaatcctcattttactcttctcagtcgataatatttctaagaattcctgcgtttttgaagtgaactcagatatttttccacatattttataatgggagtctttgagagatatgagctccttgaccttcattaagtagatttgaatggaattcaatgaaggtctgtttctccctaggcacaggtataccagctcccatggcatttctcctgatgggctctagagcaagacgtcttatgcacagttccagccagaattcaactagatttgggctctagaaattctaaactgaatacctgggcccagtaaccagggcagggatatttgatgtttaatccagctgtgaaatctttttaaaatcaccctgtgtttaactttgtaaattatactgttctttgagtctcctgttttattttgttttcctggttattggcatttccaatttcttatttttgtttatttgcttaatggattagtaactcatcaataaattcccccttgggagaagtaacacattcattgtatgtgtcatgtttgtcttaaagaaagcctagctcattggattatttcttctgttggtgcaaacactacagacctagggcaaacacttgcttatgtgcatactgaaattcattgtcattctgcttctgtatcttcaggtcctaagccttgtggaattggtgtgagggtcaggaagtgaagttgtgcagtgcaggaattagaaattccaacagaccttttgatttgtctagcaaaatgcttttaatttttttaacttaattttttaaagctgagcatgcattcagttcaccaagaccccaacaatcactttttattatctttttatctcttgtctgaccagttttatttaaaatatctttgttgagggtcttctacaggtcaggcactgtactaggctctagagatattgcaggaacaagatagagcaaggtcccaaatctcatgaagcctgcatttaatggagagatactgattaaaaatgaagcaacaaataaacaaacaagaacattccaaataatgagaaatgcaattaagttaatagaataagatgatgtggtgtgaaaagtgtgcagaaggaggtgtaactatagattgactagaccagaaaaccctcctgaggagctggcatttgctctgaggaatcaataatatgaaggagccactttgtgaagaatcagggagaggatgctaagcagagccaacagcaaggtcaaagagcctgtggcaaggaaagtttggtttgttgcaagaaaagaacagtcagtgcaaaatagaagcaagaaggaaaattgtataaaatgagatcggaaagcagagagcagattgtggaaattcttataggctatcgtaaggattttggattttattttaaatgtgatggacagctatggaagattttaaagcatgatctagtttatagtttttaaagtttactctgattactgtgggtaaaatagtttatagaatcaaagaatggaaacaagaagatcaatgactgttgaaaaaaatcctcataacagataatgatagcttgagtgaggtttggaactattaaagtgaacagaattacaaggataggacagacattggaaatagagccaacaggacttgctgatgtattaaatgcatctcgtgaaggaaagagaggaatcaaggacaattccagattttgggcttgagcaacaggctagacaagagtgtcactgattgagaagggaaggactgaatgagcaacagacttagttgggaaaagaaataattctgtttcggccatgtggcgtctaagatgcatacgagacatccatgtgtaaagttgtgtaggcactggatatatgagtcactgcatccatttacattacccctaagggcttctaagtttgtgtctttggtacagaccataggttaagaacactggttcaggagtaaaaagatctttgcttgaatccagtttttgatgcttaacagctctgtgaccttgagcaaaattcttaagttatctagacctcaggatccctatctatataatcaggttaaaatattatgtacctcataaattgattgtgaagattaaataatgatatatgcaaagtgctaaacaaagtgtccagaaaaatataaatatacaatatatattagggattatttattgaacatctactctgagatatgccttttgtatatattacttcacctagccctcccacattcctaacatcagctctcccagctaaatatcactctacaggagactgagaacagattgatacaaacacagatttattttttcacttttcaaagaaaatgtacatacctgcatggactacccctgacttaccaacataggtagcatttctaagaagctgaaatggttagctctacactgaaatccacatttttatggatatgcctatttcatatctcttctttgatgtctgtcatttcaaacttgacatgatctgatctctaccccaaacccaaatcttctgctgacttcctcatcttagttgaggacatctcgggccttttgattgcccaggtataacaccctgtaatcatcatcagtccttgtctttctcacacatgctttatgaaagctttgtatgaaatggcttcatggtaccccactctcatttcctgctactcaccccctcactcactttgctccagccacactggcctacttgctgttattcaaatacactaggcatgctcttgcttttgcacttgctgtttccttagcctgacacccaaatatcctagacattcccccagacatctgtcttgttaacctgaccacctgttcaaaattaaatctctcctggcactatttcccttcccttcctttaccccggctcattcggagagacactatactctctgaagccagtttctctggagtcaattcttctatcagtaaagatccattggtcctctgcctgctgactcagccccatgacatgcattagggttgtctctagctgcaatataagaaatcatgcaactttgggaggccaaggcgggcggatcacgaggtcaggagatcaagaccatcctggctaacacagtgaaaccccatctctactaaaaatacaaaaaattagccagacatggtggtgggcgcctgtagtcccagctattcaggaggctgaggcaggagaatggcatgaacccgggaggcggagcttgcagtgagctgagctgagatcgcgccactgcactccagcctgggcgacagagcaagactccgttaaaaaaaaaaaaaaaaacatgctatagtgactaaacagggctttatttgtctcatgcaacaagaagttcaagggtagatagtctaaggcctgacacgactcagtgtgtcaccaaagattcggaatcctcttatcttctttttctaccatccttgtgcttatcctcaaagccatactattgctactgattttttatgagttccctatttcaggcagaaaaaacgaggaaagggtaaaaagcaaaagataaagagttctcctatgttgtaaagtctgtcttctatagtctgcactgcctgaaattgcttatttttcagctatttttaacctataaaatggcaatttcatatggtctgacctaatattggggaaggaacatcttccccagaggcttttttttgagatggagtcttgctctgtcgcccaggctggagtgcagtggctcgatattggctcactgctagctctgcctcctgggttcacgccattctcctgcctcaggctcctgagtagctaggattacaggcgcccaccaccacgcccggctaattttttgtatttttagtagagactgggtttcaccgtgttagccaggatggtcttgatctcctgacctcgtgatccgcccgcctcggcctcccaaagtgctgggattacaggcgtgagccaccatgcccggccccccagaggcttctacctgcatctcattggccagaactatgccacttggacactctcagcctcaggcagagcaggacataaagattgtgtgagcctttaaggcagccacttcagtgtttgccatccacaattttgttcgttttgagttaccaatcttccatgaacttattcagcttcctggctttgagccatccccctcagagcctctgttacaaggcagccaccactgtttcatagacatgggggttcataactcttcactaaatccctactccacacctcagcacatgagaacttttgggtctcttatgtgatatctacagattttgaggaattacatttcagagactggggcagtaatgatagaatctcgggccttctgtctaaataaaccatactgtcatttccattctaccacattatcctgtgcttgtgtggctaaaaaaaaaaccctgcagagctgaacttctaaatctttatacatattatttaatctaatcctcacagcaagcttttagctctctcttctattgctattttatacacgaggaaactaaatctcagagaggttaaatccaaggccctttagctagcaaatgacagagcttctattcaaactcaggtctgcctcaagccaaagcctcgtcctgatccatttcattaaattactaccaagtattacagatctttcctagggcaatcattttcttctatataggactcctggagtcactctgagtatttctaatgaggctgacaacaaagggaagcttggaagtttctaagcagtcacttccacagagttgcttaatttgccctaattcctggtttttgcagcccctgtcctaggctcttgctcacatatggacttgaatttgtggaaaggtcaaaaatgatattctagatggagagatagtcttggagtacaaagaacataagcagaaatgagtaaataaagctctaggagagcgtgtgatccagctcaattaaaggttagataagccatggtggcacataagctttgaaggtagagttcaaatcataccattaggattttgactgccaggcagaagagtttgatctttcttctgttggcaatgatgatgtattggaggttttgacacaggagagttaaattatactttgtgtttacaactttaaaaaatcaaaaaatttaaaaattgccttgaatgcaaagcaaacataataatcctaccatagggattccaaggcaaatttgaaagttttgtgacattttctgttatcatttctgttttccaagatagcaatgagatttaatttgcgcatcacaaagaccgttagcctttaaacagacaaaacagaaaattcttacgtctaaattcaatttttgttgtaagaacaaaagttgctcctactaacgttaaataacaaatgaccggaagcatcttgcaattcaatgttaaaatagttcctgaccaggtgcagtgtggctcacgcctgtaatcccagcactttgggaaaccaaggagggcagatcacgaggtcaggagtttgagaccagcctggccaacatggtgaaaccctgcttccactcaaaatacaaaaattagcggggcacagtggcatgtgctactcaggaggctgagggccagagaattgcttgaacccaggaggcggaggttgcagtgagccgagattgcaccactgcactccagcctgggtgacagagcgagaatctgtctaaaaaaaaaaaaaaaaaaaattcctaaattgtaaaaccagcatggcaaacgaaatgaatattatggcttccttgtctagagtagaatggtcatgattcagaatataattttttaaaacatattgaagaatattgaataatttaagtgactcattaataacattgagaagctacatgcaataaactcagctagaccatttaaggtactggtttttatttgtccaagtaatgtcacattattgaggtggcacagaaaacagtaatccatctgtgagtcagaaatatgtgagtcagcaacactgtgtgaagagccctctgtccttttgattactcaaactgatgttttgattcaactgagtaatttaccagtaagttaagataattgagtattaaaaaggaaatccatgttgagagaattggttgtgaaaagatgaagtgaggaaatggagttattgacagagctgagaagtattcagggatgtctgtatcaaataaatcaacccttcaaatgacttgttttactgttggtgattgagtgagtccaaggacaggcttctaagagaagcagttaaaagaaatgctttgcaaatgtgtttcctcaaatacttaaatttgaaggcagtaactattcaaaggatggatttgcaaaatagcaatgccttctttaaaaacaggtgtttaaattggtattgatatctgaagaggaaaatgaactcacattggttaaaaagtaaagacttctctattcacttcaaaacactggtcttatttccctcttttgaaaggcttcctatggaaagaaaaatcaaagcctatcacggtgattcaggagttttatactccatgtgtgggtcaagtgtgagtgaggtaaaggattgtgacagttcctcaaggatactgtcatagtgaggccatctcccaaacctgactggttccaccttaatttggctttggggaatgaaattggggactgtccagcccgatgaagggcaagctaagacctgctcataggcatttggtttaaattacaagaagattaaatttctaaaaataatggcaaagaacagcaaagcctggagactgagctttaatagaatcatcataccatttatttttggaatgttgacgtttctgaaactcctcagatgcaagatcaatgctaagtagttttatagaaattggatgcattttccataagattaccagcagagcagagggcagtgatatgcaaaagcagtgcagagacagtgcctcaaatacactgcaaagctctgtccgggcgcctctcctgaagcacctggcatcagcactacattttcagacctttatctgttaaaatgtttttttgcccttttggggatatacagtgtgctagccttgttgtctagctgcattggtcattcatcatagtttttctgtagttctcattgttttaaacacattagggaaggattggtaaatagatagtattctatatcatgataaaagcttgataaaatcacctaggaaatcggtgtagaaaaagaaaagagcgtaaagctgagcccaggggccctccaacatttagaattggaaaaaaagttagagtttggaaaaagacctaggaagccaagaatataggagaaaaaccaggacaagacataccttgaaagtcaaatgaaggataacttgggtcaaatattcctgatatttgagaaagatagtgactaagaattgaccattggtttggacaagacgtaggccactgatgatcttgaccagagggatttattatgaagtgttgcgggccaaatcctgattctagtgtgttgagaagaaaataagtgttaaggaaatggagacagcaataaagacaacttgttagaaagttttgtttaaaaagaattgccggaaaatgaggcaatggatgcaggggtgcatggaataaccacaagtctttttaaaacacgtatttataaggtacaaatgacatgccaaaaatgcacttcttaaagtgtacaattcagacacatatacatttatgaagctatcattacattgaagataataaatatagccatcaaacccaaaagtttccctttgcaacccctcccacctctccctgacaccacccctttccccccaggaaactacctatcttctttctgtcaccatagattgattttattttctagaattctatataaatggaattatacattatgtactctatttatcagacttatttcactcagcataattagtttaggattcatccatgttacggcagttgtcagtagtgcattcttatttattgctaagtggtattccactgtatgggtatatcacaatttgtttatccattcacctgttacatttggattgtttccagttttttttttactatgccaatgctacaatgaatattctgcatagactattatatcatctattaataaaaatcattttatgtcttccttttcagtgtatttgctttgatatcattgtctttccttattgcactgggtaaaacctccagtaaaatgttgagtagaagcggaaagaacaggcattcgtacctggttcctaattttatagagaaataattcagtcttttatcttaaaggataatgtcagctgaaagttttcacagatgccgtttacctggttgatatgtaaatatatgtgtgtgtgtgtgtgtgtataaaggatggatgttgaactttatcaaatgcttttttcttcacctaattatgtgattacatgtatgttggtttgtttttcagtctgttagcatggagaactacattgatttttttttgtctgttataacaaccttgtattccttggatacaccctacttaatcataaggtgtcatcctcttcatatgttattagatttgatttgatataattttgttaagaattgttccatgtgtgtttatggtgatattattcttttgggtgattgtctttgatttttatatgggagaaaccctgaccttatacagtgagttgagaaatattccctcctcttcaattttctaaaatgatgtgtagagtcagtataattttttaaatatttcgggcagaagtcaccagtgaagttatctgggcatgcagttttctttatggaaatgttttaaactttaaaattcaatttctgtaatagatacagacctattcacattatttctttcttcttgagtgaattttgatagatggtgttttacaaggaattcgtccacttcattgaagttgtcaaatgtactggcataattattattattatttttgagacggagtcttgctctgtcgccaagactggagtgcaatggcaggatgttggctcactgcaacctctgcctcccgggttcaagtgattctcccgcttcagcctcccatgtagctgggactacaggtgcatgccactatatctagctaatttttgtgtttttagtagagacagggtttcactatgttagccaggctggtctcaaacgcctgacctcaggtgatccgcctggctcagccttccaaagtgctgggattacaggcatgagccaccgtgcccagcctggtataattttttttatgattctttattatttttatagtatctttagagtctatcctgttatctcctctctcattctttcagtaacttgtatctcttctttttttttcctggtaagtctgactagaggtttgtcaattttattgattactcaaaacctgttttggcttcactgatctctctctccctctctcttttatttccgctctatctttattttttcccttctgcttcctttgtgatttatttgctttttcttgagctagaaacggaagtcattttttctatttttttaataaaggtattttagagctgtagatttccctgaacatgctgctttagctgcatcctacaaattttaacatataatgttttcgttgtcattcagttcaaaatacttttctcttttcattgtatctttagctcatgagttgtttagactgtatttagtttacaaatgcctggggctttaccaaaaatctttctggttttgatttctagtttaattccgctctgatcagaagacaaactttgtatgacttcaaatttttttgatgttttgagacttgttttatagactagaacgtcagctattttggtgacgtttcacgtgcacttgaaaaaatgtctatctttgtcaattagttaaattgatgatgttgttcaagtcttctatatccttactgggtttctgtctatttgttccatcaattattgaggctataattgtgtagttttctatttcttttttcagttttatcaatttttgccttatgtagtttgaaactctattaataggtacagaaatatttagaattgttatattctcaagaactgactcttttatcattatgaaatcatcctttttattcctggtaatattcttaactctggaatctacttattcttttattaatatagacattctagatttctgatgattagtgttatcatagtttatcttttttcattcttttccttttaacctatttgtgtctttatatttaaagtgatctattataagccacatgtagtcaggtcatgcttttttaatccatcttgaaaatgtcttccttttaaatgtgatgtttagaccatttacatttgaaggtaatattgccatggtcaggcttaaatctaccatgttgctatttgttttctatttgtcttatccattctgttgaaaaaaaatgtttagacaagttaaatttaacagagtttaactgagcaaaggattttttcagaatcgggcagccctcagatcagaacaggttcagagagcagcattccacagtatgggcagcagcatttattaatagaaaacagtaatgtacagaaacagcttgattagcatgattacttggccatccaaaattgaagcttggctgctgtgattggctgagctcagctatttgttacataagtataagcctaagttaagctttcagttaatttatatcgtaaaaagtacagaggaagtttcaggctaaatttagcggttcattatatgctttttcctctttttcttctcttttttggatagttgttttatgcttccatttcctttgttagcttattatatatatctcttcatttttaaaattttaatagttactttaggatttagagtataaatttttagtttatcacagtctaccttcaagcaatattttaccgctttatctagctgtaagaatcttcagaatacccttctatttcccccttctttgcctttgtactcttgtcatatagtttacttctacatatgtcatgaacttcacagtagattgttattatgtgtgcttttcaatcacttatcttttaaagagattttaataagaagaaaaaaaatgtttattcctttgtatagaaccagatttccatctggtatcattttccttctgcttgaaggatttcctttaacatttcttgtactttgggtttgctggagatgatgaattccttcaactttcatatgtttgatgaaaatctttttactagttattttttgtttgtgggtttgtttgtttttgatacaaaactttacagcttgattgtttgctcatgcaaaatacaaaacgatgatgcaggagagagtaaatgtatgcagaagggtagaccatgagtaggtgagggaggacagggttcaggacagaggagttggcttctgataaaatcacagaaatgtatccatagcagcaagaagaaagacagaacagttgtttacacgtgtgagttgattgattcattaatggatccaaccaaactggttttaaatccacgatgtaccatttaatagctaagtggttgtcagcaagttatttaagccttttaaatttgaattttcacgtctataaaaacaagttccttccttcctcagaaggtgattagagcaatgaaatgaggtaatatataccaaatgtacagcacatgacctggcacattgtgcccactcaatacctgtgagaaaaaaatatatagcttttctatgctttactgcctaagtacaagtggaaagattctgaaatatcatttttccacttctactttctctgcttccctttctctcacccctcctcccttcccaaaagaacatatttaaaatccaaatgccaggctgtctgcaggtgcagtgttcaagactgataacatttggaggccagatgttaactgacataaacactattaagtgctatgtagaccggaggctgaggcattgatttccaattttatgattattatttgaatttacagcaaaccataatgccattccttccacgtctctacctccaccaaaaagacaatatatggcctattcattttcaagagaatataaattgtttttaaaaatatgaagttcttgaaatattaagttatgctgtttcacaaacctggaactgaaaatgcacccttgatgtgcacctcaacacctccctagagctctgcttgaaaggtcaaagacttgtgaaatttgatctgaaaaccagtctcattttctgaaataaatgcagagtaataacgacaaaaatgcttcaaacctgggacaagtttttacatcaacttatgttttaaatctcagtttccttagacttgatgtgggagctggcccaatgacaataaataaatatcctttctctgagtaaagaaatactttgtaaaaacaagttgggtctgctgtgaaccatggaggttattgttggtgtttaatgcgctcacacagtcaattattctttcattaatctattgagcagacatttgttcataacctgcagtatgtcccaggaaagtgccaggcactagttagtataccgttaagtgcaacagatggccctcgtggggcttagagttgtgtgagagaggaaggcaataaaaggggaaaaaaaagacaaataaatatagcaaaaagctttaataggtactgtgaagggaacttacttaaataatgggttaaggaaggaattttttagtagatgacttaaactaaagcttaaagaatgagaagaaggcagccatccagagagtagaggagaaaacaaacagaaagaccaacatttattcattcattcactcgacaaatatttatgtagcactttctaccagccagggactgttcaaagcaaagcagatataccaggaaggaaaacacacacgtgcaaaattgctgaattgagaaaggatttggcatgttctggaacagaaaggaagcttctgaggctgaatcacactgagcagggcacagtgtggtattggatgaggatggggggtgtggcaagggctagattatgtgaaaatttgtgatccatggcaaggagtttggattttatcctacaggcagtgacatgattttattattgtgttaaaagattgctcttgctatgtggagaaggtttggagggtggagttgggcacagtggaagtggagagatccatggggtggctattccagttcagatgagagattttaatgccgtggtggaaacagagatacacaaaacagtacagtttctgtatagagtggataggacctgttggtcaactgaaaaggagaaaggaggttgggaagggaagtaaaatcatggatgattctggtttgtacaactgagtagatggtggttccatttactactatgagggagaatgagtgagtaggtggttgggagcagggaatgaaaactaagggggcggggaagggtgggataaagattaaactaaagtttcctagccaagtcttgaagaattaaatcaattcaaaaatttaattcattatgtcagtggttactatggccccatcactggaatatacaaacagaagctaaatgaccatttatctgcaatattttagatacaggtttcaaacatatatctagaactgattttcaaatggtaggtgagaacttacaaaagaaagcagcaatttcttgaagccatcactactttagtaaaaactagttttcccagatcaatctcatttccctaattgatcttgagctattggaagctggcaccatatttcttaataaaaatcttatttaattaatagattgtcttattggcagagatacttaacttatgaattaaagtatttatattttactaatagagcatttaacgatctcttatgataactttaaaaaatggagaatgtagcctggaaaatattgagcgagtagaatattttgtatactcaaagtgcaccctggggcagaatcaatgcaaagccacccccctccctggccctttataatgtctacatacagaaaacattcccacacaaaattaatctcttttagagaacttttcctttccttagaattacagttttataaaaagtggtaattactattaaatgttgtaacatcgtttaggggttttagtagataaaagtttgaaatcgagtctgtgaaatttcagccataattagaaaacataaagaaagacatactttgtaattcctattatttctgagaaacattttttacctggaaagggatagacagagcattttgtaagcttgctagaaataatgctcctatatttatgaagagggaatgtttacatatggtcttgttctgcttgtgcattaaatagtatgacataggaacaacacaatgggaaattaccaaagaatcacactaaaatatactcctaagcatttgaaacaaaacttttaaaaaatgatacttaacaatttcagtagagaaactaagtgttgatattcttttttcattgttcacccatttcttgatagtgaaatgtttacaacccaaaaaaaggatctcaatcaataagtaaaataatttgcaaaatatatttatcatcaaaaattaaagctttctaacaaaggaacattgagaagtacttgtggcatttccatctctcaccacatcaataccaaagaatgtgaatgatttttgctgtgtgtggtcattgggcctctcctttgggcttagagccctgtggaaggcattctagcccctccctgcaggtggtatttggtagcacatccccagttcttctttatggagctaacttttaggggttgattagggtacagggcaagagatgactgagtatcaccgtatcacccacagtcagtcttgttgaagttcgtctgtgctgtctgtggtgggtatcaaggggagtttataaaaattccttggtcccaaaccattcatttgttcatttgtttattcatcagacgtgataggcatggcccttagcactggggttaaaaataagaaaaagattcaaacctaagtatcatctgactcaattctttaaagtatagaaatgaggataggaaggaactaaaggacaagttttaccactacctgtatctgatcttaactcaaatgacaccgcctgagaaaggtggatggtgtttcccggtgaagtgcaatagacaacctacatggctggatagagcggacctgctgactacccaaactaaagaaacattattccctttgtctctatcacactactatgttttattttcttcatggtatttctcactatctgaaactatcttactttcctatttgttgtctatctttccctcagggaccttgttccatacactgctgtattctcaggcggagaacagtgccttgtttcatagtgggtgcttgctaaatatttgttgagtaaatgaatgctcatcaccattaacataaaaccacacttgataaccaacattttttctatctccaaaatgtctgcaagttgtctaatcttgtacctcagggatctacctcacaacttcatttctgtgggaaaagactgaggtgtggggggcaggatacagggagcccctgtttcatttcagttagttcccccacagagctggaagtagaagccggatccctagaatctcagagctcttcagcattcctgtgctacctctggttgagcctttctgtggagaaagcagttttggattactgccatgaatgtaattttcaaaggccctggaagaagagaaagcaatggaagctgcttctagacttcagatgagctgaacatcagagttcgtcttcctagtctgtggaagggaagtcatagactttggaactgaattcttatggcataactgtaatattctgctgtagctgtggccagaggagttctgcctgccttcgtctaggtcgtgggctctatattaggctggctgtgtttttcacagcttagtccttcattagaaattaggactggctgcagcctgcagtgactaattatagaaagatgggtcattgtcattgtgggtaaaaacacatgtgcctgttaaacttctctgtctatagggatcagatagtacatttgaagtgatagccaatataatcacttaagtaaatggataaatatttatttgtttttattaaaatgatagacaagcatttgaagacattcatttctttttctttttttttctttttgtgagactgagtctcactctgttgctcagctgggagtgcagtggcgcatcttgtctcactgcaatctccgccttccagatgcaagtgattctcctgcctcagcctcccgatacagttagtttctgagtacaaccgaggagaatattttccaatagaaattttaagaaacacagcattttttcatgactatgcctacccccacaacacacacactctatacagaaacatacaccttattatagaaacattttctgtaagcaaaaactcctaggacggagttcctgggatactgaagggagaatgcggaaagaagaacctagtgactccctttaagagctccactgaggtcatcacctgccagaggttttaatccaaatgaaactggctttttgtcagatgcgagaaaaaactataagatctttgcattcatttaacaaatatttgttatgtgccttttggtgtgatactcagctctaggccctgggactacaaaactaaatgaaggcttcattcctgcttcaaggaggtcaccatctggtggagtgagagagataagtaaacacaagagtatagtctagcatggccggttctggaatcaaggagtctaaggggacatctgaggggtcagggcacagattgtaaggtgtaatgaaaagaggtcacaccttagcagttttcaaatgaagcttcacatttttcaaatgaagcttcacattttggatcctccattttctcttctttgaaatgaggcaaaaagaattagcctgccagagttgttataattcaatgatataaaagagactcagtgagtaatttctaagaaagaaaagcaaaattgagacagcaagagctctctcccaaaaggcagtgaaccattctgcggacctgtggatttgaatctcttttgtggagtttgcagtctttctagcgggttatttgttagaataagccaaagaggttcacctagagaatgactaagttgcgaaagaaaaatctcctctggttcagaaatgaattattcctaggatgttgcttcatgagtctttgttacagaaattggagtttgtgcaagtaattggggatcaggaaacaaccaccctggggacaattgcaggcaattctgcgaccacctggcttaacttgaattctaggaagtagagcttctcttaggttaatcaaaggtttcatggtacaccttgtggctcttttctttatccctgatttttcctcccaggcttatgaataaggcttcagttatgtttctccctccaaaattgccagcagccccacctgctgggcttggaggctggggcctgcagcctaaggacagtgtggcagtctgctgccatctgctggctcacgtgtcaccagctcagggctggctttgcaaggattccccaggaatagaaaccaccaggagaataactgtgggccagagaacgttcctgctcatattgaaaaatgaagagatgagaagatggcagacacaagctggtataagaaggcttttctcctcctgcgagtttgtgtaaagatgtgaccatctcaaacagctaagccagtgatatttctatgcagatttgttttgctcagggagaacatagcagtgctttctaaaaaatgtatcttattttatttagatcactgtctcacaaggccgaacaaataaattaatgacacatctctgtagattcatttaaaggaaacagcagaaacacaaggcagtggggtctgaggtgggtatagggaagcagaaagaggggagggattggagaaacatttcgcagtaagttatagtatattttagttggttctgtccacattttttgaagacctactgtttacaaggctctgacccaggtgcctgggatacaagaatgagtaatacttagtaatactgagtcccttctggcttggagataacaatgtattggggagcagtaaataaatagagaattaaaacagaattgcaagtactgtgataaagtactatggtaaaggaatctaggagagcacagaggaggagcatgtgtcaaaatcaaactggactgcagtgtcagagagcgcatactctgggagatggcatgaactgaattttgaagatactagctcaatggagactgtaatgggaaagacattccagttatgggaagcaccacttctcatacagcccatcacccaccatcactgcctggaagagctgagaacactagatacaatgcaagagaaggctgttaaaacattaggtctcagatgagcaattgattcagtccagggatattggcagaggcagggagaagaaggcagatccaagtgagcaggcaacataaataatcttgaagatcagagagcagggcttggcagggtctttggacccagggaaaaggccactttcaatgccgtgtatatatgggcaaccccttccaggcaggtataagtcacaatcaaatattcagaaacttgtgagtaacttcctgtcttaatctatctgaaacttctgtgtgacctcatttaaatgttgaagtagctacaagctcaaagttatcaactgcaacattattcagaattgcaaatatgaagagtgaaagtagagaaaatgcttgagaaaattgtgatacagcaactgaatgaagcagctcatggaaaatgctaattctgaaaactgtagcacataacaaatacttgtgaaaaaaatcaagatccaaacctgcaggagaaaaaatattcagaagagaaaaaaataaactgctagtaatgatgttgttcttttctctattgtctacgttttatataatattcttatatttcttttataatgatttttttaaaatataaagcagcctaaaggtgaaatatgtgtcctgatgaaggcagaggcaaaaattaccctaaacaaataatggccctatttatgtgtttgtttctgctactgtagattccattttcttcctaattgtatttcagtttgtgtggtatattcattttgcttattaagcctgtcctcagccttccctttgcccacacccctcctcactccctggatctgtgggacgtattgtgatgtctgcccgctaattttgctgtgactggggctggtgtctggttggtgattcatgtttgttccaaagttgtacatctgtgttggttgctttgaagcagtgccccagggaatatgaaaggccatttgtctccctaagactgcttctttgcatcagagacttcttccctggcttcgtttaaattccagcaagctctcctgagtttaagtagggtaagaaggaaagaaaacaaaagcaaacaggggcatcatggagagatcattggagtcagggtctaaccccagtttacctggcataagtgaacttcttggattctaatactagggacagaatgcctatgacactcattttaagggtaatgctttgtggacttaccctctgcccactaggaatgcctttagcaaaaaagaaggcagaatgagccttggtggaaaccctgaatggaaagagttctaagagctcggtgggcatacccacttggcacctgctctaagattttagcacagatacacacagcagtggtattcataatatttaatgactggcactgcatgagcactgatgaattaatggacacaggcacagtgcttccagacaccaatcctttagttactggatcaccaagaagtccagctgaccctggagggcctggggcagtggatggatgctaacagttttaaaagtatgttagtgttttaatatccagaaaggttgcacagatacataccagatgaataacaacataaatacatgaaatttctaaactcatgcccaccattaagttttgtgtaatcccctcttcactttttaagaacctacctactttgcccttaaaaatagttcagagcccatgacctactgtttctaggggtttgggtggcacacaaaaaagcccttatccacagaggggctttttattttgctcaactacgatagatctcacccaagggaagtttgcaagtcgctttattatatttttgcttgctgcaatgtatgtggctaacaacgtagctctgcctccaggcaggctggcaagcaggctgctagtatgagtgattgtccacctgcctgtctgcctgcagtctttgaaaggcagccccatcccagaccattagcctactgagaaaattcatctacagtaccttgaaagaccaaacatattggattgttatagcttttctttggccttttacccagacattatcattttctgcttcttatcagacacctggagtttgtgggttgtctaaaagcagcttctgtgaatggtctctggggaagccttataaccctgccttctgtcatttcttctcctcatgtttcaaggaaacctacagcttcagggtaatttgctgcctccccgttttcattcaagagagcagccaaggttgcttatagtctaactggctctttatgtaccaaattacttttggttgaattcagagactaaagaggaatttcactcagttatctattgggccattctggagttctgtcattaggaaagtctgaggttgtaaagaaattagttgcaagacatgagtcttccaattctgctctgcaagttactagcctatgactctgagaaaggtatttacatcttgctaagcctcatttacctcaaatgtagagtaggatcattttatatacttcacagggttgttaggagtaaatggaataatgtattgggaagcactttgtaaagtgaagaaatataagcaaaatccacccaaagtgagctggttgtaagaactagtgaaaggaaagaaccaagaatgtagacataaatcatggccgctgaattggtatacaggaaattcactgttgtggtctaatttgaaaaaaggagcatcctcagccccatatcttttgttcaccatctctctgcaaagctttagctggggagcagtgagagttctggagaaatactagggaagaggattactgtcaatttgaggctaagagagattgtgtgtgcaggaaaaaatgcatatgtaatgataaaggagaatgtgaaaagggcacagtgcccagggaaataccaggagcgtggatacagaaaacaagagacaaaatctctactgctcccgtctgtgtgttcattgatcagagcatgttcaaataattctgggcttgagggcacctttctagagtgacgaagaccgataggaaacctcatgacactcctctgtgggagccagtgaatgcatcctcccccagagacaaagctctgcagccttggagagtaatttggtgttagcagattaattaagtcattttctgtggttaaatttgcagatgaatattaaatctcaggctgggcctcccatctaataacccagtggaggttgtcaggataacactttgttcctgaaacatttagaaatacgtgtattgtatatttaatgagactgtgatatttattcatgacaggaagaagtcttccagacaggaagactttactcatgtgatagttcagggtctgacacctagagctgtgctgaatgccccctctaaagttgcttattatcaccaagttgttgtatgcctggcaccaacgccgaatttgtccaagttactcatgtcactgaaaggccatggagtttgctcctgggttcaaattctggctccattatttgctaatggtgggcatgggtaaataactgaacttcagtgcgactcagtttcctatacataacatgaaaataataatgactgcaactctaagctgtgttgaggatgaaaactttccatagtacatacagttttatgtaaaatgcttagtgtatagtacctgccacacgttggttctcagtgtatactatgtgtcctcctccatggttatcatgtgaccagagtttcccactttctctttaagctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcagtaagtacaagctctgtctggcttccagtttcacatttacctcatctctacccaggtcacagtggcagcaacaacaattccccattaatctatggtaaggatgaaggaagaaaatgaatatgagcaggggtgacgtgatgaccattttaaggacattaatgctctatagcatgcggaatatgtagctggggtctccaagggttttggaaaacctagacacagtgtttactttacatcttttactgataccttaaaaaaattattttgcttcatttcctgaactgttgagtcatttatggcatgagaaccttaacactttttatacatcacacttgaaatttcagctgtgtgtgcagttttcatgaggctccagcaaagaggaaaaatggtgattggttatatgcatgctgtctcagtagcctttgcttggtgactttaataagatgtcattcagacacatgcctgtgtcccttctctgaaactttaacacaatgcccacttgttgcctggctccttggtgagacacaacacactccaccgccctgtaaagcactgctgatatttttgttttgccgctattaattgtaaatctctaaattttatttaaagaacaagatctaggttgtgtcacccatttattaaatttccaaaaccaaataaaattggattctggaattcatgccttaaaaggtttctgggcacagatacaattgtttttatattatacgtcataaaagtatcagtagctccctaaggtctccagtttggaaaattccactctgttctcttctgctattggaagggaagtcaaaaatttcaccctctggtgaaagggggaattttgaagctaccagcaaaaaaatattccttgaggcatttctgccagcacattttaatagacgcacccctgccctaaaatatctcaatcattgtgtgggcccaaattcatttttcagtcatttggcaaaatttactgattctctcctttgtgccacacattgtgtcaatctctggtgataaaagacaaacaaaacagtgtaaaaatcacagatgagttaaaagcatatctcattctcaaaaaatgtgcatgctgtcagggaggttacagctaaataagaaagataagaggaacacacacatacaaacataacagagtgaaaggaaataacatttaatgagcacttcccatggagccgagctcatgttcttatgttatctctgttaatctgtcaggtaggtgtctttattatccccactccatagatgatgaaactgggactctgagagattgagaaacttgcccctatcccatgactgtgtatcatgctgtgtcccatgatgtggctaagcctgaccatattaaaaacttttggaatctttccatccatgttcttcaaattgcaaagtggcatctctaccactaggtagaaaacaaatgactgcagagtagaggtgtccaaggctgcaggagaggtaggtagccagcaactttgctgtagatcttgtagaacccaaggcatttctgacaaaagtttgaatgggggtctttgaatgcaaagatattgggaattctttccttcaccaagataaacacctttctaggcttcatcatggaagaccgtaggtcatgtggtgagctcaaagtaattagagcttaattcacatagtattttacaggtgcaagattagctttgaaatcttgtcattccccaaaaactaattccctggctaagagctctccagactcaagccaaacggcaggaagaatctcaaggtcattcagagtcgccccagaaaactctactgcacttccagattaaatcttgtgtttcattatttggaatcaaaaggttgtagaaatgttaaatttgaagagaccttaaagatcacaatccaactgaatctacggcagtcaaaaaagaggtgtagttctaaatgacaccgcatccagcatccctgttactggtagtttactgtcctttcaattttactggccagtaaaattccccaccacccgccccaccccctgcccccagtaactttagaacctaaattttccaactttaaatttaggcaagtaaaaattatatatgtaaattatttaatatcattctcactttttaaagataaggacttagataaaaagtagtatgggcacaatttcataataaaaagcagcctttcccaagaaaacaaggttggcaacataataccaccctatcaaaaatactgataacaggatatattaaaatctttgtgtgaatgaaaatagcacaagattttgttttccaaatatttcagtaccacagaaaaaaacttttatatatttgtcagttttggaattatatttcacaacacgctgagaagtagagtttgaataatattaagcttcttctagtaatttagttttaagttggcaaatccagtttcacataaatatctgaatctgaactaaagtaatgctcttaaagctatttcatatgattattaactctttaagatgaatcgaaacagaggaacagcagctccccacacttcccgcccctttttttgccttctacccatagatccaggaagcaagaagggtgctaatagaccaagagtctagatgtgaaggccactgggtgggggctgccggatgttccctgctcacagacctcatacccagcacagagctgtcatgaattttttatgaatggtggaaaactttgcataattctactgcattaaatcctagtaataaaggaaacactagcttttaaatttttctcatctgaattttttcagaagagtaacagaaaattatagtcaggggagagtgagtgaaaagatattaagagtaaaaatgtgaacaagaaaaattaaaagtagctttaactttgagcaacaaaggagaggatcagaataaggctttatagtgaagtaaagcaagatcaccattgggtcccaaaaggcaatttcagatgctttcctagatgtggcaatagtttgctggtttctgttcagttcctgtgttgtagtcatcccaaacgtaatgccttcgtatactgaggtacagattgcctcatgggaacataaagtactggaaactagtaaggccagttttactgctgaaaactgtggcaggaaccaccatggacagaatggagttttgattatccacctgcaaagccacaggaaaggaaactccatgttttttttcatttggtcatcccattttgcaaagccttacacagacaagaagcttttgaaagccaccatttacgtgtggactaagtagtctctagagagagcctactcattttcaagggaaatgagacctaagaaccaagaggaaaagcagaaataataatccacttaaatttaaaacctgtttattgatggactagcaaaaagtgcagtgtggtttctaagacttgagttagacttacaccatcacacttactagcaccatggcttttaagacattgaatctcttttattgtctctaaattatctgtaagtaaaagcacacatttattgagtattttctgtatgctatctgttaaaatactttacatatgttaattcatttaatctccatatccccaatgtggtaggtactataactttcttgttttaatgatgaggatattagggcacagagaagttaagtgacttctccaataaatgggaacaagacgaacccaagaagtctaggaggtaaactatatggatatccagtatgtaaacagactctaagtgaggctgaaaaatacaaaataatgctattaatttctgttctgcctacctttccagctgttaggaggatcatattcattctctcttttaataagtatgtaaatttaggaactttgtgaacaaataagacagtttctgtgtcttcaagggtacggaaacattagaagtcaataggcaattttagcagtttcagataagggcaggcatagagagctatgcactggtttgaaaggtctggccaggcaggaaagcagcctactctgaggaggttacagctcagctagaggagtcaggcaggcagaggaagtgcaggagaggccaggtgctaactaatcctccagttagtgtgggagcattttggagaaccacagctcagtgtggttgatccagaggatatgagaggatgaggaagtggtgaaaaacaagactggaaaagtgagcaggaacctcatcatgaagggcctatgttaaggaattggcctttatgttgcaagtggagagttactaagcagataaacatataatgcaacattttaaaaaaatagctctgattgcagtatagaaaatggtttaaagggtagggaagcttaaaggctagtactcaaacctacagagccaaacaggaggctgccatgatattcatgtaaaagaggatggggatttatattacagatgatctagtgagcagttagtacatatttgcaagtcaggatcagcaggagttagtgtttaattgaaggataaggaagagggaggtttcaggcttggtcgagaagataggtggttgcactatttcctgggatcaggagcattctcttactacatgaaataatgtacatgaaagtgctttgtaaactgtaaatataacataaatatgagtcctcttgattgcaatggacagacatgaattaagattaaagaagctctcatcagctggaaatacagacatgcaaccctttaattatggatgcccttcaacttacaatgtcccaaaaagcccatcctaagttgaaaatgcatttaacacacctaacctaccaaacattacagcttaacctaacctaccttaaatgtgctcagaacacttacattagtgtacagttgggcaaatcatccaaagcaaagcctattttataataaagtgttcgatatctcatgtaattgaatactgtactgaaagtgaaaaacaggaaggttgtatgggtactcaaagtatagtttctgctgaatgcatatggcttttgcgccattgtgaactcaaaaattgtaaattgggcagggcgtggtggcctgtaatcccagcactttgggaggctaaggtgggtggatcgcttgagtttgagaccagcctggacaacgtggcgaagccctgtctctacaaaaaatacaaaaacttagctaggagtagtggtgcgtgcttgtggtcccagctcctcaggaggctgagatagcaggatcacttgagccagagaggtggaggttgcaataagctaagattgtgccactgcactccagtctaggtaatagagtgagactctgtctccaaaaaataaataaataaataaaataagtaaaataatcgttaagttgaggaccatccatataaaaataaagatacctactggtattgataataactataactcaataactaatctgcttttatgtgctaagcactgttatcaagagttgtacatatgtaataattaatttaattttcacagaaccctgtttgacaggtaaaaatgttgagacatggagaggttacctaatgtcgcatagctagtaataatgcagctgagaaacaaaccaattcactttggctccaaaatctgtgctgttaaccactatagtatatatctctccatatgacagacaaaaattaaggaaattacaagttaatttctgtgtgtagtgagaaaacagagaaaggtggaatgaattaataaaattcagagtgtggcagtgaaaggcagtatttctgctttctagaaaatcattttattgtttagagcagacctacatacactcaattctatgactcagtactaagactggagtgctcatttcgttattctacaaatttgtaatgtgctggctttgtcactagatgttgctcttgcaatgcaatgattctgaatatctggacttgctcctgagaggcattgccttctccaggggtttgggaaagtaagaagtgtatcagttttcataatcaatcaaatgttttataatttctatgccatttgattcttaactagtgatttatcaaattatgatttttaaaaatttataatagttccataaataatctggttgcactctaagagaagttttttgttttgttttgtttcttttctgttactttctataaattatctgatagattctctaatagcaattttctaacatacagcattagctttggcagctcaaattgtttaagggaaccaatgctgggcatctgtaaaatccattttttgcttctgaatgttctgttctcctaaacttcaaaagttccataatgataaagtcatgttgacattatgccctattaatgtttctttatctccctttaatctttggattgtacagttttaataactcctccaactcattcaacagtacatcagctcaaggtaccacctatgcatgagatttacttatattaattagcttttattagatactagactctggaaatccgggagtcatagaagatgcacttaaatctaaatccgttatcttgtcccaaattcatcctgttgtcttatgaacaatgtgaacttcacatcagaaatcagaacacttcacttgactagcctaaaaaaaaagaaagaaagaagaaaagcaagaaagcaagaaagaaggaaagaaaagaatcagaacaaaccacaagatcttcacccatctcaaagttcatcttgggaaaaaaggttggaaagggtcagtttctgatacagttcaccacactccatttatcacaactgctcctgtcttgattattttttcttttttgtatctctccaagaaccctgaggctcttcctttggctccctatttatatgtacccccacctcatggggccacttcctgccatggccttaactatccctacttttgtaggaaacccctaaatctatagctcgaattcccatatctcagtcttcctgctcgatgtctccacccggatacaaatcagtacctttaagttcaacgtgtaccttaaaaactcagtgactaccttaaactcccccaacaggaggggaaactcctcatttccttatttctactcacggcttcactgttttctcagatatccattttttaaattgaaaattatatttctttatgaccccttatccaattaaatgtcaagttctgcaaaacctctgggctctcttcaagttgtctcattctgtccctttcttgacattacctattggttctcatcagaatgggtgcaatttctaactattctttccaggtctgtccccactccaatctatccctccacatccaaggcattttactttctaaaacacttttctgttggcccatctcactttccatctcactaaaaaccttccctggctcctttctctctcctctctctttttcttttcttttctcttttcttttcttttctttcattctttttttcttttctttttttctctttctttctttctctttctttctttttgagacaaagtgtcactcttattgcccaggctggagtgcaatagtgcgatcatggctcactgcaacctctgcctcctgggttcaagcaattctcctgcctcagcctcccaagtagctaggattacaggcatgtaccaccacacccagctaattttgtatttttttttagtagagacagggttcctccatgttgatcagactggtctcaaactcccaacctcaggtgatccgcctgcctcggcctcccaaagtgctgggattacaggcataagccaccacgcccagcctgggtgatttctttctatggagttaagtactgactctataatctttgtctggactgtccataatatgagcgtgggaggccttctatccttattctctacaaatgtctatagctaatatgctctgctccacccaaatagccatcaaacatcttaataagcgtgttcagtattttcccatttcagtacctttgttcctgccatttctcttcattggcagcatctaccatccctgactttttaaatccttcaaagttcctctgaaacactgctcactcaatcaagactttcctactttctctaacctgtaattgtcatgtttcctttggacttcatgaagtatacccattgtttttaattctcattctgtattaaaatgtctattacagtttttaaaatattttttgtttcccctactttgtttcagttttggagttcatggatattttgtatgatttgatatgtcaactatgcagcaagtcataaaataggaagcataggctgggtgtagtggtttacacctgtaactccagcacttgggaggccaaagtgggccgattgcttgagcccagggcttgagagcagcctgggcaacatggcaaaactctgcctctacagaaaaatacaaaaataaataaataaaatagctgcgtgtggtgttgtgtgcctgtagtcccagctactccagagtctgaggtgggaggattgcttgagcctggaggcagaagttgcggtgagctgagatcactccactacactccagcctgggtgacaaagctagaccctgtctcaaaacaaaacaaaataatgacaacaacagcaaaaatgaagcatagtgtttaaaagcacagatttttgaaaccaaacagtctaaattcttacacttggaatcagtctcagttcttctacttactaggtatgtgctagttaactgctctgtggatcgatgtcatttatataatagcaatattaagagtacctgacacacagccctgttacaataattaaatgagataatacatgtaaactgcttaccacaagacctggcagacaacagtagtgacacaaataatgcttactccttgtcagtattctttttattgtcactgtacagagtgggcacagaagacacttgccagattaaattgaagtttggaggtttctagctgaagaaaaaggtggaaataaaagtatcatattaaataagatgtcaagttaaaagcctatgacagaggagaggcccaaatggatgcatgtgttgttcgactctggagccccaggcctcgtgtggtgcctggtacagggcacatgattaataattattggttgcactaatgtagttaacaaagaaggtgccatatttgtgtgacaatgatgaggacagggaaggtaggccagacactgagggaagttcactgttactaatttctgtgctgctatgatgattcacactgtaatagcaaagtggcctgattttgtgactgtagctcaaaccaacatgtcttctagtaccttcaatagagagtttgctgaatgtgggtttaagtagatttctcaaagtatgtgccagagagacagtgtgcacttctgaaaacacatttttgactcttcctaaatacagatttacataacactaggtacagcttaatctgttctttgggacaaaatggagtgacaatggtatgattatggcaggttcagccatacactcctattaaaagcttttccttaggtactttaagaaaaagttatattacaaacaaaaagtaatgggattcccagacagaaatctgtgtttaaatggcattaaagctgtggttcgaatcaacaaaagccaggaaatccaaagttaacctttatccagactgttataccagtttttccaactgtgtgtgtccctgtgagcagccctccctttgaatttcctggctctggcaaccaaaatccacaagtcgctttgaattacagtactctggatctgttatttaatgggaatatatcctgaggatatatgcttacttgcaaatgcttttatgtgtagtcactgtaaattcaggagtcatgaatctagtactaattttttcctttcaagctcttggaataccctttcgtgccaaattgtgagtcctgtcttatatccaggtagaagaacttgtataacatttgtgttgttaacactgataaaatttaatattatagcttatatgtcacagttataattcaagtaaatttctaaaggttctttttttctcttttcaccagacacggcgatgacttgattgtaactccttttgcccaggtatgtattatgctggccctggcttgctttcactgtcgctggtttctaagtctgaacctggccatttgtcttcttttgtccttaaccgtttaaaacatttttcttctaggtccttgccagcttgcgaagtgtgagaaacaacttcactatactgacaaaccttcatggtacatctaacaagtaaggattgacttttttgtggagtttgaatccctaacataaaggcaaaaaatattgagcagcatttaaaaaaatacaactattacatggaaaattgtcctctaagctaagttaatatacacaataaaatttgaaaacaggatggagcaccatagtattttagaactcatacaacactataagtaacctagtctgggtcttattcgtctttgtacccataagactcagtaccaagtagaaattcacaaatgaaagaacaaaaggaagatttaattttcgttgacttttacatttactactttgaccagtaactgccataaattctattaaaattctttttgaataagttattaatgaattcagatattcaaacttaaaattaaatgtagcaaaaagttcaagttcaatttgcctaatttttgattgtctataaacaagttcatgcagtttaatgaataagagtgggattatcttctcctccaccttcaattaattatatgatcttggcatttaaattaatgttgctgatccttgatctccgtatctataaaatgaagggtttgaactttatattccttgcagtaacactttctccaaaatcatttcgaatctatgagcttaagctaagttctattcggttcactcttctgcatgttttaaaacagtatcacaaaggtcagagagtcatagaacccgtgatcctggaatgagaggactggaggaggcctttgagaccattgattctcttgtttagtagaaacctaagctctcaagaatccagtgacttgctaacaaccccctccccccgcataagttagagacacagcagggccaaaacctgtatctaatttttcagccagtgttcactacagagtatcctatatctccagtctttgtgaagttatttttcagtcctttactttgctttcacacacattttcatagaatagtttcattaaaagtgggagtaaaccctgctttgaatgtttgctttttctttcactgttttatgactaggctttcttgtgagatgactctgtatactctgatcaaacttccatgtgagtgatctttctcacatgttgtatgactgtgtcaccctccagcttgaggcatttcagtggtccagtgttatcattaagataaagtttaaatgctggtgcttggcactcaagacaaattaatttgattgatagttgcttgggtttatatgtagtgcaatgtatatgaaatctagaggcttgtctcagcctcttttgggtagaactccatttatttatttatttatgtatttacttatctatttatccatccaactagtatttatttagtacataccatccattcatacatggatatatgcatttaacaaataactactgggcacccccatcagtaccaggcactggtaatataatagtgaccagagcagacaagtcctctcctcttttagggcttacattctaatacaaaatgctgtaggatgcagtgtaaacaatcagaccaggtctctagccacatggaattatgttcaataatcatggtctgttgttctctgcatactctcttctctatcctaattatggacttactgttctttcttcctaaaatgtctgtttccacttgccagtgtctgcttggccaaatcctgattgtctatgtcccatctctagtatcaccttcactgagatgctttccctgacctcaccaaacctggctgagtggccctcatttggatccagagtactctgaaaaccttatcactatctttatggatctctgcccaccactagactgtgtgccctttaggagtaagaattgggtttagtttttcttgaattcccaagaatagcagaatgcctgacatacagtttgtgcttcataaaaattcatcacatatatgaacttctgaataaataattgttggaggaaagaccaccaattatttagaaaattatatttgcaggattgattccttctctatgtttttttctttgtagaatatggcctctggcttcatagcccatttctacccccttgaaaatgatgcacttgggcaagctaattactctctctatatctcagttttctaatgtgtaaaatagggttgttatgaggattaaatgaattgatatttgcaaagcacttaaaacagcatcttgcacaaagtaggtgctcaataaatgtgagctattataatggatcgttacatttctcttgctgaatccagaagtggtgtaacactttggggttttcatatctgttgtcagcttagatcaccataaatgatattcatggtattgaacaaataaaggtattgttacccccactctatggataaggaaacaaaacttagggagaataaatgacttgggcaagaacgtacagcttccagtgggcaacagagttttccttgaaacctgtaatcctgactgtcactgcagtgctcttttcatttgccaaacctgttaagtcttctgggttataggaagaagtccctggaaggctttggaacagaaagacatttaggaagaacttatggaatagatgaaggtcagaaagcctgaagacagagacagtagctaaaacaatattttcaggaattaaacatgagggtatagctctaaaccagaatgatggagatggcaatggggaggaagggattaatatggacacattttaaaggcttcttaagcatggctggactgagaaccactacattgcacagcactagggagaaggcggggtgggtggtggtgttctcattcttatttgttagcatgggtttgaaggttttttacctctgttagtagtatcagaacattcagcccaaccctgctgattaataagctgtgccaactgaaacaactttctcaataatcaggcctttccaaacccttgagggttttggtccttgtgaacttttaggaaccaagtaccccaagaccataattgccatagcacagctgaagcacagcccttcccacactctggctgaggactacccttcaaatcacggccccttgtgtcacccttggtccaaagcaagccatgcttatcacaaaaagcaggcctccagtggtaagatagttgtatctaatgatctttctcaaattcatacccatgtgtacagagttgatcctgttactgattgcaagtactaccttgtcaccaacaaaaattcaagagagggcacatttaccactagagcttcaccaaagggagttgagagtggtgcagtctagctcagactcagtcctgaataatggatttcagacatcagggagctgaaatcaatgaaatcaattagccatctctggagcagtctggcaggggcaggctggaaaactgagtgtccatttaatgcactccattttatttctagatagtgaataccttcaaacaactaaagaaaagccaagagaaggaactgaagacaataatgtttggcaggaatggatacaacatacagaaagcatacccccacccgaacacacacacagacacacacacaaacactcacacatatacacagagttatcttaacagctgaaactgtagaattcatggaactcagatattcctttctgatatacttgacttcagatccagggtgccactccctgccttgaatgtagcatttaagcaataattgtgtcctaggagtggttttcatgagacatctggttagtgtggtttattgtaggaaaaggaactcccacatagaactatacttctcataagtcaagatttcttttatcttttggctctttgctgtgcataaaagcagtccattgtctgcttgtgctttaccactcaaagggtggaaatctcaaagttcctgttgaggtggtttccttgcaccttcatgaaatatcccattgagggatgcttgattggacctgtatttcttggctgcaaattaaaacctacacttcctttgtcccaggagttaattttgaaaatatggctttcatttagagttgttaattcagataagcgttcttaaagcacttgctgactttaaacagactgctggagtaatcaggtgcgcaagtgagtgtgcccaccattcagcagtctgatagccaggggatggagctgggagcaaataggtgtcatttatcaatcgactctgtcatcaacatcatgaatgtcacctgtggctatcaggaaataatgtaacttctttgtattaacattcttccaaagcataatttaatgaacatgtatgtaatcttcaggaaagaactaataaccacttaatttttttagtgcatatctatccaaaatgtcttttattgctgtatgtactttggcatgtgaattaaattaactgaggatcataaaatgtttagcgttcagagctggaatgaacctagccaaatttcctcagatgaagtgaagcaacataggtaaaactcctcacacaggactcagtacgttgtaaatcaccagtaaatgttagttgctgcctgctcttctcaagtgaggaagaaactaggaggttccgtgaattgcccaagggctatacagtgggaaggtgccagagccaggattaggattcctgtcttcttagtcacagtccagttctgtctccactgtgctattcagggctggaaagtatgaactgctatggccatattatcttccctatttatatcaccatcttcagcaatcagccacgtaacttcttatgattcttccataagttacggactttggaaactgagcaaccaataccactttcctctggcattccttacaattttctgtctggcattctcatgccctacaagcaatcatgtggcttgcagaagtcatttattcattgaaaatgtattgagcctcttctttgcaccaggtctcatgaataattgacaaaccaaataaacatggtccctgcctttccaaagcttccacacagagatgcttatctgaattgacaactctaaataaagccatattttcaaaattaacttctgagacaaaagaatttgtatagtatgagtaatttccaagaagtcattgagagaattaggcactgtgatttgacacgctataaagaaagtagagatttctgacatttggggtctcctagttcagtttcttctttcacaaaagtcttctttggaactcaggaaaaggtgtaagataaaattattaaaatgcattattaatccagtgcgtatgtgttgagtacctccatcatagcaaatattatgccagatccctgtgttacagtggtgcacaatgttcaatcattgcttaaatttctcatagatgagttgaagagaaagacaggaaaatgggaaatacaatatagaatgagcaatgcagtggttcagtaagcacaggaaactacagaacacaggtgagggccactcacagagggaaggctcctctgaggaggtgatgcctgagcagagtcctaggacatatgaaagagctagccacataaagagaagaaaagtatccaactgagcaaaatgtgtgcaaaggcacagcaacaaaagagagtgctgtgttcgaggaacagcaagtggcatatagaaccaagactgtatgtgaaaaggaaaccagataaaatattcatatagagtatttggttctcaaatcactttcacatcagtgggttattcaatctacattctattaacattttggagttcctactatttgccaggcaatatggcgggacctgaagagtatgtaagcaaagagatcagaactggatcctgccatcaacaggtcacagattaccagtggagataatatgtgccaatatggactgtaacatgaagaaatgaccctaaaggtacaaataaagcaccatgagagattaaagagaccattcttggctaagaggatggcatcctttggagaaggtttgatgggtaacttaaccttaagttaaccttaacttaacctttgatgggtagattgtttggtgtggagacagcttccttgacaggggaatgaatggcctgaataatggcaggaaaggggcagcacatattcaaggaaaaagaagtgttcaagtttggccttggcaagtgtgagtcagctctgtccctcattcattcactcttctattcaataagtatttactgaatgcttgtcatatgaaggaccatcctgggtgccagggatcaagcggtaaacaagttgttccctgctcacataatgtttacatttaatcaaaggaactatgtattgaacactaactagacagagcctatttaagctataattttaaagtgctacaaaagagaagtacaggatgcatgagagcacagagccagtcagtggtctgagatgaaatgtcaggcaatgaggaattatgagagataagctgggaaaaggatgttggggctagagagcaaagactttgaatgccaggctaaggattttggaatttaatctcttaattttcctgaaaaacagccctcagtattagtgcaggtgttatcagcatatagtatagtggaaagagcatgcactttgggttcagaaagacttagctttgaattctggctgtgccaattataaatcatgtgtcagtatgtttcttaaactctctgagcttcagttttcttatccttaaaatggggtgataatactcccagtggaagctaagaaatacctagcacagcctagcagagaaaagcaatcactatatgataatttcccttctcttgtcacatgtgaaaatttcataccactgagagtttaaaagtaccctgcctaagatcacccagctagtaaattaatggtagatgtggaccctgtctatagactacggctactaggtatgggtacctacaagctagattgtccctaaaggaccagagattaattcagagcagtagaaaaacctagggaattaattctgtggccacaccagtaggaagactcttctttagcaacaacgatgcaggctgttctttgtcatttagaatttggcttcgttctcacgcttgcctgtgcaagagaatgcaaaaagaagtgaaaactacagattcccaggcctcatctcggatatactgaaatagactcttcagggttggaaaaagaaatttaatagctccccagatgagtcggctgcgtatccatgtttgagaaccactggactagagtctcactctcttgctcattgcaaatgtcctgttactccttagtggagcagagaatccttaatgccagtgtttctgaaaatgtggtcctcagaccagcagcatcagcaccacttgggaactttttataagggcaaacttttaagcccatcccaggcctactgaatcagcaactctgggggtagggcccagcagtgtgtctgaataagacttccaggtgattctgatgcaccctaaaatttgagagccccgctcaatagtattcctgagaagttttccagcagtgcatcaggaaacaggagagtctggtagaagttctgcaaaacatgagaagaagggtaagagcagtgaaattgaaaggttaggggcagagaaaggaaaagaaacaagaaaaaaggaggagccccagtactatgggaacatgggtttgcttgtttcatttaacccctgacatcagcaggcttgttatgatgtagaatgacgtcccagttcctccatgtaaattctgttccctaagtaaagcaagctggatgactgttcccagtggttgtgtgaccttggcaagtgacttcacctctctaggtctctgtctcctgaggtacaaaaattaggggcctgaagtgattgatcgccaagggttcctctggctataactttttacagcactgcccaaaggaattgagattcactctggcatttcgagtgatgcctgagcaagtgactctttttctcagggcttcttggaacagcaaaacttaaaacagggggctggtttgggacctggagtaaacaacttccttcctggagagtctgagcatcctgaggacttgcagagggaaattccaggccatctggatgtgagagaattgcagtcatctacccgggttacaggagcttgccttccggagatggcattatgtcactacatagttcattatgacctggaaaagtcctcagtaaccatgagggtggggtgtcgggggtggaatgggcagttttgatacacagactcagtccttcttttctctgtctccacaggaggtccccagctgctagtcagcctcctgtctccagagtcaacccacaaggtaggccatgtcataaggtctatctagatgtttcaagatagaataataaacatgcctcttattcagaactgttttttagaacaatagtgttgtttgcatattgtggctctcaaaagtatgtctcttggtgacttttttctaaggtacactggagcattacttcactctattaaaaccacattaaaagcagtactaaataatttgcccattgtatgtgcaggctttcagaatatgataaacatggggtaatgctgcctcttccccaaagaggagcaggagacagagttgtattgacagtgcagcttgacctcagcttgctggccccaataaactccaggagagctaacatcgaagacctaaggtgctccacgttcgcctgagggcccctgcggatatgttagtggtttccctcttaatgtcaactatagattccacttgaatctacatcctttccaggtgtgaaaccaaaggctctttccaggtcacgaatcatttcttttggagggcatccaactttgttcctcaacggtgttttgttttgttttgttttttgttttttaagaacctaacctctcatctttcaggacagtgcatccacttttcttggtgtgttgagagctgcagagaggaagggccaccttgaaggaacaccatggagttctgttggaactgaaattcttcttcacacaaaatgcaaccagttctatgatatttgttaaagtccaaataatgttttctcctaaatctgttccctactattgtagcagtagatttgagaaaaaccacaggagaaacaattaagatgaactcacactgagatcacctaatgcctgacacctaacgatgcctcacatgcttttctatttccagcagcgcttcatacttaaaatctttctctcttggttgttgtgttttctttctggtatcctgatcataagtataacggaagtattacaaaagcttagcttctaaaagaagggaacaaaagcagcagattctattggctcattggcttctgaagtatttgtggtgcatgctttttaaaatatttttataaaagaaagattgagaacgagaaaaaaaagtgaaagaaagatactaagtaaaggtgagtttactctagagcctcgtaatatgaaatataaagaagtaaacagtactctatggacttcaaaaacctggtgtgctgcatgtactatttcttttagaacttttataaaaagaaacaaaataggatgttttaacatataactcgtgttacatacttggagatcgaaggaggtagttttgaaactccaatcatttcatcatattggcctaccagtgaggcaatgttgctcacatttctgttagccaaatttacatcaatttgattatttagactatgttttctttttcttgtaataaatactgacaaacattaggagaatatgtacaatttatggttctataaattagctcattaaccaaagatgtggttggaaagatccttttgtgattattggcacagcaactacagcttgacaactagggattcttttgataaagtcttctcaaacaatggagcaaagaaatgacagtaccactcaggcaatttgtttccttctgtctctgtggcaaactacaaaaatcttggcttttcactgggaagagaatgtagtgataccaattactacgtaattacgggtttcaaaatctccttaacgtttagccacggttagaaaaggaaggaggagacacacatcccttgttttgttcttattatcagcttaaataagtcaggcagatttttcctgttattttaatatttatcagcatatgacaaagaggtgtgtttaaatagaaactttaaaggggaatgaaaaataactggctcagagcaaacagaattgagaactggagtgctgcttcaaaatatgatttttcatgatagtaagatcaggtttttatttctcagtactgaagttgaattcatgtatttcaattgaaatctaagataaaaggtacaagaaatctacatcaatttaaacagatttagcaacaacctagtttgctcagaaagcctgacttagataactgtattcttgtattggagcaattcagagagagagagagaaataccaaatcttaaaatgctttattattttgaacatataaatgagaaaaaatgcaatttattttaaaagctaattgtcagaaaccatggtaaattggtacatttacttttacaaattgattattaactgaaatattaaatggatacatcaaaggaaagctctccatttgaaatacccctcttcggccaggcatggtggctcatgcctgtaatcccaacactttgggaggccaaagcggacggatcacgaggtcaggagttcaagaccagcctgaccaatatggtgaaaccccatctctactaaaactacaaaaattagctgggtgtggtggcacgtgcctgttgtcccagctactcgggaggctgaggcaggagaatctcttgaacctgggaggcggaggttgcagtgagccgagatcgcaccactgaactcaagcccaggtgacagagcaagactccatctcaaaaaaaaaaaaaaaaaaaaaaaaagaaagaaaaagaaaataaagaaagaaataccagaaatacccttcttctcactatccagccaaggttcttatcagctctcatggctcaatgcaaatgtccttactttgcaaagacatcttatttttttttaagttggcataattgctccttttttgtgctatggcaacaatttaattctctgatatactttaattcaaggcttcttgtgtgtctctcccattggagataaagctcttgaagacagggactgtgccttatctatctttttattactcatggtgctttcgcatagttattttcacatagtaagaacacagtaagtgttgaattgaccgggaaaactacataaaatttggggactttatgtgaagtaaaatacatataaaataaacttttaataatgagccaatatttttatctctattgctatgaaaattattcaaattgtgttttttcactgttaacaattagttattgcactgaagttaatagaggtttgaagcacactctataactgcttatatatgttagtgtgttcgtataggttttgaacaaaaagagtgaaatctaagaagttggcatttagcactttgaataagaaagccagagtagagcaatggagaatttcaagcccagaaagaacaacgaggaagccatatgctcccaggttgaggagaaagacgcagtaaatcctcctaggggtgtcgaaaatgccaatgttgtagtttaatgagcatctgaatttgtttcacattttgcctttcacaagcataaattccaggctctccctacatggtgctcaaggattgaaacagaaaggaaaaaatagaaaaagaaagaaaactccaaaataaggcaggaactcgaattctgtcacctgtacatattcacaacagaaaattgaagtaattctcaggatttcaggtcccaaaactatttgcaacaggaaaatggggtgcatgcatacacatgtgtgtgtgataattgtcgccttttttccattccatcctatcctttgctcttcaatagtaatcacacatatgtcatgacagtaagaatttactgaaaagataaattatcaagtgttcgctgtctttacaaaatgatttttttgctttatagaaggattggagaagcatccttttaatggctagcacatccgagtcatgtaaatgtgacttgatgtaaaataatatgtatcatgtatacaatattttagcagccaatttgatacataaggtggggtgctctctactaaatttctttttctaaaatttatcagtaaatttactgagcaggaacattaccactggtaacagatcagatgttatgaaaaacaccacagaagtctatgggtcactggaaatgacagcaaaccatagcaccaagatgactagggaatcactttgaggacttcaagccagattgctgcagatactaatgatatcaaagcctggatatccatagccttgatttatggtgattttcaacaccagtcaattagaatgcatttcaagaaaagactgtgttcagagaaatcgtatgagacatttcttttaatatgtgtctaggccattctggggaggaattggctttttaccaactgataaaacagaagaagaggctttctccttggaaacctatttctccatacaggttctgcccatagctttacttgattatgactatccttccggaggttcatgtgggtgtaccagatgcagggtctcttcaagtagtggacaagagggtcagtgagttatcttcgattttaaggaattcagaaagtcatgacattgattccgttctcattctttgccagaactttcaggacctgtgatgagacagggtctatatgtgcatgggtaaagggctctctgagaaccacagcaatagcctgagagcagtgctgcatcagatgactggaaatgaggcccagcacaagcagaacctttgcttggtttctacattaagcaagaactgtcaggcaggattacaacacttacggacaaataggaataaaatcaatcttgtgaccaaaggctctgaccagtcatgataaaggaaagattagagggaattataagaaaaaagaaaaaggaaagaaaagagataaaaaagaatggaaaaagaaaaagtcagaaatatcaaactatgttttcttccttattctgaattctgtgtgctgaattaatggaataattgccttaattactcgccttcagcgtttagacagcctgcatataaaatgatagcaaaaatgcaccagaaaagccccagttattttgagaataattttccaaatggttgttttgtaataattgcttttgtctaaaatagccctcttatgaaagtttaccccagagcatcaacactgagctgtttatattgatttgcagttatttcatacatatctaaaattaagtattggtactcgcaaaaacattaatacctcagctaaagtgcaaacgttaaaatgtttcccttaagcagatattgtcaaatataacaccctgcttattatggttatttcactagttcaaaattaatttgcaaatttagcataaatatttcttctctttgaatgaaaccgaggaggcctcatctaagttctcactagctgcctgaacagttgagtccgttccgtgttgactccacttcacatttttgtactgctgagaaacaccatccacccaccctccccttgaaagttggaatcatgcatgttagtaagtatttcagttatgctattgacgtcaatggagtcattaaatagattgctggccctcccagaggcaaatcgctgccagggacctagatacagacacgttttttacaaagacaaccatcaggttttgctatagcagtaagccagagaaagggaaaagtttatactgtagcagacctatctccaaacacagtttctttctttcttttgcattttagttccggcctttctttctctttggttacagtaggctcaagcagatacccagatactgttgcctgaatgttttgtgtgcaaaagcatctcctgtaattgagaccatgaagggaggtaccccacttttaaaaatgagtctcacattttgctctacacagcctatcttgatgttgacttggttgcataaattatttaggcaaatcactattgtctgccagtaaggtcgtgtttgatatatagttccctgaataaacagtctcctccaaacacacacacacttttgtactttctgccatccctgcgtggcatgtcgctgcatcccctcatctatgaatcaacctttttgcagctagcactgtgctgtagcatcagggatctgcagcaaagggtggaggaggaagctgggaagaaagcttcacttctctcagctgcctcatctgcagcgctcccacaggaggctgtccacgtgcctgtgtcctcccaaaccctagctgctgcctgcctcgagcctggtcatgcagctcccaggcatggcaggcagagccctttaggaaacatgtgcctctttctgggcattcttgacagctctatttacctgcacagccccaggagtcagagccagagattcgcctcacacatctggactcttccacctccaggatcgaagttagggagacatcttgagcagacagatttcttcaaatctggttgtcagaaactatcccattggttttagaacccatttctctcttcagtcctgtaccttcactccctggagacccccaacccccattacttatcagtaagtttgtatataaatgccagacatctgactacctctggtaaccccttttggttcatctggagacccaaattcattcacctacacaactgtccctttttctgtctttctgactttgagtagcatcttcatcatccacccttttatctccctcttcacctaccacagccaactcctttagtctttttctctaatctttttccttttctcccccacttcctctgcctttgtttattgttccatcatcctgtacctaaagcattgtggtggtcctccaacttgttattattgtcctcattctttccccactctaaaccagcttccattctggtactagaattctttttttttttttttttttttttttggagggacggagtctcactctgtcatcaggctggagtgcaatggcgcacaatcttggctcactgcaacctcagcctcccgggttcaagcgattttcctgcctcagcctcccatgtaactgggactacaggaccccaccaccgtgcccagctaattttttgtatttttagtagagacagggtttcaccatgttggccaagatggtctcaatctcttgaccttgtgatccgcccacctcagcctcccaaagtagaactattcttataaaccccagttatggttacattattttcttctttagctatactttgccttcaagataagacctaaatgtctcaccaggcatgcaaaagcctttagaattttgctctctttctttgtcctcatctcccactttacgctgccacccccctgcacaactgatggctgaagtgcactgaatatacatccctgaaatacaccaggatcttcttgctttcctgctttcatatatgctgtttcttctacctggttgccttttctccaaaatatcatttacatattcagctcagggattatttttcacattgtcactgtgaacaaattctatatatcatctgattcttggattcaggattaaaataaatatatagtctcaattcagggcctgggccctgatatatactatgtgcataggaaatactacttcctttacccatttccttctggaaagtgcattttaacccttcatcttcttgatataccttctgcaactcacccaaaattactgttaattattatctcaaaatctctgttattacacttgtcatactgtattgtaattatttcattttttcccattctaaactaaaagcatcccaagttcaaatactaatcctctttttctatatcctcaatttataacataaagcccgggacatagcaaatgctcaataaatgtttatggactgaacaaatagggatgaaataatgcccatgcctgaaccagataagattagaaaggaagtgaggctcatgttcagctttgttaaggcttactgaaatatctgctagctctcaggacatgtgcatagtgctgacatcccttgctaatcttgacaacgtgtgactttcaaggcacttgaagtgaactctttgttatccatcacttcaggaagaagtggcagtgttaaaagaaatggaagaaaaacaactaaatgaatttttatcatactatattgttctcttagtgcctggcattgtgcttgccacaaagtaggcactcaagtagcatattgaatggaattggtttgagaacccagttaatccttcagagaagttacttctctgagactcacttttcttgtctgaaaaatgggcattttttttttttttgagatagagtttcactcttgttgcccaggctagagagcaatggtacaatctcagctcactgcaacctctgcctgccaggttcaagtgagtctcctgcctcagcctcccaagtagctgggattacaggtatgcgtcacaacacccagctaatttttttttttttatatatttttagtagagaaggagtttcaccatgttggtcaggctggtctcgaactcctgatctcaggtgatccaccctcctcggcctcccaaagtgctgggattacaggcatgagccactgcgcccagctgaaaatgggcattttaatattctatatgttaagattgttgtaagggctaaatgagaaaagctttatatagtgattaagagtgaagactctggagtcagactgcctctttcaaattccagccacaccactttgtgaccttgggacaaattgcttaacctctctgtgtcctaattgcctcgtctccaaaattaggatggaaattgtgtgttttggttgtaaggattaaatatgttaacatgtataaagcatgtagaaagtcccagtgttagtattggtgttattagtgttatataacatgactcagatagtactcagcacatagcaaaccaccaatgtgtggtagctaagatcccagccttctggtatcagtagagaaccacaacagaaagccctgttgagctctttctagaaggttctggtctactttgcttccataataataccatctgaagggagtaatttttgaagtttaagactttttttttcctcctgagactatagaaatcttgttatatagaaatagttttagagctgaaggtagagttctccagctcatacatgggaaagctgaaaagtcaggagggagaatggagctgacaccaaatataaagggacacccctaaatacagctttttctcttaaaagcagagtgcaaaaaaagattgtcaaattacttaggacttctggtaaaccaaatcttagttaactgaaagccctgtcttgcataagcctgacaggatgccactttatatgatagcatcattacagcttgtacagcacatcaaagttgtattgaaatacatgtttcagggttggtacacacctattcaggcataggtgttacaacccaggaagcttagcagggagtagcgctaggagctggtgcaaagcctccctttgcagagaggacaaaacccactagcagagtctgcaggaagggaagaggattggcccttttgggaaaaactttacaccctctccaattactgctgagaaggaaaaagcaacctcatacccatcttaacccattctcctctctttattggaagggagggagataaaaaaggaggttggagttagcctagagaagaatgaatatggaagtttgctaagagacaaggaaggaagaggaccaccgaagttcctttttctgcctcctgcttccccaagtgggtatgatcctgggggcagggtgaattctgcttgcttgcttctgatcaaccccgagccagcacattatgaagttgcctccagaactgttctcggaagccaggagcatttcagggaacagcctttcacccaagaggagggaaacaaagcagggactgtcccctcaaaatagagaacaggcaacagaactcactggatctttttcttggtttattgtcttgacttcctcccagtcagagctgttgacaagcaccaaaagcgaccccttggagttttctgtatttttcctaccccctgtctggctgtgtccacagagtaagctgggaccatggcgattatccagcttatttgaatcttacaggcagccaggtcagataatgctattttctctctgccccctcagttgtatttggggcttcaaatttctagggtctagtctggctagcactgctggtctaataaactagataatgtccaaagcccacatgtgtgcctctgatttcaggaaaggtaaggggctagtgcttattccatttctggtatgtgccaggcacagtgctagcccctttgaatatatcacgtcacctaattctccaaactaaacttctttgcgtatattattgcccctatttcacatatttggaaaaagaagattcaggaagtatgtggggctcactcaagaccacaaagttagtgatagaatcagaactgaaagctagatctgtatttcttgaaaacccatgctctttcctctgcagtctaaaccacactgtctctgcctccatcccactgtaaacctcagatgttatagcttatcaagaaggggatggggaaaatgtcatagcaagaaagcgaagtgactggactaccaacaaccttaataattattacatactagaggactttctttaatttctttctcatctatccattttattgtaagtagtaagcaaaggtgtaagtcttgagagaaatacatctcacacgtccattattcattcattaatgtatttaataaacgtgttaaattcatactgtatacaaggcactgtgttagccactgaggatgctgtgatgaagagaatgtattcagaccctgatctcatagatcttacggcccaggaaataatgcataaataaattcatgactatacacttgataattgtaatgaaggaaagtacagaatgctatgatattggctcactttttcacctgtaaaaatgggaataatactagtacttaccattagggttgcggcaatatctaaatgcgttattttacgtaaagcatttagaacacgcctggcacccagtagtatttagtgtttaactattatgatcattagttttatcactatttatcattatcatcattatcattagtctagtgttattattgttatcattctggggcctaaagtagattagaagataggaaagaactctataaataaatgactttaaactggagtcctgaacactgagtagctggggtagatcgaggggcggtggtcctgagagagtaaccaacacctcagagatgccacagccagagaactgggcactttgaacaacagtaagggacgcagccacagagactgagagatgccaggttaagcagaacatttgtaagtcatggtagacatgtagattttactgcaaattcagttgggagccattaaaagattttgagaaacagattgacgtgatctgatatgcattctatttattttattttattttattatttatttatttattttttgtttttgagacagagtcttgctctgttgtccaggctggagtgcagtggcacgatctcagctcaccacaacctccaccttgtgggttcaaccgattctcctgcctcagcctcccaagtagttgggactacaggtgtgcgccaccacgccaggctaatttttgtatttttagtagagatggggtttcactatgttagccaggctggtcttcaactcctaacctcgtgatctgcgtgcctcggcctcccaaagtgctgggattacaggcatgagccaccacgcccggccttatatgcattttaaatacacaacttctctttgagccccaagtctgggttagtgacatctcatacatgctcccagtacctgtattttctctgtaataatactcagctcctgccccttccatgtacctcctggttaagaagacaggctctgcagcaagactgcctgcacttagttctagttcaatacctttctttctctgtatgattgtagagaagtaattcaacatccctgggtcttgattttcttacatgtttaatggggataataatagaaccttctgcatagaattgttttaagagcaaaattaaaacacttagaacagtggctggcacacataaagcactaaataaatattagttgtttttaatatattgtaactgcctattttcttgactgtttatacactagactgtatgcttagttcctggcacaaggcaggtgttcaaaaatatttactgaaaaaagaatgaacaaggaaagagaggtagtgcaataaattgtaactaaaagaagagaaagattgctgtcctattcatgggaaaataggctttcttgaaactggggtatattctgataaggaggagcctgcttatggggccagagaaactgaatgactttgcagctgcccagctgctacagctttggggaacttgaaataacatccgtggaacaaaaatttgtttcagaatctgtgatgccaatctggactgccatctgcacaaaaagaaaactgggctcatgaaagagctttttcattctcttgggctatgtgactatctctctggaaagcaaatgcaaggctaaacctccggagttctccatttgctgcctttggaaggacagtctcaccaaaagagccagtcatcctactaagaacataacactatgacttccttttcatccctgcattgctaatagggcctcaaaggaacaagggctcagttctgtgaagtaaacacacacctttagtgtagtgaataaacactggaagaagcttttcacatatttgtaagctcggaagtcttttaggcattgagtagcagcagctcctttattgcttcatgcagctgcacggggtacctgcccggacaaacaatgaatccttcagctctctgaatgttccagttctgtgccgtgtgtgtgtgtgtatgtgtgtttgtgtgtgtgtgtggtgtgtgcatgcatacgtgcatgtgtgctggtttgttacttgtatatcccaggggaaaataagggttctttgcatgctttttgtcaacacaatgggtctctgttctcactgacctggttttcctttattccttccctctcatcacaagtttaggcagtctggctttcctcatccacagagcaaggccttcccctgatttacccctctctgcatgctcttcacacttccaaaccattttccatataggccccttaaatctaatttaaatacttccctctggaaagcctcaaatgatgagtcctgcctaattgctccctcctgtacatgtcctatgttgctttctaaaagcatcatagctctttatgtcatgggcataagttcttccttcattatttgtcaggtgtgtgtgcactccttaagctaaaattttatattatggcatctcactgagccaagaggaaggaggagtacttgtgtgaataagacctagactctgattgtgagtttaaaccgtttggaaataagaaataagatacattacttgaggccaggagttcaagaccagcctggccaacatagtgaaatcccgactctactaaaaatacaaaaaattagccagatgtggtggcacactcctgtaatcccagctgctcaggaggctgaggcaagagaatcgcttgaactcgggaagtggagattgcagtgagccaggattgcaccactgcactccagagcgagactctgtctcaaaaaaaaaaagtaagatacatcaagatagggactgtgtcagtcatggtcctctacagaaacagaatcagcagtaggacaatattcactttaagaatttggctcatgaaattatagtggttgacaagcttgaaatctatagagcagaaagtaaattcaggcagtaattaatgctgcagtcttcaggcacaatatgttcttttccaggaagccacagtttctgctcacaactgactgcacaaggcccaccaacatcatcgggggtaatctcctttactttaagtctattgattgtagatgttaaccacatctacaaaatacctttcacagccaacacctagatcaatattgattaaataacagggcactatagactagccaagtcagcacatacaactaattatcaaggacccatcaaccaacaaccccaaacacctgtctttggaattagactggaattatgcctagctcttctacaaacaagatgtataaaatccaggacaataaaaatttttgtattatttctgattgagtcttcacttcaaaacaaaataaaataatcattcatcctagctcacagaattgttttgaaaaccaaatgatagttcgaaagaccagaagcgcaagctattggtactttgaacaccttgacagtgcgcaagtagtggcagcacacctgttaaatattggtggccacacaaacacatcaccattctctctactgagcagacatgagagaagagaaaatcttgggcttttgctttacacgaatgccaatcaatttgtgcctagtatctggaacacacaactgattatcttaaactcaatggagggaaatatctttaaaagaagttaatttggaccagaaatatctcaggggaggtaggagtgaggttggagcattctttatgtacatttccacagagttgagtatgaaactttattccctgtaaaaacaaattggaaatttgaatgtgaatccaatttgccaggttatccttgagacgcccttccttctcacacctggatattaaaacttatctccatttccctgtgagtcttgtattcctgtcactaaaaattcctccagcctctttgcagagcacattggcaccaggcccccttctaaagccacaatgccgaagttctgattgcacctccgtattcctatgtttccggtaagtcttttaaagacatttggctcctgcctctggtcttgaatattttaggcctattgagtttagaatctagagaaaatagcagattaaatgtagctcaggaacaagagggtgttgtccagagaaagctgagagtgactggcacagcagacgtaaacatcgtcaccagggtgtacatagctttaactcaggtacctgcacgggcatcacaggcagcatggcacagatagttcacaggcctgggtatctatgcttatggactggccttccaagtgcagtttcctgctcactcttatttatcttctgataaagaattgctcccagcaaattactaaactaaacctactgctgatacttttactccagttgtaaaaacacattactccctctgcttctgcagaagtggaacatgcttctacaattcccttttctaaatttgttgatggattacttattgccccactcctcaagtttctgtggaggggattccatctaatctttaacagggaacagtttttgggaaatattaccttttctcccttctgtgctgcgagagcagagggcaaagacaagtaacagtgagtgggaattataggagaggtttttgcctcagtgagccttttaacccactagagatctggaagaaaatggagtgggtttctctgggaggtgatttgttctgcattcccttgctagaagatcacttgcctagacatatgtaggaagtttaacatgggttttcctcattcggaagaagggtggattcaatcacttctgagatttttcttgtgttaggagcatatatgatggaactgtgttttggtaaatcagtttcagttctacactgcccctaaagtattttgcttgttttcagaggtctgtccataaagcatttgtttcaaatacaaggcatgggggaggaggtgttatcacaatatcaaacccctgctaagtatcagattttctattaggtactctgcaaaggagatctgtttttatcctcaacaaccttctattaagtcaatatcattatcccattttttttaaccaataaaactatgcctccatgaatgtaactagtagtataaagacactcactcagcttgtaacagacagacctaggatcggaaccataaagacactcagctagtaagcagtagagttaggatgtgaacactgccttgtttggctcagaagcctgtgtacttggcatgagctctctgtgctgtccagtaagtaaaggtgcatgtgatgcccacacaggtacctgcgttgaaggtacgtacacccttgagatggtgtttacatctgtggttccaatcactctcagctgtctctgaacaataccaacttgttcttcagcaacatttaatctgtttttttttcctccagattctagaactagagagaatttagaagaaaatacatttcaagctttagttttccctcatgggaataactgagccaatagggaggtggcagtgtcttcctctcttctaggaataagtctccttccctgaaagacttttgggttttgagtaagccatcctggcagggaaaagaggcaggggagaatttttaggacgtaacagagctgtgggagacatatctccagtgcattactcactgcttaaaagacacccccagcctctgacatcacaaggagagagaattagatttcagatcagtagtgaaactgaggtgtgtcttgcttgaacacaaggaggcagccatccaactctaggctggctctggaaagtcccattttgaataatttgcttcttatgatgctttgttcagcttccctaccttaagtgaaactgtgtgacttaaatgaaagagcactgagctgaaactcaggaaacctaaatttcagtactggcaccaaccaggtgtgtaaccagaagtaaatcctttaacctttctagactcagtcatctttagtttaaattattttgagtctttgagtcttagaattcaatcttacttcagatttctataatggctcctggcccaaaaatagtggtgtgtgggtgttgacatggataattctttgtcacggaggaaacagcccctcagtaagaatctggaattcaagcctaggtctctttggtctaactccaaaacctaggcttcttccacctctcctaccctgacaagaggccatactattgtttcataacaaagtgtatctttattatttttataatccctgttagccttgtcattggcacagttcattagcaaacattcattgagtgcttatgagtgctgggaaaataaaaaggaaggggacatggtgcctgacctaagcttaaaagcattttcataaggagattctggagccacactgcctggatttagatcccagttctactatttttagactaatcatttcttaaactttctgcatacctcagttgcttcatcctcattttcttcatctttaaaattttcctcttagagttgttttaaggattaaatttgttgcttctgtaaaacatttaaaatagtgccaattatagaggaaagaccaaatacatcattgccgttattgttactattatatatatatgtgtatatatgtatatatatatgtatatatgtatgtcagtccccttgtgtcaggagtcttagaaggttgcaactgggtcttgtttgctggcacttaataaatgtttgttggatccaattattcaacacatatttacaatgtttctactatgcgcaaagccctctgatggatccttggtagaatccagaatttttacaactttttaaaaaattaccatgttttagagcttgcgtaagtataatttggaattttttttctctttcaatatttctcttctttctttttctgtggcccttgtatagaaagtattgaggaactgagaggaagatatctcacacatatgcttgctaacttaatcatatgagccatcctggaggaggtggggttaacaacacaccaaaaagaagattcttctctttcttaaatgataaatgtcttttagaactctgatgtcagacaagagagtactgcttacttttaatgggttttctgtgtcagagagagagaagggagagagagcgagagaaagagagagagagagattcattcaccactttctcattgactcattcattcaccctaaaagcacctggcgagtactcaccacaacatgaatcaggcattatgcctgggtaatgctggataatggagatacagaaatgaataaaacatggtttcttctttgggagagttaacagtcgtggggcagacaaacataacttgatttataacgcagtgtaataagaatttttcagaagcatgaataaagtgctctggaaggacacaggaaggcaggtagttgggagcaagatcctatcctaagtacaaataacactctgtactgagctgtacctaggaaatttataaattggattttattaaattttaaaaattagtatttcccatagctcggtcattcattatacgccaagtgttcagccatttcagctcaagttagcatattctttgagcacctattataaccaagtggattaggagactacatattaattctgaccatgactaggacaaggaaggtataagatatatgatttgaactctgccttaaagaatagatagtatttcataaggcaaagtgagaaatagtttttaagagggcagaccatgctcaaacaaatggaggccagccaggtgcagtggtgcatacctgtagttcgatctactcaggaggctgaggcaggaggattgcttgagcccaggagtttgaagctgtagtgcaccaagatcattgcagtgaataaccacttcactcctactgggcaacaaaacaagaccccatctcaaaaaaataaagtatgcagatgaaaaagtataggtttaattgcttagttattggaatgaaagtcaccctaggggattagtgaagaaaggatagggtgtagggatatgcaggacattagacaggaaagatggctgggcaaagtaaaaagggctttgcataccttccaagattttattttgtgtgcagcgaggagccactgatatttgttcatcagggaaatacattatcaaagcagtgcttcttgggatggttaatgtggttttggctacagtgacaggaagcagattcaggcttggaatcagaaaacataacagagattgatgaattgggattacttgtgtgatcttgagcaagttcataatcatttctgagctttagcctcctcatctatatagcaagcaagatgaaattacgacaagagcaacaatcacaacaacaatgtttattgatcattactctctgaatagcatggtggtagggcatttccttgtaatgtttaagcctcaaaacaactctgtgagttcttaaaaaggtaaacgtaaatttacccatatgacccaccaattccactcttagatatctacacaacacaaattgaagacgtatagtctttcaatatatgttccacaaagtcgaacacaaatgttattagcagcattatttatttgtttttaacttttgatttttaaaaatatatttagggggtacaagtgcaggcttcttacatgaatatattgcatagtgatgaagtctgtgggcctttattgtatccatcacccaaatagtgaacattgtacccattaagaaattttcaactctcacacccccttacccttccaccttttgtagtctccaacagccattatttcactctatatgtccatgtgtccactgtttaactcccacttataagtgaaaacatgcagtatttgattttctgtttctgagttaattcactgaggctagtggcctccagttccactcatgttgctgtgaaagataccatttcattatttttatggctgagtagtattccatggtatatatatcttagctgatcctgactcaagcagcagttgcccagacggattagaggagtgacaggaaccaagaaaagagctgtacaatgctgcaggcaggaagtaacaagagcttaccaaaggcactgtcaggaagaaagaaccaaaggtgttgacaatgaagccaaactagggtaaggctcctaattgtaccatattttaacttctctaaacaatcatttaggatgcttgattctatgaacaagagaagacaaagaatagaggacttcctttccttcagcaaacagctgacacactttcccatcataaacttcgtaattcaggatgtaaaaccagatccaacaaccaaacccagctagaaggttaaataaataagtgctaaataaataaacatgatttttcttttccttggcccatgagtctccatagaagatgccatgtgcttctggtaattgaagtctactagtcaattttcctttctttgtaaaattgggggaatggcctactcagggttataaactgaaactttgaggagttggaactttttgtatgttttgttttacattttctcgtcatgagccccatcattaatactaattatgaatcacaggtgagggagtgcacctaacatttcatcttttattttgaaatgctattaaaactcaaaaggcagaaacatagcctgtggccttggcagatgcaggactaggtgatttaatggggtttttcctgcattactttctatgactgatattttgtggtgcagatgtgactgccacattgtgaaacattattattaataaatccacattccccgaaacaaacaagacagcatggcaaacagtggtgtttgctctgtatacatttgggttggtttttcatcatttcctaggaccaaggccctgctgcttcccatcacattggtgaaaaatgtgagaattcacagtttgcctattttggcaacataaacatgggaaaacttgtggtcacagggtcaggactcttcgttctggagggcctggtagcaagtggatggggtcgtgagggagcttccttagggaggacaatattgaatctagaagttcacaagacttagcccatgtaataaagagaatattctgaataccctttaatattcagtctttcagtcactgtccccaaagagccaagaaaagctaatgtatgcccccccatggtaattaatgttcaagcttgaagaaacttgaagaaatcttaaacgtagcaacactaactgccaggtttgttagctgttataagaattcagccagtcacaacacattcaaaatgccattattagacactgactatgtgtgtagcagggttctaaattacagtcccagtcctcagagggattatagtgaatgcaggtggggataatatttaaatgtgacacatttacatattaactaacaattaaagtggatggtggttttcttctcagtgaagactttcagagctgtcctgcccccacaactggcgagtggagcctccatcttcgaatccaaacaattcgatctcactctattagagataatagaaaggtcatgagttttgacatcagaaactcacaagtcttaatcacacattgcctgtgtattaggtggattgtaaactccctgagggcaaagtctgtttaaacactgcgtatctcagaacccagcacagtgcccaacatttagtaggcactccacaaatatttgatgttgaacacataaaattagctgtaatcctagcaaagttaacttctgagtccagcgttcctcttggtgaaacaggaggaatcacacctgctttaaaggagctgagaggttgactagaacggagggtgaggaggaagactccagactttccttgcctgggcccaaattctggcctggcaatcattagctctgtgattttgagcaaataacttgtctttgcctctgtttcccacaccagcaaataaggacaataatatcgcctacgttttaggctaggcatagtggctcatggatttttggaggctgaggtgggaggatttcttgaggccaggagtttgagagcagcctgggcaacataacaagaccttatacctacaaaacaaaactttataaaagtagctgagcatggtggtgtgtacttgtaagtcctagctacttgggaggctgaggcaggaggatgacttgagtccaggagttggagatggcagtgagctatgattgtgccactgcactccagcctgggtgacagagtaagaccctgtctctaaaaaaacaaaacaaaaaactgtattagcccattattgcattgccgtaaagaaataccaaaggttaggtaatttataaagaaaagaggtttcgttgactcacagttctgtatgatggcctacaggaagcataataatgtcatctgcttggcttctggggatacctgaggaaacttaacagtcatggcagaaggtgaaggggaagcaggcatgacacacagccagagcaggggcaagagagagagggcaaggtgccacacttttaaatagccagatcttatgagaaatcactcactactgcaaacacaccaccaagggaatggtgctaaaccattgatgagaaaaccaaccacatgattcagtcactttcaaccaggccccacctccaacactgaggattacattccaacctgagagttaggtgggacatccaaaccatatcacaaacctactttttcagtttgttatgaggattaaatgaatatttgtatacttcttagactagggcctggtacatagtgtgttctatgaaaatagttttaaaatgccttatatagcctgctacaaatgacgctgaataaatgttaaagaacgtgaagtttgacccccatttcctaaactagcgcctggcttactataaatacacagaatggaatataattattaattgggtgttacaggttttctgaagctcaagctagaaatatgggtttgtgggctagaaatatggggaagagcttcatcaaggacaaggaacaaaattgtaccttagtggaattaaatggcagtgataaggagttcacagagaaggcatataatctgcaaaagctggaggaaagaaggatcaggtcacagtcacaagatgctccaccatcaacaggacttggcaccagtttctgggagaataatttgtcatgatccagctttttaagtgagcttgaccaaagctctgctttagttctgtggtttcaactgcacagattaatactttgatggctgcttgtttattcatttatttattgaggaagtatttatgtagattctactatgtgccagacattttgctaggcagtggtgaataaaatagaaatggaagactgggcaacatatacctgggtctacaaaacaataaaaataaaaataaaatagccaggggcagtgacacatgcctgtgatctcagcctctcaggaggctgaggcaggaggatcccttgagcccagtagttagaggctacaatgagccatgatggtgtctctgctttccaacctgagtgacagagcaagacctgtctcaagaaagaaaaaaagaaaagaaatggacttcctctcttttggaccaggagggagagacagactataaacaggaaaataaatagattttgataagtgcttcaaaggatattaaaagggcacggtattgctcagatggaaaaatgggaaaaggtctgtccaaggaggtgatatttctatggaatctagaaagataagaaggaaaaaggagactattccaggatgggaaacataatattcaaaggtcttgagaaaggtatatttgagaaagaaggccggtgtggctggaacagagtgagctaggagtgagtggtgaaaaatggggttggtggcatatagacagggccaggtctcgcaggatcttgtaggtggtggtaagctatttggattatattaaagcaaattgggcagccactgaaaaaaatggagaagagaaaatgttatatatatatatatatttttaaaaatgtaactcagatttcaatgtgtaataaattggattggaaagagaggatatgaggggaatgttgaagaagtctgagcaagaggtgatgcttgcctaatcaagaatggtagcaggaggaagtgagggaagtggaccgatgtgtaatatattctgtaggtgaaatagataagatgatgctgataaattagatggggagggactgaaagtagaaatagtaagggagagaaaagattcaagaatgaaatccaggcttctggcttgaaccactgagtgagtattaatgccaatgactaagttgaaaatgttaaaagagggaacattgaaaggtggattgaggaaaaactcaggagtttggttttagatgttaattttcagtgatctgatgtagccaagaagagatatcaacacagcagagaaaagattaggcagagagataagttttaagagttgcacagatctagaaggggtgaagggcagtgggacccagaaagcaggttgaggtgttggcctttgttaacagcagggacacctggtgaaagaagaagaagggaagatgtgggtgtaagtggaggtgataatcatcatcaccatagcttatatttattgatgtgtaccaggtaatgttctaagtaagtttcatttattaactcaatcctcttagtaaccttatgagtaggtttgtacgtacactgtatcaaaactgagagagtctcatctgatggtctacattgtggaaggggagtcaagagggacatttgaggagagaagctaggacacagttgggatagaaagtattcagtggaacttccaggcaagactgagagttcctctgagattttaaattatgaatataaagtgaatctaacccaaaatgcaaatggattttccacagcattcagcaatcagacttcagtggcctgacttaattggtgcttcatgtggaagcagggataatttccaatgccaggagtaataatcaagtacactattatcccttactagtatgctagcactttatgtactttcatgaagctgccttggggacttggccacaagaaaccttccacccaccaggctacccctcaatccctgctcagaagcagaaaccatggctccatgaaagaataatatctagagtgaactacaaccactcatcagaaggatgaagaaattgatggctgactttaagcctcaattctggaagaggtccaaactggatgctttgtcttctacctcacagctttccaggttcctctcagtgaccagggtacctcctctacctaagaaatcaccatcagctcttcccactgccaagagctcataaatgaagaagggatgcaaaatctttacttgacacagaaagctttaggttgacaacaaatagcaatagctaacatttactgagcatgtcttttatatcaggctgtgggctaagtgcttttatatgtagtatttcccttcatctttaaaacaaaccagtgagataggaatccttatgatctcatactacagataagaaaagtgagctttagggaggttaaataatttttctcagaccaagaagctaacaagcagagcagccaagagtggaatccaggcagtctgactctagatactaggctcttttaacaagtacagtataatggcaaatcagccaacatctctgctggatcaagctgttgtatatatccatttgttgtcacatgttgtcacctttctatagatgttacttagaaaacaaatggattttatttccaactatatttagaccggtttctactctcccatgttctcaaaatgagacactaattgtgggggaattatggaattaatagattttattatttccctcttttgaaagcaaacatcctgttacagagtcaagtttatggtttgttggttttttgcaagcctggtgacctatgttaagagaatttcccctgaagtcaaatgtgctgacacatgtgacagcataagctgcactccatgggctccaaggactggcaataatgacctgtttttttttcccaccatgtaattatgaattgagatttgacttttaaaacaaattcccagataattgaggtcaatatgaaaattttagtttcaatatccgagtatcttaactgtgtagattatttgtgagtatactgataataagctccttatgttgtcctacttttaggtggttgtagcctgtgaattgtttttttcataaatgagggatatatggatttgcatggagccattcacgcattctgcacataattagagccaaatggtactcattaagattgaacatgagatgttaatttccattagcgcctggggaatctgcatttttaaataaagccccagatgattcttgtataaatcgaagtttaagaaacattgaatagatgtgctctaattgtttgatttattttctcttcttttcctattaaggataagaaaaattaaatgacctttaacaggcttgactatcactacaatagtaataatagccaatagttggtgaatgtttatctttgctgaatagtgttttatatatctatttcatgtgtaacacattcttaggcagagattatcattagccccattttgaagataaaaaacaatgagatggagagagtctaagcaacccaagatctcatagctactgagtggcaaagcgagggtttagaattatacttttgcctttgaaggccaagtcattatctggagacagataacaatggatataaatcacagctttgctacttaccagcttgaaagatgagtttaataatactgactttgcatggttattgtaaaaatgacagaataatgcatataaagcaccaagtatatgcctgccaagtagtagatactcattaaatggtggctattaaatgtcagctggaaagttgaacaggtattccatgattttgatcactgtaatcagtgaacacacgtaatccaaatacctgcctacatatcgtacactgttcttattgttttaactctccaaattatttacataattatctctacctcctccttcccactatctctttagatatgatctgtgcctaagactccctaagacactaattctacatgatttgaaaagtaacataaatacttttattgtttttctatcctaaggaagtttgaatgaatttaagatattttccaatgactttagtacgaatgtttgcaaagggccagagctccctggaagtaagttgaaaaacaaacccagctgtaatagcctggtgacccagcagcccagacctgccattataacccatttggggattgcatggtaattgggtccatggcatttggcttagtggttctgattgtgacacatgatgattcaagtttattcatggacacactaaagcatcacaaaatgaccttttttgaggtccttgaggtcaggcggggagggagggagaagcactggggcactctaaacaaagcagctttgtttttacaccgcttgcttggacaagtgtctcctcacgtgcagcagtcatttgctgtggagctcttggcagagtaactaaaatgtgacagaaatgaagggcaaattctgaaatcccctggaaaatcaccctcccaagcaaatatttgccgtggtattgtagctcgatgacttattttttgtcattcactttttttggctcattcctttcctttatggccatttaaaaggtgggtaaactgaatatttattgagcatctactatgtgcattgcatgtaccgtactgagtttatggaagatagagtctgagctgaaatcatttaccatctctagaattcatcctccgtgtctgcaaaatggggatttgggcttcatcagtgattcccaagttagtttatagtttattaaaccatattcagcaagtgattcccaagttagttacatagtttattaaagcatattcaacattgcatcttctatttaaaacacacacacaaaatcttcagaaaaatctttagaaaccaagaaaataaactttaacaaaatcttctcagccaatagacatacaaaaagcatagaatctcaacaaaagggccacctgaatctgcataaaggctaggtatgtgattttgttgttgttgttctcaaccatataaaactggttgagaactccagatcagataatctctaagatttatctcaggttcaaaaagctctgtggccggacatggtggctcatgcctgtaatcccagcactttgggaggccaagctgggcaagtcccctgaaatcaggagttcctgaccagcctggccaacatggtgaaacctcatctctactaaaaatacaaaaattagccaggtgtggtggcaggtgcctgtaatcccagctactcaggaggctgaggcaggagaatcacttgaacccaggaggcggtggttgcagtgagccaagattgcaccattgcactccaccctgggtgacacagcaatactccgtctcaattaaaattaaaaaaaaaaatctgtgattttatttgggcttctctcaacaaagttggtgtttttgtagctcagagaagatatatctagcattagagaaggataaatcattatggcttaagagataatcagtcatttctaatatcaacttctgattgtttattcatggacatatgtatgtgctgacccacaaaacacaattttctaattgattctactgatattggccatcaaatctaattaatttagacccaaagtgaatttttttggttttctaaagtcagtcttcactatcttcgtagcccaaattagccaaataatttaggtaagaagtatttattctaccatttctatcaggtttctctctgatgcctgtgctttgcaaacaggtcagtaaaagagataaaagaaataagcaataaatcttaagtttttttcttgtctatctgtattttatctgtatttttttgttatattagctattttttttattaattcagtatgttccagcaaaagaggagaaaaaaacacacagtaaagggaaaatcaaagaggagagacacggttaagagactgactacattaaaagagaaaggggaggaatgaaatccaaaaagaattttcagggaaaatctctcagtaaaagaaaaaaagagaaagatattgcatagggtgtgtttcatgactcatgcctggctctgtacctgagtgattcatttggtggaaaacatagctggctcagagaacctttcacaggccccagactttgttgaaatcatttgaagcttcattttgtgtgtatattttcctcacttctttaaaactgaaatattaattgcttatgagaaataggccctgatcattggagtttatgtgtatggccacttgagatttagaagtagatcagggacttcgaagtaggggaagtgtttaagaacctgggacaggtttgttcctagtggcttttctttatctcccagcaggaataaatagtaggtccaagggaatcctgttggatagagttcaaaggggacaggcccttggtaggggcagactagattagtggctttcaaacttttttgatcatgactcacaataaaacatatattttacattaagactcagccccacatgtctgtgtgttttgtgaaataatacttacctttactatatatgctttacttgatattttctattctattatattttattccattctattctttttgttttgttttgttttttgttttctgacggagtctcactctgtcatgagtgcagtagtgcaatctcggctcacttcaacatccactgcccaggttcaaacaattctcctggctcagcctctcatgtagctacaactacaggtgcataccaccatgcctggctaatttttgtattttcagtagagacagggtttcaccatgttggccaggctggtcttgaactcttgacctgaagtgatcctcccatttcaaagtgctgggattacaggagtgagccgctgtgcccggctcccattcttttcttttgttgttttaaataaatgctggcaaagacctattaaaaatatttcacagctcagtagtagatttctatgtacaactttccagtttctgtcctctctgcagcaccctctaaacacacacattgttaaaatacagcacaatatagccaattttcaggaacatctctctggcactccatccttcacactaaaatacttgcaacttctcgaacaccatactgtctttcacttccttcacgtgtcgccctctctgctcagtgcacttgagtactttcccactccaattcccctttgttcatcaggctaatgcccgctggtttagacccaattcagaggtcaacgtctcttattagggctgtttgttttctgcactctcctgagcatccggggcttatctttatctcagccttatcatgctgtgttatgatgacccatttatatgtttttctttcccactagacttattggtggcaaaaactatgtcttatttgatatccacaggacctggcctaatgcttggcacatacctgattaataaattctggatgaatgagacctacatactggtaggcacgtgatagggagtgggctgacttcttggtaaactgtagtctgtttacgataaacaagaaagcatacttttatggagaatgctcagcttcttttagttgatgtgctgaccctcattgcaattctttttctgttgccaataggagataatgtagcaaagtagctatgaagtcagactgaggagctgcacagaactggatttgacttctggctcatcagttactagctttgtgaccttaggcatgttacttaattcttttaaatctcaggttcctcatttgcaaaataggaataataaccttctgtggctgtggttaggattgtgtgagtgttattaaataatggcatatgagctccatgaggtcaggatttttgtcacttcagttcattgtcatgaacttagaagagaggctggcgcatatttgttgaatcaatgaatattttgtacataatagaccatcaataattcatagcagctcttattcatgtgaatttttcaccaactcttacacgaaattttttggagtatgtatgatgtgcataataattctgtatcccttctttagtcagaagttagggacccacctgtgaggtgacccttccagagcctcaaattcagtgacacaagatgcatgtagaaacagttgcctttcgaaagaagttgttttcaggctagaaattaagtttaatcattccaaggctgtttgattctgtggaagttctacagttctgtttttgagtcatcgcccatcggcatttgactcttcgtgtctcttttcatacatctcttagccatatcaccatttgctgaatattagactcacacagattcagattcagagtctcgggggaaaatgattgcatttctaagtgttcttggaactgtttcacttgcttcctcgacagatatcttgtgtaaggtccataaggatagaaaatccattattacctaagaccctttactgtttcccatttcatgaatagatgtttgtatttcaggttttcacttgggtctttcccatgttcagtacttttataagtaacttattgtgctacaacgaaggtattgttttaggcttttttgaatttcatcagcatgcagacatccctacgtactatatttctacaaaaaacccacaaactttaaaaagtaattcccaaactcttaaagaagccaggccaaataaaaggatggcattgctttatttctatggcatattgaaacagtaagaatgaaaagagatcctcaagagagcggttttaccttgcttttactttctcatgcatttatccaaaaagtcctttttattatattattcattatatattattcattgcagctcactcctcagataattaacccacttctatgataataatgttactccattcataaggactctgccccttaaaggtgctacctctcaacactattgattggggattaagtttccaacacatgtgctttgggggacacattcaaagcaccagagggcctggtctaatgattaggagtaatcattagaatggtgtaattcatcatggtgtaggtagtaaagttaaatgatccaatttattagtccattattcattcattagtccattatggttgcttaccttacatatgactaggttggtgaacaaggttgtcctattacttatcctattatatgtaaaagtctgcccaaagctgttttaatcatttgtatgaatgtaggtaccatttcaaagtgcactccttatcataaactcttgagatacatactaagatgatataaaagagagtggcaaatcctatagcactgtgctaatttaataacttacaaagttcatcaatagaacaatatacttttgttctcatgctgactcttgttctcaagttgaagattactccaaagtcactatagtcatattatgctgtctggggctcttcattgaaattttgaaaataggaggaggagcatatccagtggtgaaagagaaaacattttggtaagtggaaatgggagaaaaggaagcttgcctgactacctaataggccttacttagttgcttcagtgatggggacctagtagaccacagaagggccaagctgtctggaaaagagaagggttgtcatttctggaacccctactatgtgccagatacttcatgggtcttttacatctttaagttgaacctatgggggattttattgcattcgttttaaagataagttaactgctgtccatttaaaaaagtaagtacagttgctttgcaagatcacacaacttttatggggcagggcctgggcttgagtccaagacttcaaagcttgtgttctttccactagccacctactctcagaatgctcctgttaaacccattatgtggcaagtcaggtatgtgttgcacttgacatcttttttagttttccacttgtacaaacattccctgaaaaattgtggagaggttccatacagtggaacttgagatttcatctactcagccttctaccctgaaaggttcctctgagctcatcactgtaacctgaaatgtctttcacatggatctgaaaacatttagtgaagtagaaagtactgtgctcatagtagtcattctgtggtacctttttttcctttttaaaaaaaggaaaaagtttagttgacaccaaatagttgtatatatttgtgggatacagagtgatatttttatatatgtatacactgcataatgatcaaatcagagtaattagcatattcatcaccttaaacatttatcatttctttgtgttgggaacattcaaaatcctctcttctagctttgaacgtatacaataaattgttattaactatatttaccccatagtgcaatagaaaactacaacttattcttcctatctagctctaattttgtattccttacccaaactctctgtcttcctcttcccactaatcttcctagcttctaataaccataattctactctctattatgagctcaatgttttttagcctccagatattagtgaaacttgcagtatttgtctttctgtacctgacttattttacttaatgtcctccaagctcatccatgttgctgcaaatgacagaatttcattccttttcatgagtgaatagcattccattattatatgccatatttcctttatccattcatttgctgatggacatttaggctaattccatatcttggctattgtcaatagtgctgcaataaacgtggggtgcagatatctctccaatacattgatttattttcccttggataaatacccagtagtgggatcactgtaatatggtaattctatttaagctttgttgcaaaacctccataccgttttccataatagctgtgctaacttactttcccatcaacagtttataagagtttgctttcctccacatccttgctggcttttgttattttttatctttctgataatggccaaaagcttttagcttttcctcactcattgtgacattagctgtgtgtttgcctgttttgtgttgaggtttgtaccttctatgcctaatgtgttgagagtttttatcattaagggaaattgaattttatcaaatgcttttttctgcctttatttgtaggactttttagtaacaaatttcattatagaatgtaaatattataaggaaaaaatatatgttataatatgaattaataatggcatgaatattaaaaccaaacaaaatgcatattggaaaaattggcactattgcacaaacacagacatctaggggaatgtctttctctctggtgttcgtgtttttaccttcttcagccatgtgaaaagactttcaaaggttctattttattctcagagttgacagactcacccttcaacagagtgggcatcaaaagccaatagctgccttgagtaaattaatttttgttgattttagttcccctttaagacttcctgagatactgatcatggaaatgaatattagcgatttaattctggcacctcgtcaggactcacactgcattcctgggtgcagcctggaacatcactgctggctggactcacttctccttgcccaccaagggacctgaaaaccacattaaggtggagaggagagtgtggcacctccttgctcagagatcggccagttcactgtactttattgactgtggactgttgatttatccagccttctcatttcacatgtgagggagggcgatttggagtgacttctgtgcacttacatagctgatgatagaggatggaccagaatccacatctccaactaccagtccagaattctttccattccccagtcactcacttattcatacattcatctaacatttattggatgcctacagtgtgtgtatagctgtgactacaaagatgaattggacgcagaccctgaactcaagatctttaccctggcttgtgtttttgatttcccagagggtctgaggtccattaggaaggtgactatctgccagggcagtctctccatgccggctggattaggcaatcactgctggccgtatgcagtcccgttttcagtgtccaagtctattcttcatagatggcctattctctgtttttctgactttcttactggggtttctcacccaaacatagcattactgataaataatatttaagtggctgagctctgaagattaagctattaatatcacaaacaggctccatattctctctagtaaagagcgaaaaagagtcagtatgtatgtgtgtgtgtgtttacacatatgcgcatgcggtgtggctctctgagacacttagaagaaaagttcctgcgtgctcatgaaaggcccatagtacagctatgagtatattccaggcctcacatggctgcagtattcaccagattaccaatattagagaagcagatttttttctatgggtaatttttaataatttaagggctctcatttctcattatttcagaaatccaacttggagcttctcatttgatcagcaagtattttccaagggcctcctgtattctcagccctgtaagaggtttgggccttggaggctgagtcagagatcatgatattcaaaccgttttcactttcattttgttgttgtcattttctctccatttgatcctgaggtaaaaaaggactagtaatattatctctatgtcacagaggaggaaccagaggcacagagaggcttaatgacttgccaggaccctcaaggctataagcaggaaagcaggggcgagaccaccaggcttcttaccgctaggacaatgcttttttttttttctaactatgccagattgccagtccatattttttttaattcaggaaggattagagaaaaaatattgcaagcatataaatgtaatctcatgatagaatagtaacaattacataaaaatactaaagttcattttaaatactacctaaactaggtcatgaattcatcctatagctttttctcccagcaggcataattgagttgctttcccaaatgccaggttattctacccatgcgagttataaagacctttttcttgaagggattactgctgaacttctcctaagtcatgactttgtgatgggagagatataagtaacatgttcgttgggcttttataactctagagaaagctcttcctaaatcttggagcttactgctcagccaacttattgactttgtttaggaggtggccattagcctctcaaaccacagaggtttggactgttcaactacagtaagcccagaagcaaagagagattagaacacagcatcactgggtgaaaatggggaaagctaaactgcttcgaaattgcagtgctctgtcctatactcatttctggaggaatcaagaagagcctgaagcagaagtgacccactggccttggagacaggaggcaatggaaaagcacagttcatccacaaaccagcctctctgagcatcagcttcctagctgcgtgacattcccaagactcttccctgcactaatttccacatttataaaaaagaaccacagatgtgtccttgatggtcatcttactgtcatctgttaccaccacatacgctgtcttgttatgtggcttgggaaaatctataaactggtcttttggctttgatcacctgattgatttactgtcagcagatgatattaaaattagctttcatttgttgagcaaatctggatgggcaattgaggtggaaacagggagtggcctgggtggtggctggaattagaatagtaatctcttgtgttttagaggttacaaagcactttcccacatgtagtctcattgaattactacaaagtcctgcaagggctggtattcttaacctcatcagacaaatgagaaattgatgttccgaaagataaagtgactggtcagcattcacaaaaagatttggtggcagtacaaaaagtggaataaaagcaaaagctcttgcttgctttctggtgcaacacatcagagattgattagaatctactataaggctttttggctatgctgagatgatcgacaattaattataaaacactgtcaacatagacactggtgctcttctctttctgggctttcatacctgctcttcttgaggtttccctccccaacctctatctgtgtgtaactccttcagtttatcacttggaaaccacttcctctaagaagacccaagaccttgctagatgcccatcctatgggtttccatggcatccaaatattacccacactctgttcataccactctaattcaattgcctgtgttggaatatagctccatttaggcactaagaatacttattcacgagtcattcatgagtggttattttttcaccattgtaaccacaacaccttgaacagtagaccctggataaacatttcttgagaaaatgttgcctgatctgctgtagccaagaggaagttttgcttccacattgccctcagggctgggagggaattagaatctcttcccctaccctcctgctttattaaggtataatggacaaataaaaattatatatatttatggtgtatagcatgatgtttatatatatatgtgtgtgtgtgtatatatatatatatatacacacacacagtgaaatgattaaatcaagcttgttaatataatctgtcacctcatagactttttgtttgtggtaagaacatttaagatctactctctcagcaattttcaagcatacaataccttattgttagctaaagtcaccgtgctgtgcaatagatttccatagcttattcctcctaacagaaactttgtaccctttgaccaatctttaaagccatccaagacagtaccatttccagaaggaggctcttaggaatccaaagaaaccaaactctagctatttgcataaaatgttagatcattcccagaagtaagccttagagttgagagagtactagaagtgtgacaaggatggaggttagcatttgtgtatccttatgggaaaacaggtaagagcggatatttttggagttactgggaaacttaaccatgacacttggcctgcttatgtgtctggtattattgctgggaaccaagcttcatgccaaacctctagctatcagatgtcagttttgggaagagacttgaacttgcttatgtggttatttataacagtagttttctattttgtgtcaggttagaagacaccatcacaccactgaaatatgttatcagaaccacatgcagatagaatatcgtaaatatggtagatgatgagcaagacctaggactcacaattcaggaagatacagaacccagcatttaacctagtacctacatgtacaaaatcctttcaggtatttaggagttaataagcatattaatataatcatcctacaaaatgaatttgtccaatcttgtcagtgaggtcatttctgcaaaattttaaagggcttgtagagtttgacaagagataaacattacaggcattgtgctgaattttcagcaaaagcagtcataggcaatataaaacaaaagagcacgactgggttctaataaaactttatttacaaaactaagaagtggaccaccatgtttgctacatcacggttttctgaccctggtaaaaatacacctatcaattcccatttttactctttcatttccttctggaaatctttcctatgttctccatcatccataagctaaagcctaaactccttaactctgctctgatctgaacagtccctcatatttagtggtccttttcctctctttgtgctcaagtcacatttttccatgcggataatgccattctcaatgctttctacttagtccaattctacccatcctttaaggtagatgtcttcaaatgacatagaggggtcatatcagaatcatctgggaagccttttgacaataaacacagtgctcctctcccacactaaattctcgtagacccagcgaggagaatggggaaagcagggacatacagggttggaaaatgtccctcgccttattcaagaaattctcaccttcttttaaaactactgctataggacattactaaaatccacttcctccaagaagctctccctgatcacataaacccatactcagcttttctttctgtggacctcctcagtcctcaatgctcacaaaattcattttaacacctagagtattatttggctatttaagcttttcctgtgccaggcactgttataggtactggtgtacagcagtgaacatgacagtgaatgcccttctctcagaagatgacactctaatgacttgaagagacagacaagtccatgtgcccaaaagagtgaaaagataatttcagacaatggaaacaagataatgggataaggagtgactggaaagcaaagcgtaagggatggttggagggataaggaagtgctgttttagataaagaggccaggaaaagcttaagaagtctgtaattgagcttaaaatcaaaatgcaaaaacccagaggaaaagaactgcaggcagagggaatagcacagttttatctttcccttctgtgaaaatcctattgaatatagaatgttggagaagcaagactcatagagatatgaaaaatagtcttcttatttagggttgttagataaaatatgggatgcctagttaaatttgaatttcagataaacaacaggtaatttttttagtagaaagactgattgtagtataataactgaaaaaaagtattatctgaaatttaaatttaactgggtgtctggtttgtttgtttgttttgggttaaacctgacaagcctacattttattcataggaaaaaggtggaccagggtgatttgtgtctaatatcctccagctcctttaaagctgtactgagacaaaatccgaatctaagcagaagcaatttaatttggtgttgctatttcagaagatcttatattgttttctgactgtctcattggatagtaatttgtcttcctggcaactccttaataacagattccctatgactttttaaaaatcatatactaagttcaatattaagtaattaatttattcttttatccttcatctatcacaagccagtaataatagtactttcctgaataaaaggtgacaggcctccattctcaagtatagtaggagaaattagcagacataactcatttaaaatcagcttggatcatgacaaagggccgcagcagaggcacccaatagactgcgtttctgagtagggagatccagcatgggaatcaaggaagcctgatgtaggccttgatcaatggcaagaatttcaataagggattatagaagacatcatccaggaaaaatagatcaaagacaatgtgctgaaaataacagaacttgtattggtaataagtccgtctctgtggttgaaacagagaatagctaaatgataagagcatgagatgttagacctgggttttcacaaaccctgtacaccaaattaagggattttatttgttgtctttatttgatacctttgaaaacttgtggacgtctaaatatttttgagctggcacttgatgtaaaaagggtcacaaatgaagaaaagcaatctgatgcggtgtaaaaacatggagaccagtaagagagtgactgcagaagtcctagttattcaaatgaagactcaactctaatttataataagacaaaaggaaagagggcactgaatgcaatagatatttttgagatagaaactccggagcctgccaactggtgggttgtagaagttgagagaaatggaggaattgaagataaagctgagattttaaatcaacgtgactgggagaaagacggtgccattcacaaaagtatggaaaacctagggagattggtagattgtaggtggagaagacttaatcatttttaaatattgcattatagaatgtatagctataaagagcatcatgataatgcccaatccctttgtttcatgtagaagaaaatccagtgggagtaagtaacttgcctgtgatcactcagtaagttagtgaaatagccagttctggaaatctgatgccctattttccctaaacagtgtttcattcataagatgggctgtcttatgatgagtttatagaagtagaataattgtgtggtgctgtgcagtgatcagttggaaatacagatgtggcacttttgtaaaagatcggggacaatgatttgggaggcatctaaatgaaaataacatttgaaggtgtgaaaacaaatgtggtagccgaaatagatgtagtgcatttaagtcaaatgtgacagatgacaatggggactaagaagaagtctccactgaatttcacatttagaaggccattgggatgagagagaaagagagggagagagagacagagacagagacagtgcagagtgaggagctggtgcagaagtggaaacaaaatttaaaattatttttctggaagctgacagtaaaatgagaaagatagaatatcattgaagcagggcctaaagaaaagctttcaggttgttgttggataggagaaaaataaatgcacatgtaggtagaagcaatgaaagccatggagagcaagagggtaaagatgtaaatcagtgaggatagtactgaaattggtgaggtcctgcaagaaactagaggagacagaggagcaggaaccaggaggacactgaagcagatggttaaaagcggagatagagaagcctccacagcacaaagtggtgaagtggatggaattcaaattgacctttatctcatcagtgaggtagaaagttgggttcttggttaaaagttagaggatagaagtgggaatgggaatttgtgaatagtggaaatgtcttgacataatgactgtggagaatcagtagagagatgtaaacccagattgagggccttgctgagggtaaagtagtgcatttgtggtagacctaatcaatctagtttctatgctgttcaactatggaagcagaagagaaaatatgaacaatgggagatttccaggaattttcaggtggtggtgagtaccggtttttttgttgttgctgttgttattgttgtttttaaattactgttgatggaattaatgttaggtaaagagtcaagcagactgggcaaatgtctgcttgccatttgctgaatgaaggagttaagtcgagggccaaggtcaggttctcaagggtgcttttgtgccaggctttagctgcatgttgcacacattatttttttatccttgtgataataggaaaaattagataaatcataaacttatgaggtaaccattactaccccaaatttacagatagagatcctgaaactaagattgagtgaactgtgtacaaaaagacccacaggagtaaatggcagaactttttcaaaccctgccttgccgttgcctccagtagccaggaaggaaatgcaaaattgggcagataaggtagctgaggtcagatgaggaatttcagaaatagagatggaacacttcctaatgataagctccaaagtgaagcagtggtgacagaggaagaatcaaaatgctggttatagatgtcaaggtgcaaggaattagagagttcatggatttttttccggaaacttattattgaagtatcatatgcagagagaaaagtgcacaaatcacaaatgtagaaatcagtgatttttaataaaatgaacatacctatgtaaccactacccagaccaaaagaacagataactgccaattccatagaaggcccctggaagtccctcctagtcactaaaccccaaaggtaattaccatcttgacatcttggcttaatatcaaagattagtgtttgtctctttggagctttgtattaatggaatcatactatttaatgtactttttaatatctgggcattttttgctccacatttgtacttatgagattcattcctgttgtttcatgctacagttgttccagtagatttaaccactaatataaccatgcaaatagttgccaccttttctaatgagaaaagagtcccattatgtgaggcccataaacaaaagattatgtatatttttatgcatttttattggatagaaagtgtgggcaacttgacagatacatttctgacatatacagagctatgctaacattgcatttagatatagttactaaaaaattataagaaagttctgcatgttctactctatagtactacaaacagccttgtaattagaaaaaagaaggttcaaaatttagtgcaatttacacatacattgtcgattcaggaaagaggctaggattcaatgaatgcactgacattttgaaacaaacaaacaaaaaatcctgtgtctttatgagtgtttggaacttcaggattcaccaaactattcttggttgtttggaaatgatgtacacttagtcctggaagaagatttaaggaaacaccacctgcctttcagtagtatgtttctgggaaggctctatgttaaccattctgcaatacaaatataaataactagatacactttaagacacaagacgtaatggtctaaaaaatgatgttccagagcagttggaaatgcagacaagtacatgattaatattgcaaatgggtttataaaatctccaagttgctcaacctcccttgagactcagtttcttcttctataaaatagagataatgctccatctagctccctgggcttctatgtgaatcagatgacgtggtatataagacagtactttccaaattgtaagacaagaatatggtatgattcttacttgcggtaaatccttttcagttgctcattgcaggtcaatgtgaagggggaatacccagatacgtagcaccacagattgcagcaaagtttagccaggtgatgaataagtttgcctttggaatcagacagtcttggatgggagtacaggctgtgccactcactagcggctgtgtaactggaggcaagttattaatctcctagagccataaatttcatttctagaatggagatcatagcatttgttagacttacctagaggaataggtaattgtaagaaatgcacccctcatggcaccttgtgctcagaattataccaataaatagtgtcggttaccataattctattatgataatagcaataataatagtatgatggcttcaagcagccacttagtgctgttgatgtacaaggcaaacattgacgtcctggggtagtacctgccaggctctcccactgttttgttacttcattatttaagggaatttttccaggctgatgatagcaggcttggaaccttggtagcttacatcctgtggcctctgggcacctacaaaattcaggtgtcaagggagcctcatgtgggagggcctctgatagaggaactactctcctcttctctgctcccagattctcaggtaagccctgtgcctttctgtaatttcttgatgagttttagaataatggaacatatgagcagaaagagacctctagacatcatttggtacaacacccacatttcatagcagaagaactagggctcatagaggctaaggggctttcttttagagtgagctggtgataaagccgggactataactcaaatctcccaatacccagttcagaacactttcttctcttccccgctgccctcaggaggtggcttcacctccactctctcaatgcaaatggaggattgttatctgctttagatttgggcttgaatcttattctccatggaatcccttggacaatgctttgcacataatagttactcagaaaaaaagtatctttaagtggaattcaatttctaggataccctcttctcatattcaatttttagagcagaaaccaaccttaaatatcatctttaaatgaccaagttcatttctctgtgctgcacatgtcctacttcctaggaacattctcctctagttgtcctgggcagtcaagccatctttccattgctcttccactgcccccactgtacagctacgtgctaatgcttatgtcaagatagcacaatatagtggctaagagtataagacctggagtcaagagagaatgaggttcctggctgacacttactagatctttaatgactctaaacctgttttcttatctgtaaaatggggaaggtaatgcctactttgtaaggtgttaaacactaatagtatgtaaaatctttagtatagtgcctagcccatattgagtgctcgataaatgtattaatattagattgcatcacaatgtatacattgatatgtctgtctcccctgttgaactgttatctttgggtacagaaccttgccttagttaattttgtatccatgggatcttgaacggtgttgtctggtgcagaataaatagtcaagatttttaggagagggagaaagagaaggaagggaagaagggaggaccagttatgcggtgcagctgagcgccaacctaaaaaattaaagacctgggttcaagcttcagcttttccatctactggctgtggagttctaggcagttactcaatgtctgtgaaacacattctctttatcagcaaaacaggtttgctaatactgacatcatagcattgctatgaggataatttgagacaatgtgagactgtttgcatattgaaatgtactttacagatttatacaaatcatcattgctatgagaagacatgccttcactgtctcccttattttaccagataatcagccactttgcagtgactccatctatggagcagaaagcaccccgttaggtgctgtgaggaggcctttgctttcaatatgtttactatgcagaagggaggttagaatccacaacctccactcacagccatggcaggtagcttgagagaacttctggctgggagcctttgacctccactgacctacctctccgagtgcccagcagcagcagtctctgaagtgacccctaatacggcatgcacatgccaggcctgctcaagttcatctttggaatgctgtgtcctttgtcaaatgtcaccagcatcattttctcatttccctcatgacacacattttaaagcagcaaagtgtattccccatgatgtaaatggtacagtggcagagagtggagacagagggtgccctaatgccagtggaagagaaagtcagggctgattcctgaccgccacttccccgctctgagcaccgcatatagggatctgctctgagacctttatctttaccttcatacagagcttctccttccttacgtataaatccccaaatgtataggtctgggaacctctagagaaacacggatatagagaaattcacctcagtgcctcttattcttcatcagggatctataaagctttttcaatagtaaaagcagctccttttaaacactccctgaaagcattacctgatttcctcacatctaaatccacatttctttaacctactcttttcatctaaatgagagctttaggtggatgttgagcctccattcttaattctggaggcttgggtttctccagaatgtttagaaggtttggctcacatgggtgttggtattagtttcctattactgcaataaatattacacaaacttagtggcttaaaacgacacaaaccaaggttttggcaaggctgcgtttctttctagagactctaagggaacatccattttcctgtctcttccagcttctagaggttgcatgcattccttggctcctggccccctttcattttcaaagggagcaatagctggtcagacctttctcaccttccgtcactgtgacactaaatcttctgcttccctcttcagcattaagaacactttcaattacattgggccccactggataagccagaataatctccttattttcatgttacctcactagcaaacttaactccatctgctaccttttgccatagaacagcacatgtttacaggttgcagggattaggatgcagacatctttaggagagtgatttcaggatctcaaaatttctctatagcaggatcaacaaactacagcccatgggccagccacatgtttttgcaaataaagtgttactggaacacagccatttgtttatttatgatctgtgatgaccttcgtgctaaaatggcagaattgtttgcaacagagaccatatggcccacaaatctaaaatatttattgtctggctcttttgaaaaagtttacctctgctctgtagcactttctgtgtctttggttctgactgtgactctttagaacatcactcacaaccttgtggatatctgcttcatgttttaattacaaccccaaccccactttttaaattctagcagtgttctgcctgcctctccagcagttcctcctctatcatcaattaccataaaattatttatcccttgtagtaactccaagcaccatagagtgttaagtctctttactttttccctctgcttaaaatgcacttaccttctttctctatctcttgccaggcaagctcctatttatcctttaaaaccgtgccaatgcataacttccaggaagccttctctaacatgcccatccaaggagaagtactctactctgaaattacttctagaattctagaatagaattacttctactctcaaaacagtcttgctggactgtaagtgcctcagtggcagtgactgagtgatttacccttcttgttgcccctgaaccttgctggagaaactggttctttctatttcgtggagggaatggctcttttcttgaagattcacttcccttctcctggcctcagtctcatcatgtgtgaaccaaagagttggattaaatacagtcagtctctaaggtcccttccagattcaataatcctttccatcccagaagatttggcctggttccttacagatgctgaggagaaatctcctgcattaagcttgcaccctgcagagttggaaatcatccaaaacatttatcactcatagctttgctttgactgtgtggcaactgggaactgaggaaatgggggtagagtgactggaagagaacaaggagttgctgagataatttgggggagatctcttgtaagtatttggccctgacctttcttcaggaaccaatgagaaggcagcacagtggcctggagagttgtaatccttcgcagcaatccatgcctggggctcctccacttgttatggatgcaccctaaatccttgcaaccacgtgggagtcaagacaaactcaatgtggtccaaattcacatgtctccccctcctcccctaactccctcacatgtatcagtgagggagtttctgctcttgtgtcccactctaaggctttgtgacaattttggacacaattgtcaccctttgtgatgattttggaaactcgtctctccagtcctccatatcccatcccttaaacatatactttttccttccaaacattgcttagaacttagctcttctctgttatcctattgctaccatctattctagcctacacaggtaatcctgacagtagaatcttccccaggttcccaactctagctacttcccattgagagccatcttacatcctcctgccagcttcatagttgcacattccctctcccctcatgcctcacccctattcaagaacctacaatagctccatgcattcctgcatcaaatccaaacttcttggtctcatttcgtaatctggctccactgttttttgtttttgttttgttttgttttgtttttttggagatggaatctcactcttttgcccagcctggagtacagtggcgtgatctcggctcactgcaacctctgtctcccaggttcaagcaattctcctacctcagtctactgagtagccgggattacaggaacccaccactatgcctggctaatttttgtatttttagtagagatggggtttcaccatattagccaggctggtttcgaactcctgatctcgggtgatctttccctctcagccttccaaagtgctgggattgcaggcttgagccaccgtgcccaacctccactgtgttttcatcactctattcagtgaaacctatcttgtctctgcttcacatttcattttggccgccatgccattccgcgtatggttaccgttgcctggcttgtaattcagcttaattcagtgcattttcacaaacacttatgaagtacctgctctgtccaaagcacaagcacacctttgctgctcccagtccttctctgatgatccaactgcagtccatggtttgcccttgctgttttcactttgtgtctatgcactcctcccctcctggagcacattccttgaggacaatgacaactgtgtctttcactctcgtacttactgggacctactgttaagtccaggctcccagaccacctttacccatacatcattctcttcccacttgttctgtcatctataaattaatgataacaaatctatctcacaaggttgttttgagtattagagatattttgttcagggttgactatcagttgatggttgcaatgattagcattatttttatatccatccccttagggtctttcagtttttgttgcacaagctcttaagcatttggagttagagaaagtaaaatgtgttttattactattaaacatagaagttatttctgttcctgagtcttgattggaaaattccacactcaaccccacgaattactgtaggttaatgcatctaatttcacctgttcataaggcaaatgtttatttattttattttttattttttggaggcagagtctcactctgtcacccaggctgagtctcactctgtcacccaggctggagtgcagtggcacgatcttggctcactacaacctccgcctcgtgggttcaagcgatgctcctgcctcagcctcctgagtagctgggattataggcacacgccaccacgccgggctaatttttgtatttttttttaatagagaccggatttcaccatgttggtcaggctggtctcgaattcctgacctcatgatctgcctgcctcggcctcacaaagtgaaggcaagtatttattaaatgcttgctgtttatcaagcactgttcagtccttaccattagcaacttcagtggccttcttttttttgaaggtgagtcattccctcttcctcatctcagacccagccctccctacctacgaggaagtgtagtatgggaactgtggaattcagagttttcactgagggcttggttctgagccttggccacgtaaacctcactcactctccaccctcctgtgttcttctgaggctgtgtctgctgggtaccagctagagccttctgtctgctggctacctagcctattcagtttcagaaaaataatttctaatccaaactacaactatttgaaatccagtcagagtgtagcagtaattcattcattcaataagttcaatcagtgagtaaattcaatttagtaaatgattgctaaattaaagcaatcacccagcaaggctgattcaacaatctcaaaatgtctgctgtatgtttctgcaacgaactttgtagtgtaatctcttcattaaaagattaatattcccttgtttactactatttcaaataatacaaattcacataattcaaggaaatcttccaaactagataacatgatattatatggtaaatgccagaagaaccagcaaaacaaaaaacaaaaacatcaaaccttcactaatgagaaaacaacctttaaaaattgccttaggcatctataatctagattatcccagttttaagactttgcagaatctgtgtctagttgttatatgtgtgaagctggcaacaagaggccaaaatatcagaagtgacatgcaaaacatttacagtcctgtctgtatgtgtgtgttcagggggagattgatttaagccaatattttctacctagcctgcacatttatgttggcaggatttcactggtaaatattggtctaaaccaaacactgaaatctttaatcacatttaaacagacattgcattatactgcattagacactgcattagaaaggaaccaacagggaaaaagtaagcacagctgatagctacaatctttcaagggtaaaaaggaaaaatcagaattcagtaagagtcttcagagggagaaatgccaagaaaaccatagctgaaatacaaaattttgtttttctaaagtctggagctgagttcagttaagtgacgtagtttacaaaccaggggaaattagggccggaacggaagtactgctaaattaggagaaattggccaaaggaaagtgagctagctgtgacatacacagtgttggcttctttctctcattctcaaacaattcttgtttgctactgtgtggagttgggttgccatgaaacctgaggcctaattttatatttcattggaagttctgaatctgtcacataaagcaactgtttgtctacccacagaggctgcaaaaatcataactgttaatctttcctaacacacacagaaaaccccaacccaaaaagagttgcttggctttctttgttcagtgtcttcattcacatccaggggttcttactgaatcatccagaaccccataaatcacctcaagagcctgtgagtctcctactaaagtgttccttcctccatccctcaccacctctgctgcaccaaaccctaccccgcacacttcagacacagccctagactgcttagatgcttactaagaaagtctttaggaggaagggctgttttatctctgaaatctatgcttatcccttcttaattaaactgtcaggccccacattttggtgtagatgataagatttgagagaagcagggatcttgttgggatgaatggtcagtcccactgaagggtgcctcaaagaaaaactgtttttttttttaaatttcttttctttattattatttttttaagtcaggcctagtgcagtgcctcacacctgtaatcccaatactgtgggaggccaaggtggcaggctcacttgagcccaggagttcgagaccggcctgagcaacacagcaagaccctcatctctacagaaaatttaaaaatcagccaggcatggcggtaagcacctgtagtcccagctactttggaggctgatgtaggaggatcacttggcctaggagttcgaggctgcagtgagccgtgatcacgccattgtgctccagcctgggtgacagagtgagatccagtctctaaaagaataaaataaaataaaataatttatcagctcttaggcaagattgaggaggtgggactcccaggaaaaaaaatgttgaaggactcattgtggttattgccaaacctggctgaggatggaaatcacctgaagcaattctaaaaagaacaaattcccagaactcagtctgccaagactgctttatacatctggggtttagcctgggaatcacccccaggagattcagatgcacctcttctatagactggtatagtgatgaatatcaactttgaattcaggctggattagaaaccacgatctaatatatacttagtgttgtaactttgggcagattatgtaacctctctgagcctcagtttactcatctataaaacagggataataactatttactgggggtgtggcaaagattaattaaatattatacatagtctctcacacactgcctgacttatggtgggtcaaaaataaagttaagccaatccaaatgtctccttgagactcacccaactgagatagcccctaaggcattcctgatcacactggaggcaaactgcctcagtctgaatccactaagtctgtgattctggaaagttactgaatattagcaaaaaatcattatttttattaccacctcttttaagacaagcaattatggtggaatgaatgctggcctttgagtgttcacgtcctggctatagacttatgacctagaatagtgcttcccaatagaaatataataaacactctacaggtaatttaaaattttctagtaaacacataaaaagaaacaggtgtaattaattttattaacatattttacttaatatatgcaaaatagttaacatgtaatcaaatatatgcatttattgagcaatttacatcattttttcatacaaagactttgaaattcagcatgtatgttacacttacagcacatctgaccagagactagccacagtttaagtactcagtagccacatgtgactagtagctaccatattgatagcacagtgtagacattccagattctaaagcaagtcatgtcaccttcatgagcctcaataatctcatttgtaaaaatggagataactttaatggctttgtttgcagaagaaaatcagtaaacttgaaagcgcatgtcaactggtaaagactgtatataacaggttttctgctctttacaacacttagactacaaaatacaatgcgattttcataaagtgatgtatccaaggtcgtgtgtgatctgagacatcactcaggatagcatcaggcagagacactctcctctaggcagatgaaagagattttagctagtagtgtttcaagaggttggaaatttcttagtcctcttctcctcctcacccagcaccttcactctcaacagcaaacacatttgcttctactcttcactgactcttgaaattccttcgaccattttcattctacaaataaagataaaattgagggataaataacccttgtgttccctctgataacatcttaatttgaggcctccttacttcttaagctcctatctttttctacaaatgatattctctgatgttaataatttaccaagtgcttattctctgcactcttataatttttataaaattctgctaccagagcaatagctcatcttcttaaagattgtattgtatatatcaagagcactgaacttggagtcagaaagcctagattcaagtttccaggttctacattttctagttatgggatttgaggtgaagcctgtagtgaccagaagacatgaaaattccctgagcttcatcaggcttttcctctataaaataaagacaataatacctctctcgaaaggtagatgaggattaaaagagataatgcataagaaagtggtctataactgcaaagaattagacaactataaaatggtatttagggatttataagccattttgtgcatgctattcttccattgagcagtttccaatggttccttcttgcctgccaaataaagtcagattccttaatctaacattaaaaacctctccaaaatttggccctgaccacactacttttggaagtttatcctactcaacccacttactcaaatcaaatgttctaaccaactagaactctcatatttgtcctacccaaacaacactgaatggtgtgacctatttctaatttggtatatttcttaatgctgtccattgccttacctcattttccaacctctcaaacttccacccattcttctttaccaggcctccaaatctctcatgatctcgttttccctcatgtccttgaactctatctctgcagcctctgaactttgcttgtgtctttcttatgacagctataaaaacccacgtgggattctagtaactcttggtgcacagagacttgcaacaagatgcctgaatgtgggtactcagtgagagttaaatatccaaatctgcaagtgattttgcagaagtgctattgagaggcaaaatgtttcccatataaaaactagccagcctagaaatctaatcaacacatgaatgcaaaagaaagatagagctgattagctgtggtaacactgaataaatcagtaaaaagaaggtgatttgtttggagactagcaaaaaaagaacaaaggacaagtattggacattgtgtctttgatactgttcagtagcaaaggcccctttctttttggtaatgcatagcccatctgttgatatgttgggcatgtctacatttcaactaatattttctgagcttctactaggtaatagatgcttgatgcacaaaaaactaaaaaaatagattctctaccctcaagaaggttagaatctaatagatgagaaaaaccaagagaaatatttgtaatgaaatatggtcatttggaaatagaggtttgcatatggtgttgtgagatcttagaggaaggaggcttaatccaacctcagaatatttagaaaactttgtagaggagatgacactaggctgcatcctaaaagataaggaagagctagccaggtgaacaaagttgggaaaggcattttaggcagatagaaatgcttgagcagaaacaactattatacaatctatctcagcaagggagctgagtatatcaggcttgaggaaaggagccatttaaaccatccaactagttctcctgctctgatttcatgcttaccaagccatcttatggttagaatttggcctcccacatagggaaacatgtgattaccagaagacataaaaagctttttataaattactgttctctattaattcattggactctgatttgccactgggctcttgtgagttgaactagtataaactgaatgaactcaaaatacactaacaaaattacatttctggacctgaaaggctgaagtgacttgaattttggtcatcaaccaaattccaccaccttagaggccatgtggttctaacttatgaatgtttcaaatccatttacctctcttcatctccattgctattacatggttgtagctatcatcatctccagcatagactgctgtaataaagaagtcataatgccatcttagtccattcttgcttctataacaaaatatctgagattaggtaattttcaaagaggagaaatttgtttctcacagttctggaagctgggaagtacaaaatcaaggcattggcaggttcagtgtctgaggagaactgcactctctgcttcaagatggccccttgtttatgtgaaggacctcttcaaggagaactacaaaccactgctcaaagaaataaaagaggacacaaacaaatggaagaacattctacgctcatggataggaagaatcaatatcgtgaacatggccatactgcccaaggtaatttatagattcagtgctattcccatcaagctaccactgactttcttcacagaattggaaaaaactactttaaagctcatatggaaccaaaaaagagcccgcatggccaagacaatcctaagccaaaagaacaaagctggaggcgttatgctacctgacttcaaactatactacaaggctacagtaaccaaaacaacatggtactggtaccagaacgcagatatagaccactggaacagaacagagtcctcagaaataacaccacatatctacaacctctgatctttgacaaacttgacaaaaacaagcaatggggtaatgattccctatttaataaacggtgctggaaaaactggctagccataagtagaaagctgaaactggatcccttccttataccgtatacaaaaattaactcaagatggattaaagacttaaatgtaagatctaacaccataaaaaccctagaagaaaacctaggcattcaggacataggcatgggcaaagacttcatgactaaaacaccaaaagcaatggcaacaaatgccaaaatagacaaatgggatctaattaaactaaagagcttctgcacagcaaaagaaactatcatcagagtgaacaggcaacctacagattgggagaaaatctttgcactctacccatctgacaaagggctaatatctggaatctacaaagaacttaaacaaatttacaagaaaaaaacaactccatcaaaaagtgggcaaaggatatgaacagacatttctcaaaagaagacattgatgcagccaacagacatgaataaatgctcatcatccctggtcatcagagaatgcaaatcaaaaccacaatgagataccatctcacgccagttagaatggtgatcattaaaaatcaggaaacaacacatgctggagaggatgtggagaaataggaacgcaaaaaattcctgtgttgaaaccagtaggtttcaacacaggaattttggggggacacatttagatcataacaaatgctaccagcaactaggatggataattaactaggttactaggtaatgttttatgtgttttggtatggtttacctcatttaatcttcataactatcccacaagatatgcttacccccattttagagatgaggaaattaaggcttagagaaattgagtaactcaaatggcaaagccagatatcaaactcgtgtatgtcttcctgtagatatggggctcttgaatactatttagctaacctcatatttctagtctctagatttcattcttgccttcaagttcattctccaaattgcagccagagggatctttttaaaatccaaatttggctgggccactcctttgaaagagctccaccaagttttccagttgcttccagaataaaatacaagatctttgcatggccttccatggctgtatataacttgatctagcttctcctatcagtctttccctgtctgcgttcctgagcatactctgatgttccccttgcctggaatactttcctctcccttgacacttaattcttattcctcaaaatctcataactttccaaggcaggccttccttcacatcccacttttcagattttgggtccctggttatccctattataaatgtttatagcattctacacttcttagtatctctgttccaagttgtactaagtttttgcataattatttttctattcctcttaggatataggcttcaagtaagcaaaacctaatattcagcactatacccttagagtttcatgatgtgcctacaacataataggcactcaaaaattttactcattaattatttatcgtatcatattcaataaataatagccaacattcatctggtacttgtaatgtaccatgcactgtcctaagcactttacatttatttatttgttaaccagatgctacagcccattaaaatagatactattattattctcattacacagatgaggaaactggggcacagagaagtaacatcttatgtaacaaagttttataacagtaagtggtggtactggaatatgaaccaaggcagtctaaccccagagaccaagcttttaatcactgctctatatccttcataaatattttgtcaatatatttactttgttagaaaaataattggacagcagcttgcctctatccctatcactttcttgtgtcattggtcttcaataccaatacaggtagataattaagttctttgaacatcccttcacattggtggtacatgttttagctggatgagaacagattctcgttagcatataaatgccaaaggcagagttctggagagcaggttttcctaagggtaaggacattaaaagagtgggaggtagaccaaaaggaaacagtgctatgaggctggcacatcaaagacatagttttgccttgactaagcctatctctgtaaaagaaagagaaacttagaccatttatttataacaggcccagtggtttagcaaaaaagttatggaatttagaatcaatatgtcaatcaatataattaaaatgtctccttcattctccctccttttcccatcttcccctctcaatctctctgtccttcttctttgcctccctccctcccagccgcatcatatcactttgagcaaattgttaaatgcatccaagcctcaattttctcacattcataatggaaaatgtatgtcataatgataataatttctctcttggggttatttttcaaggaaaaaaatgagatatgcaagtgaaagtgcttggtaaactgtcaagttatatatataagagccagttgtgattagaatttttgttttacttgtagtcttagaggaatttgctaaagagatcggcatcaaaatgacctacttttcactgttatttcccttaagggcagtgaacctcttcttttatgaatccacccagagtgaaatccctgtcatatgcaattgcaaagttccatatctataaagacatgctaacaaagttctgcctaaagaaaggctatatagggcttgcaaactttggtcttggaagaattgcattgcagtgtgtacatgttctcctgttcttatgatttgttccatagatactttacccaaggttaaaataacatgccctcttgaaatgttgcactctaacctgagtgtgcttcatttaccaaatattatatatttggacataataactcatgatgaagaaaaattatatctaactctaagggaaaaaatcacaaccaagattgccaaataaatagataaataggccagtagcctcaacctaacacctttgcataaagagatgccaattcctatatgtatgaaactattttacattttatcaagtacttattgcactatgggaaggaaccgaagaatggagtaagtatgctaacttaaaggcatgtagagccataggagcaacccaaacgtaagacatctacagggctagaagcttgtgaatgaagctaaaagtaaagctgaatgtaaataatccaattaatacacacttctcatttacaaagatcagaagattatgggaggaagctgagaaggcgcctagcttcacagacttactatttatacaaggaaaagggatttccaatataatcattcgctacaatggacaataccactcctgaagtgtattgttcattgctgtaatccagcacccacccagcagcaggcttggcacatagcagatgctcagtgtacttttgctgaatgaatgaacaaacaacttccctatacaattctccacatctgaaaggccactgacctggtatgtcagttagaattttgtgaaaaaacgatccatcaggtcagctctatattttagaagtggaaaccaacagtctctaacttaagacaaatgtcaagaatgcatttttctgaagtcctacagtgggaaggacgctttaggatttcatggccaaccttacaaatgcttcctttcccagggccaaatcaaaactctgtcaatgactcagctgtcaaatacatgtcaatatatcatcaggaaagtgacccaggaccagagaagtggtgggaaggaggggagaagttcctgacacgtgccggatgctgtaccaaaggcttggcgtatactgattcacttaattctcacacctagtttaaactatcttcctgttttacaggtgaggaaatggaagcacagtgggctacttttcttgtctaagggcacattgctattaaatggcacagttatgatttataaacagctggggcagactctactgtgttccactgaattttgagttagtagggcatcctggtctatgtcacattaaaaccaacatttgtcgttgttttttagctatgtgagatttactcaaactctgttgatacccattgttatagctaaacaaaaggaaaggaaatgttttttagaaattctgctcttgtttttttaaactgggcttcccctagatgggactatctgttgaaagcctacatggacaaccagaaagacagcaaagtgcacaaatcacaagtttagaaatcagtgagttcttataaagtgaacatacctatgtaaccagttcccagaccaagaaatagatcattgccaaccctatagaaagcccttcaagtccctcctggtcactaagcccacaaggtagccaatatcttgacttctattactatagattagtttttgcctctttggaactttatggaatttgacccatactattttttcatatacattttaatatttggtttcctttgttccacatttatgtttatgatattcattcctgttgctgcatgtggcaattggtccaattgttttagccactagaataactttgcaaatagttaccaccttctctaatagaaagggagtccaattatgtgaggcccataaaggttatgtacagctcttttctgtgtgctttctgtggatagaaagtgtgggtgacttgacagataagtttctgatatatagagatatgttggaatatcatttagatataatttataggaaatttatatttgggtaatattgtgatgctttcaattgctaatcatgtgtaattgagggcagagcattttttcctctcagcctcagttttctcaactgtattacaagccatgagacttaaggtttcaaagttaaatgatgccagatacataaagggcccctgtgcctacttttccaagagatcagtgtagtcataagattacacttccctgcacggattgcagggccagcttttagggcacctgaggtctttcaccagtggggccactgatttcataactgctaaaatgtgtccccatgttttctaactatgagcaactagctatttgtggccaggcagaggtttctaattaccctttcctgtcactcttctctggatctctccctcttcccaacaggactctgctaactcacacacccatttctactagattggcatttaaaaagctggggaagttggtctatgaacctaagtattagattaactgaaaaatcattgaaacagaaaaaaaataaaaagatcattgactgaaaataagaatgttgctcagcagtttgtacaatgtgatcctatttatgttatatacatatgtatgtttacacagacacacaaacacatacatgacatgcacaaaggagtcaacaatggtgatctctgactgctaaaaatgtgagattttttatcatttgaatttttggcttctctgcaattttctatttttctaaatgtgcctatatcccatctgtaacaataaatgagatatttgcaaaatatatttaatactaaaaggtttacagtccatttttgtgtttattctctgattctacctttcccatgagaataggatatttttcttatcctcattttagagataaataaatttagtcttcgagaacataggtaatttacccaaggtaacccactgaagcaagatgcaggacaagaaccataccaggtcttctgagtaaatattgcacagcttccctgtgcattaggtagatcagaaaagggaagtggagacttcagaaatgacaacatttaggaaagcagttatgcaattttaaatggaagagatccgagggtaagatgcaactttaaatgcagcattttcaggaataggtgcatctttcagtgctaaactgaatcctctgtttcatagaccaagatatagtcttgctaggaatctggagggaactatttgctctaataatttaatctctgatttcttagtttatgccttaaggtaaataagataatcatcctacttccgtatctatcacacaaagatgttgcaaagattaacgaatagtgtgctgggagctcctttgagaaaagagctatttgaataccatatatcattagcagattaatattataattatttactaaatttctcttcctgtttctcagagtcaaatgcaatacccagcaaacttatagaaggaagaaaatctttctgtgccactcttgttggagtgaaagagggaaagaagagagcaagagaagggaggttggttctccctacttcttccctctggaagtttttgaaagcgaagttcaactgcatgaccatacatggtcccatgacctactcttactgcctctgagatttgcttctgtggtgttaaacattgtttcttttcagggccatcttatgtaagacaggaagagacccagtttcatgggcatgtaacctgttgggttgcacagggccctatgctcagaagggctccatatttgccatcttaaaacttgtaataatactatctttgaacttgtgttttataaatgatgtctgatgggacaatggagtatgtgccagtggcttggagccttggctcatgcacttcctcacttcctgtcacctgcctgtctccctggacaagatcctaaccatcctctcctctgctcgctggtgccctaggaatcgtccagcttcctttttcccacctgcacttgtgaccattgctgccctccatccccaatcagggtataggcacagggagggtctgagttagccacatgtgctttgtagcctcagatgggacatgttagcagccgtctttgccctgggctggcatggctgtggtagacagaggccaggtcttgatggggatgaacctcttgtccacccctgtttcaggtacccagcatgtccctgctaagaggttgcagtacccttagcagtatgctaagatccaaggggttgtctgctgtggataggggcttggggaccatgagaagggagaaatacctaattcgacttccccagctcttgtgcctggtggggacacagcttgtcagtctggcggctatcaggaaggagtagccagctgctggtgagctatgtgcgtgcccttagtcataagaggcagggccttcaggttgctgtgagggtctgcactcacctcaaggtatcccagtgcctgaaataatacaatatttaaacacaccaaaccattaattgtgacaagtgtaccataataatgtaagacattaacaatggggaaattaggatgtgggatatgtgggaagcccctgtgttatctttgcaatttttccgtcagtctgaaagtattttaaaataaaaagtatatgaagaaaaaaccaccatgacaagttgaaagagagaatgcagaagaaaggaaaaaactttatattttagtatcttttatagcaattttactgctttttcaacaaggggccctgcactttcattttgtactgggcctttcaaattatgcagctgattcttactgtaaaatcccttattgaatgtgcaattcagctatctctctttcttttcttcctcacactcttttctacccttcaatgccaggccttaggatttctccaattgccattagtaattctcctatgcatctatcacctactaagaactggctaccatcctaggcacttcatatattttatcttatttaatccctttataactttatgagataaatattttatccttcttctacagatgtatgaaattgaggtctaggaccacacagtaagtggtagaagagaaagtcaatattcatgattctcactccaaatctggtgctttttttcacagtgctacagatggaccattcagccttcaggtgcccaggtatttgtaggatgcttaggcaatttggtttccattcctccaattatttactgagtatctcctaggtgctaaaactacaaagttatatcagggaggccagtcctgcgctgctctggtcattttctttgattgcattcataggtagcaggtgtttgatatccccctatttagtacactctaacctctgtgcccatggcttagttgccatgataggaagactataaagtggacacaaagtcttgactgtgaattaagaatttggaaagtgatactctagcctaactaacattgcttcaaaatgtattaatttttgcttaaacattttgatggctgatctgaagaagagaggacaatggagcaaggtctcttcatatccattacctgttcacccacatctcacgttgtaccaactctagaagtacctgagtgcttgttccatgcagtagacaatgaatgagctcactggtgtatctttgaagagtccttctcttttttgtacttctgcgggtataattactgtatgtatttccttggtcaagcttgaatagaaatcagatcccttttttcctctgcatgaaggagaaatgtgatgtatcatcttgcagtcattttgcatatcagtggattcaaaaggctaggagcaagctactttctccccaccgtcctggtgaatgtccaatattagttacagagaaccacaggttgtgatgtggaagacatgaaggtagtaaatccccagcagctgggaagtggttggactttttcctttattagaggcagggaatgagaatgggagggttctgtctcttcagaaaaggcttccttggaagaagtgctcttctggaagcaaacagaggaggcaaggggttgtttcggacacactagagagtaagtcagagaatcttcgtgttgaggcagcattgcaaaattgaagatgaagaaaggaaggaaggtatgtgtaagtctggcttgaaatgagttttattaaaaacacctcaattcttgtctgcacatttttgaagagtgtgaaaaaaaaatggaggaagttacctccagtggttttgtggctttttaagcatgacatacaggatattgaatttaacccctgtttatcttgaagtgtatgaatatttcggggataaacaaagcaactattctttgaaatatgcgtctgtggccaagtgattccagttacttggaatcacagttctgttgattctcttttctgcttcaagtatttgcacaccacagacataagattattcatataataatttttaaaaaccatgtggtcttgctagaatttctgtataaatgtataaaaatgtcttttaaatatggcaggaatgttatattagaactccatgtgagattttacattttattagtgcctattgtgtgtttgtatttcagaaatcttggtagagtttataaatgctatttctctcaaaaacagtcgtgtatataggagagtccaagtgctttttacaactctctgtagcttcattaattcatctagcatttataaagttatttcagtgcttattaagatagatttcttaagccagtaacctgaagtatttgtttagattcacaaacttttggatataaaatgacatgttaaggatatgtaaaaagaattttaattatctagcaaaaaaatgtgattttcacaacaatattttttgtgtgaaataccaacaatatttccagaaagtctagagtcttagggcaacaaattggagcccccagctttaatcaaaataaaaatctgcagagtgttcacatctggctccacctgaaagtccggttcagaatttccctgtgatcctggcacttgcagaagggaagttttagctttgtttagtataacaagagctgcaggactcccaggccaataaacgtgttcacgtaaaactccagacagcttcttttagactggagtcttatcagggagacctcattttccctctaattaaaggaaagatttaagggagagaaaggaatagcctatgcctcttacttgtgcgggtcagtgttcgctgaattagaagttattccaacatgaacacaatcctcaggatgaatgactgcctagactttgaacgtaatggtcaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaaggtaagagatgatctttttattcattaaagtgtgatcatgcagggagctccagctcccctcacccctgtctgcagcagagtgcaccagggaatgctaccaactctaagaatatgtttgttgctttgtctagaagattctcttccaaagtgtcacactctacttgtgtcttgatgctacagcaaaagtttaaaatcctcagtacgcttcaatttccagaaacaaaacttctctcttactgatgcagtttggaataggtttaaggtgagagatgtctgtctgtaaagcttccaaatcaatataacattgaaagtgctttaaaatttttttacaattatcaggaagctaaaatctgagttagtcttgttgcattgcaatcaggtgtcacatatttatttttaaacaagaaagtagtttaaccttcatatatcaatgggaaagaatggtctgtgttgaagtttgataaattccctctaaaaagaaggatatcctgggattttctaagatttcttttgcgatgctggcatgacctaagataaaaaagaaacaatatgctttgtctccaaaaccagaggttttctttaagtttgctgattttcatagtgaaatcatttgaaattgcttcatgcatactgcccccaaaatggttttatttacaatccccagacaaagcttaatgttgaagagccttaattatctatcattatatcatttgtttaattaacacctggacttagaatgctaatttatgtagtgagagttgttgctttttgtttgtatttttaccttggagaatattatattaaatacatattgctataaagttatacaaagttatatatgtgtgtgtacacacacacacacacatacactttgttaaaaagccttacaccataccctcataggtgcacatttcagagtcccagtcattctagcctgaagtatcatcttgttgtctacgtttctggggctgagaagatattttgctccacacctgccagcatgccctttccagccctgaggtgcaccagtgagtgtgtgtcccttctccagctttcctggggtaaaagtaccacctttggatcaaggcttgctggctgcggctcagaggatctgcgcagaggaagcagtgtgtcctcaggagatcctgaaggaggggaggggggactcttcctacttggaactctttgtttattggttaatgaaagggcaaaaataagtccctttctaaaattttagtttagagtttaagttggaaggaaaaaaaaaagaaaagaacacatttgaggattaactatttattgacttttctctgaagttctcaattgaaggttaaactcagggattttccaggctggggtaaaactcaaccaactgcttccccatgaggagggctttgctgtgtaacttctccaaatcacactgggactccatgtagaaggactttcacaaggcttgagcctactttggagcattagcagacactctgttccctgtattttgtggtaattgacggctatgcaagatgtagatccaacatttatggggtagtttttcaacagctttcaccatagagaacatggcaaacttcaatagtcaccaaaatatactaactagagtcaccaagataaagcaggcaattaactccaagaagagaaaaagagtaccccctgagaaactacaaattgccattaattttcattttgagtgtcaatatgctgtagtattctaatcccattcatgcctagagtgctggaattagacattgactgtcttgcaaatttattaaaaataatcttattcagcatagtagttagtaaggctctgagaccaggcactctgtagacacgggtgaggattccaatccctcaggcttccgctcctcctttatggtgttgtgtgcaggaagcaatgaaagttgaatagagctaaccctaacaaaagggctaaccttcaatgctgacacagttagcttaagtaaaaagcatgcagcctcagtcattttctagttctacagtggaaaggttgtcagggaaagcaattatttagtgcatgaatgatgcccaactgacagctaagattaatttttaaaaatatctctttttactttactacctttaaaaaattattgattattcagataattgtctcaggttaagcttgagcataacatgcaccatgacacatatgatataaggcaatgaggccagggagtggtggctcacgcctgtaatcccagcactttgggaggtcgaggcagcactttgggattgcttgagcccaggagttcgagataatgcaatgcaaacatttttgtggccaccagaaagaaattgatctacaccagttctttgggaactgaattatccatggcaaaaaaaaactatattccatattcagttttcaatgttgctgaaattatctgagatttccatccaagttgacatcttaaaactttatcatgatcatcactccctttactatgtagtcttatttggccatattttgcttacccttatcaactaaggagccagtgtaaatctctgagttgcagatctggaagtgatgtgaagaaatgttatagagggagtgtacttatcagtggtatccactacatttttgcaaaaactctgtgttcctagttctgtttcagctacgtggccactaagttttgtttgcaatgtctgatcttaagaacagcgataggtgaaattgtgttatgctgaggggtatttgggaattacataagtgcagtctacatgcaactggtagagagttaactgtgtttggtggaggaaaagcaagcatctttcatctttacttcgtctaggtagggttgtgcttttttagtttgtttgttttccttaatcctttaaattttgaagaaaactgagtgattcaaatctcctaaaagactttctcaaatgtacttcatagcctagagagttagctaagaaacatcgtcctctgtttggcccaaatttctctgatcccttaatgctggccacagtccagatggaattccagaattttagagaatggtgctgccaggtaggttagtcttgtaaattattttcctccaagaattactagaagatggaataagttcagcagaagttttacaaggcaatggtattgttatttaagatgaaaaggatggctagtgaacctcctgccagctgcccaaattcgattagacatgttagagctagccgttttgcttaacaacagattgccttcttagaattgctcattaattttgtgtttcaattttcatcacctcctgaattagaagaattgtcttacacttcagcaaaatgcatcagagcatgagttcctcagtggcaaaacagtcagatgttttgaaaacaggatgctttggctctccattataaaaagaggaacggaaagagaaacagtatagaaaggaagaaagcaaatagcctcagcagggtccccagcccaacaacggcataaacagtgacctatcttcctgaccttcactgtggctcagttcctgacctcgtgtcaccaaagccaaccaacgtcattagaggaggataggaggaatggcgcagctgctgtgagggtgactacaatttcctgtctccttcctgacagacgcagtcagtaaagtacagggttgcaacaacagtggctgaggaaggaccaacccagaacaatcccagggaggcgtaattgtgactggcggggaatggggaggtgttccttccctcattgtactgagaaacctagtctttcacctagaattttcaggtgaaaaacgtcaaaagggtcattcttacccagaatgctaaatgtttttcaaaagatgaacatactgtggtattcagaaaagctatattcaagcaactagtcactgtcttcacttcccccacaaacgccctccactgtccttttcattctccattggtttggctctggggctgttttatatgcagaacaaaggttgggtgctgctgggtgaaaatggatattctgttgttgaagagtggccctgtgtattagtactttttttttagaatgaagcattaggacttagcacttgagtaaatgtttgctaagatagaaatggaagatagatggtccttcttctcttaaggcattgtgaagtcggctacagataaccatcatgaggaagtgagtcctcctggctacgcaggcttatttttccagttcttcaggtgcagccatactacagtactaaacatggagcacaaaggcaactaattgccagtgctcttgggtttgcaggataaagtcacactattctaccaggccccgagccagctgggaattaggctgcatgacactggatggtgatcatgacaggctgattgccctaatgaggggtgaaccattttgtatttaactaaataatcaataactatggaaaatgccagctcctgcagaactgacaggaaatagatcttactggccaatggattcatcttagaactctgtaagagagagggtagacaggcgctcagtccttgaaaggaatattcatgccacttttgcctaaaatgtaatgatatgattacagcagtgccgcccttagcataagatgcatccatttgctgggccctgtgctgtaatcagagggccttagcctggccttccttctgctgccctccacccaaggaagtaaggagttggccgggccaagggagcagctttgctcccctctctaaactacattttgcatctgctggacccccacattctctgtccaaatggctttgaacccacttcccggccacacaagcctcttcctgggatgtgctgcaggcatacacacccttaggcctaaggagtttaaccaagaggcagcaatgagaggtgtgaagagacttgtgtaggaggaacttgggtaagcaggctgcggtccagggctcacgacggctgctcacaggtccctggagatggaaggacatggggaaagaagagggccaacccatatccaaggagttcaagaattctaaattcaacctgaccttccaggctgttatggagggatatctgtcaaggtaaaggagatagctcaatgtatatctttgtatatttagacttacagtgtgtggccccacacatgttagaggtgaccctggattagagggcagaatagaattaaaatcagttctggtagccaggtgggcactcacacatttttttggttcaacttttctctctttactgctcagatttatatagactaaattatggagggagcaaaataaagtgaaaagagcctaggaataagccatgagtttgagttctagccctgcctttacttaggtatagtaatatagacaataaaactatttggaatctttccatattctcttctataaaacaaaataattggaaaagacccagctcttcagtttattgattgaataatattagtaaacaacagaactacctttacaggtgtatgcaaacattgtgctaagctctttacctcattctgtaatcaatattcacagtaacactttgaaataggtactgttattattcctgctttacagatgagtaaagtgaggcatacaaagttgaaataacttgcttaaggtaaatcatagagccaggattcatatccagtccatctgacttaccatcaatgatcccaatgaggcatataaagaaagaaaaaagtttagagttatttaataattcttctaaggggattttggattggttggtgggtgatcttgttctttcaactgtggcaagcattagtgaggcctagttcaaatttatattctgtagctaccatactcacagcctctaggatggccattaattgccctaagctcagtcttcttgcctgggaagcagtgtaaggggaaagagcaatcgcaattatagaaaatggttataaagtgctcataaaaatgcaaataatagtattaaactaatccattgcctatttcagatcaatttgctcacttcactatctgtttcttaaaattctccaacatagcctaagataagatagtaaaggtctgttcaaagcactgtagactaaccccaaattccctttttccctgcttctcaaaataaaaagggaaatagagataagctattcttggccgggcgcggtggctcacgcctgtaatcccagcactttgggaggccgaggcgggcggatcacgaggtcaggatatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagagataagctattcttattttttaatttatatgatcattcaaatgatttgggcaatttcattatatgccacaacctttccaaggcatggaacatgaccataaaacagagaattaatgcttcagtaatatgtaagggaaatttttggaagtaacatgtccactgttttccttgggcattgtcttcaaataaagatgaaagagaagattaagctatttattctttgtcattgtttcagttactctttctatgacaaaatggagttgtattagtgagtattagtattagtgcaattcagtattccaagttctagtcttctcaaaacttagcaaatcaaagagtttgaaagttatttggtgctttgtagtaagtttgatttgtaatctgttttgttttattcaaatagttcttcattggttttaacagaaccatttctttactcaatggtaatccatttggcccaatctttctgcctaactcacttgaaagtcctcaagtgagcaagtctctaaaaaacaaacagaaatgaagaggacattgcctttgattgttttacctctggctacctgataagagagcataatagtctcaaaatctgataaataaatcattttaaggggagtatctttctccacattggggaaaaaataatagttatgtttagattgtcaaatgtaaatgtaaatgtagaacactagtcttcaaaaatagaattcaacccgttagcagaataaatgtttagtctccatttttttaatacttttttctcatcttttaaaaattgtttagtttttttttgtttgttttttttgttgtttttttttttagaatatgtccgagtctaaaaggctcctaggttgtatgccatggttgtctatgaaagaaaaaccaagggcgatggtgcttgcatttgcagtattcttccaaaacatttttcttctgagtaaaagtgtgctcaacaagtggagatagctcagacatctggaagccaggacttactaaacaagaagatgccagggcaaatttgtgccacagtcaataggtttcacactcttgaaggcatggtgccagttgtcaatatgctttcctgagcatcctttccctctagcatttttcagggacctaccagcacctctctgtcttgctcacttgtacgtgatgtttccctcaagtggtgccaaactgtttagtctcttgtgtatttcactgtaacttcctttgtttgattgactttaaagtagccaagtgcttccacaaagaaaggactgttaagttatttagaaacgaagaagacagtaaaactcctgtttcttttgtttctgctttgggaagtgcctgataattttttcttcttatggaatagattttaaagctataaatcttgccattctgttcaacagtcacttttttccttctgctaattaattgtaattttaaaatgtatcagttttgaaatctagagcccccaaagattgaagtttagtaaatttattaaaataaaatgtatcttcatggctcagtaactttcatcttctaatttttttagctactcaaaataattataattttttaattaactattaaatactttacatggctgccatcccctcactctttgctaacagcatagtgcataatgttttaactttaagcaattataaaaatgaaatttgaatacacatactgggaagtaaaaatgactaagccaatttttaaattttagatttaggacaagaggtgttggcatttgatatctaaaaagatagattttaagtagttgttttagaaagaaaatagtaaaaagaaaaattatcagtaaataaaaatagatttcaactcaattatataggctatgctaaagccaatcagacagggcacagtgaagtattaatttaccaactatctaatgtctttggtcactattgatgaaatttgataaatcaaaccaaaaaagatctaaacattttctttctagttatagttttacatgattacattagacaaagtcctagaactttaagcctagaagagagccttaagtattattttctatttctatttgaagtcattttatagatgagaaaaagaggtggcttttgccactaatgacaagtgaggattaaagtacctaatgtactccaaataactttgtaaaatatagagcacattctaaatgaaaagtaattttattatggcatgacttctccaaagtcttaaggtgtattagtgggattcaggtattaaagtataggtctgatcataaatctggcttactgttcatcttcagcaaaaggctagatatgtttgagaaagacatgggacattctctcttttgtttacattgacttttagacttctcattcttcatttacgtttcttgagtaaaaggtatacataagtgtcttaataatttcaagtaaagagaactaatttagtatgcctgaaaatttagtgatcaaaacatagcaagaactagttggagtgagttactttaaatgcccctggttttaatttcagaatttttaaaaaagccttaaatttttgaggcttttgattgttgtttgctttctcactcattccaatgtcaaagtttaggtagtaaaaataccctgtggttagtgtaactgcccttaacttctttctatttctttctttcctctctctgaaactgaagatgataaattggaaagttttaccacttggattgttaagccttgggttctctctgccactttgcagagctgttagcatggaaagttgaacgtgagatggtgattccagtttgaccctctccctacaccctagaatgtttctgcacaatgaaccagattatgtaaagctctcacagctcaaatataatttctagactcttgagtcatattaccaagatcctagtggagttaggtacaatggtgttggcagctgccttgtaaatagtttaaatcaaataagtctaattcacagcatatagagacacatttttatgtatttagccaacttaaaatcagtcttagtatgtgtagatccctaagttagctgatactgcaagtattttgccataaaatttggataaataataaactattaatgtaattatttaaatgtcgggaaaaatcaagggaaaatgactcgaggaattgagcatcttgggataatatttattaagggaaattattccagaagatccttgagagtctaacgttagctcttttttctccataatttctaatcattatttacatttcaaagtagaacaaagtaaaagaaaattccttagtatataatgtaagaaattaaaagaaaatttcgaattcttaagtgagtaagaaagcttagtgttttggttattggaataagatacagaaaacctgaattaaaaagctaaaaagtgactgggcgcagtggctcacgcctgtaatcccagcactttgggaagccaaggtgggcggattacttgatgtcaggagtttgagaccagcctggccaacatgatgaaatactgtctctaattaaaaaaaaaaaaaaaagaaaaaaaagaaaaaaaattagctgggcgtggtggcacacactgtaatcccagctactagagaggctgaggcaggagaatcacttgaaaccaggaggtagagggcagtgagctaagatcacatccactgaactccagcctgggcaacaagagtgaaactccatctcaaaaaaaaaaaaacaaaacaaagctaaaatgaggccaggccagtggctcacgcctgtaatcccaaaactctgggagccctaagagggcgaatcacttgaggccaggagttcaagatcagcctggccaacacggagaaaccctgtctctactaaaaatacaaaaaattagccggacgcagtggtgcatgcctgtagttccagctactggggtggctgaggcatgagaatcgcttgagccctggaggcagaggttgtagtgcaccaagatcgcactactgcacttctgcactccagcctgggtgctgggtgatgggagtgaaaccctgtcaaaaaacaacaacaaaaaaaaacaaaaaaaactaaaatggagattttattgagggaaaatccatttacaggctaggagaatcatttgtgtataaaaaggaaaggcacagattttttttaaaaaagagagactaaaattgttagtagctcctcttgattaaaacagtggacttccaacttcctctctaccctcaatgtcagaaaatctatggaaaatatggcttaagaatattatcatcacttgagaataaagaaacagagggatttaccctccatcttcatattccattgactagaaaacttccccttggctcaaacatgtcatcagatcagaccctgtgctatgattctgctcctaggacgccaaactgtggggctttttttgaaaccctcccttagctattctaacttccataacattttcaaaggccatcctcttacctatcttatcaattaataccatagctaacattttagttatctgggattttatttatgtctgctcagattgcaagtttgaatgtttgagactccactttccttgcaggattcgggctaatacatgccaaggaggcatagatttctttctgtttaattgtaagggtggaagtgaaaagcaaagaaagtttttgtcagttggtggtagttgatttttggtttattttaaaaagctgtctgcagttttcttgatcatttaagaaatttgttgacatggcacttttaatagattatcctgcttttaaagaatgctggcatgggtaatgacctcactggtgggcacagaacaataataaagatagaatttttttttttgtattttcagaaatttaaagttatgaaacatttttagactatccagtggcaatgtgcatttccagtatacttttgtatgatggtgagaagctagggaccttctaatgggtcactaatgaaatggactccaactcccactctggatctctcactcataatccacaaggattaatttaacctgccagatgctacccatttagcaagctgaaaggacacagtgccccccaatgcctgtagccttgtctgctgttattgctattgctggctccattctataagtgagtcagatgatttagatacatatatgtttactaatgcaatgggtagtttttcttggccaggctcagtatattatttgtgttcttgtcagggagagctaccagtgaattttttcctgctgtattttaacactcaggaactggttgtgcaaagtttatttgcatctttcttgtgcattgcatgggagtgtccttgagaatatcttgtaaacatttgctagtattgttttttaaatatttaaaaatcagtatcatttaatttcagagaatttgcttcaacttactggaattaattaaaaatgcttttgtatttatattttttcttttacatatttaaagtattaagataaagtcattgtctaatgctgtctgccatagtaaaatttgcaaactgagaaaggtcacatactgcttttcaagactctttagggcctttaatacagtgctaaaatagaagaactttgtcaaaaataaacaaaagtatgaactccttggtaggagtagattctctttgttttaaaaaagttaaatacattgggttaaaatgagcaaaatatgagctccttttcgtaaagttaataaaggaggaatagagattaggaaaaattcagaaatttccaatcactgcttttcaaatctaatcacatgatccaggacttcatttcccagaaaactctgcatctgcccgagggaacattagttatgagacagtgcagagatttctaaggcccatttcttcacttaaagtttatgtgctctcaaagcttcctgtggtaccaggatagagcattaaatagcgttattctctttgagttatagctgttttttatttttgtgttgttagatccaatgtagcatggtaataaaacatatttgaagcatcccttcctgcatacacagcgctcttacctgtgttctcgtatgacactcaccctgaggaaggtcttattgtatccccattttcagatatgaaactgagattcgggaaagataaccgatttgtccaagtcctttacctactaaatgtcaagacatagaatcaaatcttgttctctttgctcaaaagttgagcaaagttgttctctttgctcaaaagttgagttaaaaataaaagttaaagggaaatccacaatttattatattctcgtataacttgttaacaaaacatatcatcacagaattttaaagctagaaatcagcgaagtcttgtttttcagacctcagtttagatatcacctcttagaaagaccttcttttattaccctaattcagctgcttgttggttttgcaatttactatcacaatttatggtttttggttttgatcatggaacttggtttttactgatatctttcattagactgtaaagttactgaagacatgaattgtgtctaccatgttcactagtgaagccccagcagttacactagctgtagacacatggtaggcattagaataaatattttttgatcaattgcatgaggttcagaaacttaatctaatttgtccaagaccaagtatttgttagtgataaatccattagaaccctggaatcctgtttcctgttgtgcggcaatggctacatgtaggggcctgccatgcctaattccagctttctaattgttaggttgcatgagaaaccctcatctggttcccaatgacccccaaagtaccctgaaaaaagggaaagcttattcctacccttctctttcatccagagtcagataacaaagaacaaagttgtcagggaccagtgctttcttcctgtgagcagaaatgtgaagcatggttttggttggggtttttgtttgttcggttggcttttggttcagttttgcaatatttggcttactattctctcaaaaagtctgcatcctgtggacaagaatctaagccctttggagactagcaatggctattccacactctctggggagcctatttatgagcacatgtgtttgtaattcagccactctccatatctgttggagaatagcagcctaattatctgccatcatttggttatgtttttcattcctggcatattggtgacactcctctcacctgagccacatattcaattaattcatatgtgttaccacattgatcttaactgtgaaaatctgagcaaaatgcatacttggtgcagttatcctcatgtcaggtagtctgtggtcagtcacagcttttagtcaatagataaaaagttgtaaagtgtcttaatttgagaaaattggctaaaccaaagaagcatgaatggatagttaccaacagctggatttctccaaatagactctttttttacggtttaacttaagcataagaccattttgagttatggtgcttttcatttgacttgcttcatctatctttctggcaattcttgtttacgctccttagactggtgaataatctaaatgtcaaccagagagtctgaacttctatgagtaactcatgtgtcacataatctatgtgacatagtagtgcatcacacctgcagcagcatgctatgggaattctgtaattaattatatatgctgctgtcaacaatgaaaagaaggtgttcaagtatcaaagaaccaactgaaacttccacccaaaagcaaagccaaagtgagaaaggtaccatgagctcagattattttgaaatttacagataaaacctagcttcaagtacaaatcctgtggaagaaagagcacacacttggtctcagacaccttggcagccacttcacatatgttattcctaatcttcccatttcaaagatagaaaattctagtctctaagagactcaatgacttgctaagtttctcagactaagttacagtacatattttatttccagactcagttgaattctcagatgctcctatgtcatattttatttccggactcagttgaatcctcagatgctcctatatcatgctgttatgacgttgggttagctgaggtcactggtaaggcaaacctgcaaccagcactccctctacttcatgtttgcagtagaagctgcctctataaaccttccgtgaacctaacaaacctatgcatcttgaggtgcattgttgttcaaagcatctctccatctcttctaaattatgatagctaataatggaaaacacaaaatacataacaagcccaactaccttttttaataggataaaattgcataagaaatagctgtctatgaaatttatgtctattttatgttatgaaactattttcatcttttatagttttagttaatagtttatgtgtgcaaacctccaacctgttacaaattttcctcaatttgccggtgcatactctagcttagggattactgaaatatcaaaacagataataatatatatgctttcagggaaggaaaggatagatctatgtagtccaaagctttcttttatttttttgataggccctagagttgatcttgaaaattgccagattaataggctgtcccagccctgagaaatcgctaatctagaagtggcaattcccaaggcaggttttgaagcattccattgtcttttacctcaagggatgtatgaaagtcactagctgaaatcaatacaattaataataaatacaatgtattctacatggtatttttaaggggtagagtaataatctcaaaaacaagctatgatagatttttgtagctgcaaaaaatattagaaacttcaataaggcaggatttaaaacaacctaagaggtactatagactgaaaatggaattaacttcttaaagagaatcatgaccaatacgtaagggttatgaaaagaaagtataatatttgagtggtagtttccctgttctgtgtaactactttcatgtcagatatgaaggtcctaaaacataggtgttatttttcactagtcaggaaaggacactagactggatggtctgtgggtctgatccacagtaagtgttctgattgctgaaaaatactataagttgtagagcttctagctgcgaaatgtttcaaaataaacctttgtcatctactttggaatcatattaatgccctgtggccttagaattgactctagaagctttcagttaaatattagccgttatacctgtacagaaaaagttgtagaaaggcttaaaaggaaaaacaaaagagtgactgaataatgtaccttgattccttgatttttctcagttactatgatgatttttgtcatctgttgaaaaaggtttctgctaaatttaattatcagatcatcatctcaaatcttcaaagttcctttttttgtctttctctattaacagacaaattaaaagggaaggatcaagtatatgaaatgaaattgtgatgctccaggaacagttttaggtcttacgtttctcattggaagaaaagtcctctgtcaaaaagaaaattttgaaaagtttaaattatctaaaaatatacagtgcccctaaacttaacatatataatgagtgtatggcctggaaatccaatctcttcataggctatttgcacatgcaatatcaggaccatacttacagttaaaaaaaaaaaaagataaagaaaattcttctttatctgaaattcaaatttaactaggtgccccgaatttttatttgctaaatctggcaaccttatatatgtggaaacataatatagtttataaatattatatatatagtttaaaatgcatagtgaatgtatcagtctttaggtataaatagttacagtatcttttgtccatttgattacatcactgcagcaactttcagagttgagagaatgttggatcatgagaaattgctataaacattcttatgggaatcactttgggtctaggaaacgtcaattttttagtgttccaataatgtgtgttatatcatctcttgagaagttttcagaaattctgagaaaaatggacagcagaaaagggttagatagataggaagaaatatgtaataatttggggagctgttcaagccctaatctcatttaggagattagttatagagcagctatattcaaatttgtttgatcttttgatatttttcaattctgtatgaaggcattaatggtttttccctgctttgccttttaatatgtcacttgagcagagacttgtcctctaactagcaagtagaattgattctattgttgcttcatcataatttttgatgcagaataatggtagatatattcatgcttgtttttcgttgtatacttacctattgattactacgttgctgagcagttaagacaagaagcactcaattctaacatgtttagaagagtttctttctgatttggcacatggacagtgagaatgatctcactgtgtttgttccctggcacaccaaaggtttgctgcagatgttagtacagcagaacttgtttgctaagatgacccattatggaacactagctgattaagcagacgttaatggacaattgcatgtccattattacttctttgaccatgttaccaactcaattcaattgcacttgcttttcaaataagacaaacctgtcaataaagaaactggacatcaagtttcaaatgattggtagagtttatagggaaacacaaaaaggagggaagagatgagatgcacattgtcaaataatctgaaatgttaagaattgtggaaattgttagtttcataaggagttttagacaagcacactatatccctcattctgtttatttctttttcatttaaaacttagatttgctttacttctttgggtcttcatttcttcccatgcaaaattcctgaaagtcaaaaggaagattagaagctagccattttaccactaaagaaactgagccccaagaagttaattcagcttacccaagattacatatttgcttagggccagagctaagacagggacagactctgtttacttcatttctcactaaactgtaccactgcagtttcgacttctttctaccactgaaggcacagaatgcactgaaggcattctgtgccttcaggaggaattttcagccccttcactttcctgatgcccgggaattctttttaagttatgactaacaaagtataaaacatgagtcaaaagttagtccctaataaagtcattgtgactttaatgacttcggcagttgtttcattctgcaaaaacaggaagatcccacacaataaggcgcctgtctcacagctgggctcctgcgtagacggccacccacaagagtaactaactgctggggctgccttcctctctttgacacctttttattctctgttcttacagttttctcctactgacctcatcctgaggttatccatgagaggaaggtacctgctttagctagtctttgatagggtgaagaatagttttaatcacttaggagtcactcctaagtgattttcaggtcaccctcaacaggcctaaattagtcttagaagaagctctttcatgggctttatactagcttcctgtgttatcactattctggactgttttattctcaaaaacataaaatccccaaattttagatttgagaagagcctgcgatcattccagttcactcctcctatgtgattagtttaactaagaactcattaccaagatagtgcctatcttgcctgcggatctttgcataaagctcaaactaattctcccatgagaaatatagaaaagtgaagaagtgtcctatcacttcagaagaaactggctcagaagaaataatctctgtatgcagtgttaaaactaaagaaaaattgaagccatcaaacaaaatgttcctatcaagtgtaattgaattttagcttttattacctattctctacttttaaaataacttttcactattaaaggaacttattccaaaaatcagacaattttatagaaaaggtatattctaggccaataatattaaatcacatatctagaaaatataccttcttcccttttcaaaaaatagaagcaatttctagcagtgtatgtgaatctaatgttgggcataagcttaagaaggcatcggaggaattttttattagagtttattcacaaattttgcttgtctgtgttgaaaaggggcattggccatttcctctggggacattatttctaggtaggctgtaacagggttttcctgtgaaggcagattcttagggaaaatagtatctgtgtacatgagatggtagagacacatttatctttaaaataatgtgttcctgtttgtggatttctctactgaatttaataaagtaaataatgcccatttccttccaatccagtaactccttgggacacagttttacccaggagctattttaccttcgagtctggatgaaacgtgtaacttaataaatagattccaaaagtcttacactatgaaactctgagggatgataaatgcttcccttcctttgttatggtctgaagcattttcaatttgagttgttttcctcagtcatgtagagggagttttgttttctgggaagtcttggttgctggtaaataatgtgtccaaactgtaggaggcagccacagaatttatcatacaagtatgaaatgttagggttgatcattctcattttacacatgagaggtgatgtaactacacaggagagtgagagctgagaatgaaaagtcaagatttgtctactacattgtggctgcctctggctcaacagaaacactcccatgtgggagtcagatgctgaaagcccaactaagcctagctcctcaactgtctcctcaggcttaacttcaaacataattcatatctattctatttcttaatgtgtctcatcacacagttaaacactagtcatactaactggactctacatatactagaatgtaaaagatacccttccaccccccgccgtctgctccttgaaggccatgtctgcctttcttagtttgtacagagcccaacataaatgggcccttcataagtgctttttgatgagagcaatgattgctttcacatcagtgtggttgggccctcccttatggaggaggaaaaccaacagttgttgctaagcaacatttaaaggactaggttagtttctgacactaagtgacctccatttgcatacttcgccatgttgtgtgttttatggttgccttaagatgactatgttttttggtagcattgctgtgcccttagcaaaaggctcataggagaattagtttaagcctgggaaggaggaaggtgatattcatctgttaatgacttgcatgagtacactgatcccttcagtaaactatgcgggaaaggtgaggagtttggtttattttcagccctgcagctgagagccacctccctgattccatattgaaagtgattgacaatgtatcccaacagggtcctgtggcaatggaagactatagaaagaaaataaacagagaaatctttcctcttatagccttttatgattcagtttctacctgctcctatcttctgagcagagttgccgatatagctagtaaagaactggtcctaccctctctagactgtttgctgttgtggttaaacaacatgccctaatatatctattcctactagaatgaaagctgattaaaagcatgaaaagagtttttgtttgttcctttgtttttttttcactgctatatcatcactcttttccctggtcattttaggtattcaataaatggttggcaaatacgtgaaaaaagggcattattgaactactacaaacctgattgactctaaaacattcctaagtatttcagagagactaaaggagccaaaatgagacaattgtttgaatgttatatttgcctaagtctagtgcagagaaaattatggaagaaatcatctgtctctaagctttttacaacatatttttacaatgatccaattaaagttcacttctttgccaaaattcagcttatcggtcagagcatataaacttgttttcttcagcttctgagtcttcagcctaggtgcctgtcttttgaggatttaaaatgagaggccattgtgactgagcagttgtgtctttaaaacgaaataatttggaattcatgtgattcacctgggattcaaaattgcacagaggttcaataagtaaaatatgctagctgagatgattgattcagagatgcctggttacaaacatattgtatcatgggaaacacacacacatacgcaagcagggttacccagaaggaggatgattggacatctttgagaacaatgcctggtgcagtgagccagcaggcagaaatactggcttgcattggcttcacctccaaaagccaggtctcctaggcacaggcgatggcatgactccgggcttggatgcttgaaataaagctattgttggatgcggatgctcatttgaaaggggaatgcctcacaggaaaaagagccaattgcaagttggggctgttgccatggtgctttgctattccttcaacttgctatagatgaaataaatcctgggagtacaggggtagggtaacagaggggaaagatgaggagggaaatggggtgaacctggggcggggaatcccactgcagtaaagctctagtgtttccccttgcctgtgctttaacgctgacaaggagaagggaggggctgggaagaagggagagagaaacctgcagggaaggaatgactttctcaacatgccctggattgctaaaataaaataaaaattaatttaaatcctcagatttctaatgtgagttagaagatgtaacactaaatctcaaacaattcaccattctttcagtaaatgaatgttcatatttcctaacacactctggatcctagatggaaaggttaaaagagtttaatacatttgtcaaatgcaatctaatatgcatattaatgagctgatggagggcagaaacttacatgctgcataggaagtacttttcaaataaaataaattaattccattcccattcattttactatgaaaagaggctaaatgcactggcacacgcttggtgtgtgcgacaaataatcctccaaaaagctagttcacaaaaattcttgtgtactggcagcctagtctaaaaacagccatggtcctaaccttttttaaatgtttgtttaaatgttcagaaaatcgattaatcaaatgcatcatcactttgatcaattagagcggctggatttttgtgcagaggctgcatctgcagaattctggtctgcagtggagagagagggttaaggaacacctagttgaaatgggggagggtactgacttcagatttacttaaatattcatggggcttcctccattttaatcttctcctttttaaaagatggctgtgtttcctagtctggcaactcctcaggaaagaagaatttcttcttccttgcagagttcagctgagtaggactaatgtagaagagtggaaaccccttcggccaccagggctattcataattcataagtgcttcaaaccagccagctgaatacatttggacaggctcttgctccttcgtgcaattcctgatttcattactctcttctgccaggaaataagcagggagcataggcttcttgcaagaatggagtgcgaagatgggctttgtttggcttaggaaatgccatacattttggaggtttttgtcttttctaagttttgattattttatcactgaatctgcagggctttcctgatcctttcgggattgctctctcagaactgtgaattctttcaaagggatttgtggattgtggcaaggagagcattccaaaatgcctgaggcaaattatttgttatctgtatcttggggttacatcaaggtgggttaatttgattgtgttctgtgtctttgataaaatgtgaaacgtacctctgtgtgtttttttgtgaagtacaggacatctgtaataatttgatttgtgtgttcatttaacccactgggacctcttattttgaaataagagcatgttatattacattttatttaagtgtactatgctgtgttttaatcctgttctttttactgaattctgttttttaaaagatgcttctttttttttctttttcccttgaacttttcacatataatctcctctcaccaaataggttattaaattatattttagaggtaatttcagacaaatgtatttttaaaagtaggtacagtttcaagtggaattatcttgacctctattaaaattccttttcctatgtttgcatcttcaaaagtaatcagatgttaattctaagaaatcttaagaaaacctcttttccaaaagtgacgttggaataatttcaaattgaagagatatattttgtagaaacagtattatttatctaatggtatctgctcatccaacctcttgattcctggacagtaaagttggaaacatttaaaatgaacatttgctctttttaaagtggttaatgcatttttgttctttataaacagttcaaaagaatgctgaaccgggagctgacacacctctcagagatgagccgatcagggaaccaggtgtctgaatacatttcaaatactttcttaggtaagatattaactgggaaaaacctgttttataactggggttttcagaattaatttctacaacctatcaaggacatcctcatgtgaatttgggatggagttgagtcatagaaaaatccatttaaaataataactaaggccagtcttcaaaagaaaaaaaaataagcaggaagatcatgtttttgaaaaaaaagaattaaaatacccatccaagacagagggttattatgggctaattgtatttaaacggccctcagccccaccttgtctgcctgcctacttccatctttgctaagacctctgaagtaatgagggaaatccaatcacccaagccctagaggcagctccattagcttctctgacatggtagcctttcacttcctccaataactgagctttgagcaaaaggtttcctctatgatgttttgtaggggatatggttgaggaataattctatagtgatttggtccttgagaataagctttggaaataatttgactattgctttgctaagttatttattaaagaaaaatggatggtaagggggagaattttaatattatctgaaggatttcatcttctgcaagcagcctcgttctcttcccaatctgatgctttatctattattctctgttgttacattactggtatttaacacatgatttgctgaccaaaaagattgcatgaatggtcctcaactattgtcatgcgtgttatttgattatttgggatttttgaattcagtcttaaaggcacttttgtctaacgaacctatttggactattttgatttaagaagtcctacagaatctgcaaatctgtacatcaaagtaaatggatagcatttagattctgattttgttgactttatattgctactgaattacgcttgcttatgaaacctcactttccagggaagcgacccattctcacagctgaacactgcatcctctcttctttttggaatagccatatggcattaaatcaatgagcattttccttgatgccttactgaaacaaataccttttctggttttatttctaaaatcaatcctatttctctaacaccaaagcagttcttgctatcagcagatcaatcagccctctctttgagcagcctcatacagagcttactgcattactctgcagtggatggtcaccagacgtgattaacaagtgcctttctaacagtttctagtatgtgagtgtctgcagcacttgattttctccagctgcagttgcaacgcctttgtcagagaacaaaggagaagaattttcatccatcctagctcccagaggtgcctggaatctaactttacagaaagcattaaatactgatccttttcttctccttttatccatttgaagacagggatcttctgctgagcatttcagatataccctgctctgtgtaatgcccaacgatttttcattagctgggagctgttttagggacattttacaggttaatgactgtgggagaggagaataaaatcaaaactgcaagaacccatttttgtcttcataagcattgcattttaaaatacgagggcttgaagacttctcagaagagacactcactactggagttaaagttatatgaagtccctgagcccttaatcatccaagactggacctaagcagtcctcttcgtttgtagtctctttcaatatctgcttatcaaggacaacgagaatatcttagtctactaattaatcttttttatcaccatagtctaccaagaaagaaagctgataagataataaagatgattcattcctcagagtaggaaaaaataaaaagaaaaatttaaaaagatgctaaatatgagcgctgagtctcaacactgtctcaagatgaggcagatgtcaactttcttgcctattctgcttgctatttaggcatatctcttgagcaaaaccagtcatttgtcttctcattgttccaaaaattaaattcaagaacaaattgttgaggaaggttattagaatctcaatccttatagactcttagcattaagagggtggtgtgtgtcagtgggtgtatgtgtttgagggtggatgtggtaaaccccatcaaacagactagacgggcagattagaattttaaatgttcttgagaaaatataggaagaaaaaaacctgtaatattaacaaaagatgcatcagttgcctcacttgtaaaatgggaacactggtatagatgacatctcaaatcccttccaactctaacttactataactctgatatgaactgagtttatcagttttgctaagacatacctggccatctagattctctgtggtgaaccctaggcttgtaatctgacaatctcaaaaaacaaataaacgaagtttgtttccagactgccagtgaagggcatggaactcttagtcttatcctgtgagcatgatgaatgttcctggaagaccataaagccttcttcataaactttctgatctgcatgggaccataaaaccttgtagtccaattccctcattttataggagagaaaacaggggacccagagggatgaggtaacttgaccaagatcgcttggctaatactttcctcagccagaactaggacttggctttcttggcatctagacctaaataccctgtcaatcctttaacgaggaaagaaggctgttaggaacgcagaacatatagaagaaaatcacataaggactcttaactgatacatatatcattttggaaacaagtctttaggaatcaggattgttggagctaaaaataaaatgtttattaacaggccgggcgtggcagctcatgcctgtaatcccagcacgttcagaggccgagatgggcagatcacctgaggtcaggagttcgagaccagcctggtcaacatggtgaaaccctgtctctactaaaaatacaaaaatagctgggcatggtggtacatgcctgtggtcccagctactggggaggctgaggcaggagaatcacttgaatccaggagatggaggttgcagtgagccaagatcacaccattgcactccagcctgggcgagaagagcaaaactctgtctcaaaaaaaaaaaaaaaaaaagtattaacagtttctaataatataaaaggttcctgtaagaccatggcaaccacctcagtgagcacaaaataagaagatcttagcaatttaccttaaacttgaagagcaatatttcaataaaagccattaaatgttaaaaatgtgtcatccagggaggagggaaatcccttaatccagagataggtgaaacttgtgtcattcctatcttttaaaaaaaagtggtgcaggaggacagggagaaaggcaggcagtagactatatttaccagtccaggcactcattgatgctgtcacataatgggctccaggttgctggtgcaaggggaaatagaagtgtctaatttcaagggaaacaaagcaggacctagggagaaggagaataaataatgcaagatttttacatgttatattacaatttagttaatattttcatgaacagagaaaagttatccttttaaatcctctacttaccctctcaaaacctagaacttagaattttcaagatgcaaggaaaagagcttaggaattttgcataattgaaaagtgtgatctagcaagacatgagcctcaaattatgccattaacagaatttggatgagactacttttttatccgctttttgtttgttttatacaggccaactgtttgctcactgtattctgactattccataaatgtaaattcactcagtgtttattgtgatttttttgagtctgagtttctgattatttccacactgtgctggctaagcatttaatagaggaaattcagaatagggaaacctattagttgttccaatgcctgcatagggaaacacccattaatgtcaaattggcactatttgtgaataatggtcttcttcattattgcagtgttccagacacagtagtggttcagctcaattactcactgttgcagggaatctttaattaaacaaagggaaaaggctgctggtcctactagaaatggttatatgtgcagtgacacaggagaatctaagagcctctttaaccggaggtgaagaatggtggtaaaaaggcaggccctatggtagcctttcattttagcaaaaagtagtagttattaggagtaaagtgacagggagaaaagtaatttcaaactaatataatatataggttttatgccagagattgtgtggcaggaaaaagatttttgacaggaacctcaaggcctgggttctatgctactaaatcactgtgtctggagcaaagtaattgcaaaataaatatctgttaaataaattgccctctgagcttgggcaagttgctgacttcatctgaaaaatgagagtgtgggattgttattggttcttaaacctggctctgattatccaagtcacttgggaatcttttaaaaaaaatactgattcagtaggattgggtggggcttattcagaaaaatctgtatttttctgaagtttcctgggtgcttctgatgctggactaggttggaaacccctaaactaattgagatgaccactaaaattccttcctaagcaaaagtcataggcttgtgagtgtaggagcttgtggacacctagagacaatattgatatgttagggatggataattcccttgcttcagtcccacagagagcaggtgaggtataccacgaagccagtactgtctcactgtgcttgctttgctctgatgaagtgtccacaggggcctatgagcagccagaggtctctggggaaaacatgtgactgtgccattatctgcaagagtcaaaacaaatcgtctagatcccagaatgccatctgggagcatgtcattttcaaatggcaaagttgtcttcctactaattttcactgtaaccagcggaggtaaatgtaggtacttttgaaagctgcattaactctttcagccacagggtgtcatttagttcaataaagtagtttttatgcaatttaataattgcctctgtgcacccaccagcatccctgtggcctgaaagagttaatgcatttttttcagaagtactgaagatacatctccctgtgaagtgaaatggaatatttgatggctgatatttttaatagcacaatgtaaaggaaagagcttctataagcaggtaggcactttttttttcactaatcctagctctgctgttaccttgttgtaacataattttaaaaaatattatgaagtatcataaatatttaataaccttaaacatgttaataagtgtaatgcttattacaaacaagaggccttattgttattatttattggtagaattaatagactccaggcatgaaataaaaccaaaattatagtcttcctctaaacctcaaatggtaataaaccaagcccttaaagtaattgtttgaggattatgaaccatttatatttctaacatatatactgcttatttaaactgagcccttgctaaagccatatggatttttaaattttttttaagtaaaaataagatgagcagatcatgaagcctgtttttattaatctgatggacattttattatacaaaaatatgttaatccctttatttaaaaatctacatataagtattagtgccccacattgcaaatgtataagtgtgtactccttatacactccttatatacccctaaattacactgaaaacagaagatttggtcttgggtcctatttttgctgctttctggacaagttacttcgttcctctgggccttaatttgcctagcaataacatggaacaacaaatcttatttttctcaacaaattttatattttccccacttactttatagaactgccctagagatacagtgaaatagtgctacaagattttattttataagattctaaagctgttatagatggttagagttgttttgaatattgcagtggattctcatagacacatgtgctgaaaaacatattcctttgtctgttgcagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggtgtgtataagctcaggttttgtgcatgtagctctctgctttacagcagacggatgaccgtataccttttagaaaatagtatggattgcttttgcattattattacattttgtgttagggaagctcatatgaaatgactttactgtgagcagtaaggccttctgaaagctgtcatttgaggaaggttgattgaacatgagaccaagtcttgggggatagcctggatctcttatgctgggtagccattaagaatgccattgttggggcatctgatggaagatcctttttccataccaaagaaccacttttttttgttttgtcctgagttaggtttttatggacagttcattatgaatgaagaatccttctgaagagacatggggaaaatccaaggaaaggtcaataggcaggtctgaattatcccagaggacatttcagggactgtatgccaaggaccaatgggaaaatctgcactaatctgtagtgctggaaaagaaataaagagaaactgacagcactgactctggagcccaaactccagtagtggagggaggcatagaaagaattcatacatcctttaggaggccacacaaagtgactgctgaggtcctctcagccttgtgagaatatgaaatgagcttactgtgagcagtaagaccttctgaaagctgtcattagaggaaggttgattaaacattaggccaagtcgtggtggagagcctggatctcttactctggatagttactaagaatgaaataaattggtccttaaatcagataaccttggaataatctcacaacacaggcctgagtgatgtttcttccaggtccgtctgtggcccaggagccctaggatgtaattcatgactggcattcttcatgaccttttacattcaattgggttgacttatgcacattctgatagctgagtcttcctgatctggccttcagtgatgataaccaaagggcagaggagttttccctgagactgttttccagctgtcactaatgggccagtaagcagcaaggggagagacagggacattgaactagagtgatctctattcacttgtggccacctttgaaagcaacattggttgaagactgatgcatgtccaatataggtcagcaactaaatttataaatagatactttcccttttcagaataaaaaatgttcagaaacttgtagctatcatgaagaggacacccgacctcctaggccatttaactttcagattttcacacaactaaagcactctaaggagacactctaaagacttaaacagccaatgtccaaaaaataaattaaaaaaatgaggcatgttagcacaactttccttattcctaaattcctttaaatttttaattataggagctggaagacctgaacaaatggggtcttaacatctttaatgtggctggatattctcacaatagacccctaacatgcatcatgtatgctatattccaggtgagtgaacaggagtgaatactggctttccaattggatggctctttatgattttttttttccatcttacttttctgatttaactttcctcgacttttggacatctacttatttatgttctaatccattttacaacacaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgtgagtagttatgacctgttttgcattcctgcccatcctccttcaaaaatgccatatcagctggatgtagtagcatgtgcctgtagtcctagctactcgggaggctgagttgggaggattgcttgagcccaggggttcaaggttacagtgagctatgattgctcccctggactcccgcttgggcaaccctgtctctaaaaaaataaaaataaaaaaaatttaaaaagtgccttacaatatacaatatacttacaaaattaatgtaattagaccaccctgcatacttgaacaggttctttataaaatgtatcacatccattaactgagctatttataaaaaatgaatgacatttctacttgttttgctttctaatatcagagtaaccttccctttacatctcttactattaaaagtatttaactgtaaagcaattaacagaatttcagggcaggaatcatgtcttattcttcattgtatttctactaagggatgcagtgtatctcaaaatgtcttgttcagtgtccggtaaatagtatattctcaatatgcaattacttatctgaactgcccaatgccaccctaggtatatatagagcactatattccaagggggatatcacagaaatataaaatactctctatatttcttattagtaataagcatccagaggcttagtctcctaaaaaattataaaactgatgcaatgtgttgaagaagtagtaactaaaaatctagaacagaagaattaatgatgctgaaacaaggagaaacaatattcatatttgccataccaactctgagaaggtggccgtggctcccttccttcatagattaatgcatttgtgtataccgatatcatcaacaatgtgtacagcaggtcatactcttacttgacaaatgaaaatgatggtcaagtactcccaaaatgtgctggaccactgcaggaagagactggccatgccctgtccagcctcacctttacagattcagtttggaaggtgaaaaaagattggccacaacttttttgtggcaactctattgcttgtgttgcatattttctaagaaaagaaatccaagaaatcttgagaaagtgagatggagctaagggtgtttgatccctctgaaggagagaaagagtactgtttttataccctgtgtaagtatcatagagtgaggcaacactatctatcaactgctcactgttattaatagtatacctgctgtgtggccagaaattgacaatgatgagtgctgcaaactttttagaaaagggagagctcaatgagtgcttgggtaatgtgattggtctttataggagaggtggaaacccacctcaagctggcatttgaaggaccagaagatttaactaatcacagaggatgaggaaagacatttcagctctagaatgagcaccagtatataccttattaatactaggtttgaatcattgtgcatgggtgggggcagagaagcattcatgacatgacatgaaggaattcagcagtggggcctcaggtttcacttcttagaaaggttctcaaatcttcccctagtaagtgattagtgggtacgtactgaatgaatgaataatatctgaaagcttgtgaccacaccataaatttagctttgggaaataatttattgcttatcttatgaatcgggagtttggccatttttctctaagttattcagctaagagtatatgaaggttgttatgtctcagagcagagccagtctgacttgcttctttgacttgtatctgcttgtgttacataagcaccatgctgccacatcactggtccaagaaacaaacattagacgtttacacactccatgagatttgtgctaatatctttccaagcatcagcctttaggcttgatgtgagattgagctctggccatcatccctttcacatcagagactttatgatgatgaacagaatctacatttacttaaattagtatattgagatattacataaatcaacaatccctctcccaacaagaataaagtaggatactttacaaatgaaactgaataagcaggataggcgaattggatgtgtagttaaatgtgtttatttgcccgacaggctgtcttcacagatttggagatcctggctgccatttttgcagctgccatccatgacgttgatcatcctggagtctccaatcagtttctcatcaacacaagtgagttcaccactacagcagtcattccagataattgtatgattcactgcttaatttttttcctcctaatgttttcattatggataatcacaaggataataatgaggcaatccttccatttctctcaaactggtcaggcctttcgtggatactcagtccaatctggcaacacaatgtttgagctgcatggagaacttggagagggtcataggggagccataaaaagtactcaaaatttggcaaatacaatatgtaaggaaagaataatagatatggaattattcataaagaacaataaaaggtttggggatcccatgataatgactttttatattatgcaaaactctcgcacagagcatagtaactcactactgtccctatctgcttgggaagcagccacaaatgttgaatctgcacatgggaacctccaggtaaaaataagatgccataaaaagcactggaatgagtttccacagttcagaaggaagggtcattaaaagttccatacattttcttccaactgcatagatttgattatggattgggagtagcaatgacctgagtgaccaggggtggtctagccttaggattccaagccatactcaaagcttttgtcatgcttaaaatgtttagttttcatacctttgaaaatccattcattttctcaaataatgtactatctctaagtgctggaaatctaagtactttgagaatattggttattgtagtcatgaataacatcaagtactgacagttttctagaaatgctttttgagctacttgctgtaaaagagtcctgatcatcagtccttgacctttatccaaagaatatctgaatgacctaggtttggagtacactgggtccttttacttcattcttctgttgaacaaacaaaatgttggggcagctacatgtctgcatggattgtatcagttggtagaatgtggtgtcatgaatcatatataggccagttagcctcacacagaaaaatggtctatctaccacagtcacctatagcactgcaacatataaagcctgcttgtagatctgtggccttgatcacaggatgaacaaaacaagagtactcattggaggttgtaactaagagcacactgttaaagcaatgatatatgtgtaacagaacctgtaattaagtaacacattaccaccacttgtctggtattcttgattaagagaaaatgtggtttcataagtctgatgaccatattctcaagcagacttctgtctaacaaaagatgcctgtgattcttctatataaaaggcaggctggaagctgcagcttaggtttccagatattgcaatttctggtggagagagccaaaagacagaaaatttgacatcagaattgttcccaaaaagtagtaatgtttagtatcatattaatagaaagctctaaaaagtgacagtatttgggtaaaatgaagttttacatcaagcattatctttaaccatccaaaattcacaattgccggagattagggagaatgtaaaatgtgaatatagcttgaaagtctcaatacaattcataaagtttagtggtactttcatgttgttcttttccaaagtacaaaatttttgaagatacataaaaataggatttagctgctcaggaatgcccttacctaatattaaattcttcatctgagatatagaaggagtaaaaggattttaaaatacaatgaattttaatcacagggaaagcttatacaccagtagaagcattttttgcttagaaactgatgacttctgtttgtagagggccactgcttctctaagaggaaatgacatgtagctggtggttcttgaaataatttggagagaactaggtctgatttcactttgagataatgccaacattcaaatcatatccctttttaattaagtcatcatttggtctgatttattagattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtaagactttagcctctctacattcctcacttactgccattctctctgatagactgaatttattaagagttttcattttctttttacccaaggtgttagcaactgatatgtctaaacatatgagcctgctggcagacctgaagacaatggtagaaacgaagaaagttacaagttcaggcgttcttctcctagacaactataccgatcgcattcaggtatttgaggaaagtctttgatttaacacaaaaccaaaccaaactaagctgaacaacaattagaaaaagaaaacaaagataaattcagttattggtatatcctaggctactcctatagcttagggcttattttaagaacaagctaaggaaaatggacattcaagtttatcttctaatttatgaggaaaaataatctctatttgtggaactgcttattagttatataaataaatcgcaaaatctatttgtaatagggcatacgtgactgttggttccaaaagcttgtgtttggatttaaatcccattgacttgaagtttgttaggtctgttttggatatacaaattgccatcagctgttctcctctttccacaagtggaaaatatgaagttatctactttgagtaattctttgcattctttccaaactgagaaaaggaaatgatagcagcatctgacctctaatgttccttccaatttttaaattcaatgactgtcggtctaagaagacacacgttttcccctttgggactctataaaagtaaataactgacccaggctagcatcattgtaattccattttttttcggtgcatatgtcataattataatgcaactaaaatgttctcgggtttagtaccaagcgtactagtatgagaggcatgagatgttccggcagtatttacacctaattttatgagatttccaaaacttgatgatttcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggtatctaatatgagattttcaaagtttttgtgagctctgctgattatagagctggagggttctatttaattccgtttttccaatagaatatgtatatatgaaacaataaggagacaactacgcattttgttccattatagtcaggactcatgcgacttctccattacactcagtttcacagggtggggaaaagtagtcatcagaaacccatcaaaatttggactatgtgtccctaaatcatttagatagttgtctctgatgttagcaaatccagctgaataatatgaacatcagtgtctcctccatcccaaccctctggatttctcctagctctgtcttcattcaagaactctactcctcatccttgcttccagccctctgtttttatcttctgtccttaatcaagcccacggtgaccatcaccagaggcagtctcttttactgcatagtcaaagccctgtcttgtcttccctcccaaggatgcttctatgcttttgagaacatgctgacattttctggttgtgtccaaagcaacacattctgtgtgtgctcaggacaggggacaatagtctggaggggtgaatacagaaatgtccagatgccaatagctgcagaatatgcagcaatggaaagtatcagtatccatacaaagatttttcaagaaaacgaatgggctgagccaagtagctgagattgagaatgagttcatagactgtccaagatctttatcccaaaaacatttggattgtttattttcagtatttatcctctttccctactacctggatactccaaatttgcatatacttgtaatattaatatacagttcctttgcaatatttattttgttgcttcttagagaaacccaactaaatgagtttaaaaaatctgtgaaagggctgggcacagtggctcatgcctgtaatccagcactttgggaggctgaggtggacggatcacctgaggtcaggagttcaaaaccagcctggccaacatggtgaaaccctgtctctaccaaaaacacacaaaaaattggtcgagcatggtagtgtgtgcctgtagtcccagctactcgggaagctgagacaggaaaattgcttgaacccaggaggcggacgttgcagtgagctgagattgtgccactgcattccagcctgggcaacagagcaagactctatctcaaaaaaaaaaaaaaaaaaaaaaaaaaaagaaagaaatctgtgaaagtgctctgaagtctaatatactgtaaaaatgcaagttaacattgttaatgagggttaattcgaatagcccaaaggcttaagtggaacaagatatgaatcagtaaggaggaataacacccttttattaatagcagtgatgttttatgtttatatgatgttctgtggagcatttcacacattttccatacattatcttacttggatccccaaacagccttgcaagatagataaagtagatatttccccagcatgtcaggtgcaaagctgtcctcttggtccactacagcagctctctcatccaaagctcttcactctccatcttagggacaggtcttcctgttgccatgacatcgttatccactctggtatttcccaccaatgggctctgctgaacactgtctgattggcccagcagtaaagctctttactgggtgctctcaggattcatacagctctctcgtcctgtgatctagggaataaataactagcagctacctttcaaaaacattctcagcatttcttagcagaagcaaaacaagcgaagaaaggaaatgactgcactgtgttcagcttattcaattttctccattaccttgagcttgttattttgggtccctggaaaacaccttgaaaatagtctctaacattcattaagcacacataaagaagtaaaagggagggaaaaggagtgggtggaagtgagagaaatatctgaatcatgtacggttgagtttttgtaaccagtatagatcagagattccctgactttgctgtgaaacttcctttttaaggctaggaaagcacctagaaagaagaagaataagagaatatatatatatcatacatatatatatacacacatcatacatatatatatatatatacacacacatcatactatatatatatatatatatatatatatatatatatatatatataattttatttatgaaagaatcacatatgaccaaagttcttgtgtacagtacaacttggatgtattaaatgactggccaattaccaacatgttaataaaggaaagtttccagtagtgtggaaagagacctatataatgtcccatgggtgggtgccctttgaccatctacccctaaatcccaatgcagcatctctgtagctccccagaccatggcaggggaattcccttccctcattcaactagtgcctgttctttctctctacttgtccccacccccagtgtttcctgtttgtccaacaatgaggaggccagcgtaaggccacactgctagctcatgcaggatgcatagcccctgagtaaaccataacagagccataagcctggtatttaatcacaggaacatcagcaaaaggaactgcttaattgttttttattttcccttctttcacctgttggaaatgactgcgtgctctgtagatccaaaacaattgcatggatgtccaccgaggggatatgtgtttctttcagggctcaaagtattttcacgtgtttcatcaaactcctctaccagccaaaagcattccacagaacttgagaaattccagagtagtcaggagccagctcctcatcactttggaatagcaacatattttaaagttaacaaggaaaaaatattgagtcaaaacacgttagacctgggcctgccttcttcagaaaatgactcacagaatccaagtagtggcaaagtcattctttgtctttgggtccctggaaatcatgaggattccatccagacttcttatctggcgcacataaaaggaaatgcagtctgttgtagcaagatgaacacgggctttggaatcagatgaagctgggactgagtcccagctccaccagtcactagttatgtgacctctgacaagatatttaatctcaataagtcgtagtttctgcctttgtaaatagtaaacagcaatacttaccttccaggattaagagagaatacatcgattgcattcagtgtaagacccactgtattgtgagtgcccaaatcatggaatccattatgattgatctttctgaagttattaatgttctttctttgcatggaaaccaggaaaccttgtttacttttcaagcaccatcacaataacagatgtgtcatcttatttttctccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagattagtctgtaggcccacttatttcacaattagttctgacatatgaaaagcagatctttctcttctcttgtgccattccccacaaagaaagccaaccactgtgtccagccaacatcacaactgaagtttcagaatctatgtccaaaaagtcccctagtttggaacatttcgcttttttcttagcaactgttcacccagctcaatgatgcaggaagggggttgaggaaggaaaacaaaacaaaaccactttgctcatctcgaactatttccttctacctctttaagagtctgaagagtttaatctactagataaataagggaatccccaacttggctgagtcctctagaaaagtgaatcatagattatagaacattagtataatgcagtcagagagtcccattgattcatttgacacatgaagaatctgaggtccaaagagtcatcttaaaccacaacccacagagcatgggtggacactcagggttttctcagtgatccatgcagcctcttgttggtcatatggctaggattttctttctggaaagaactttttatatataagaaaaatacttaatgctttgttgaaatcttaaagtcagcattttaaaatattttatcctgagaagagtgtgtgtgtgtgtgtgtgtgtgtgtgtgtttatgtgtgtgtttgttgcagaaggttgcaaacaagaatcggtgttggcccataataatttagccacaagggagtgctctgtgaaccagtaagatggtcttctctaaacacagctgaaattaagatgagccgacatttcagaaccagcttgcctgctagttgcagagctatttccaacattttccatcatctctgatatctgattgtgcctcaccatctctgagagtttgaaaaggagcaaaataaattgcttacaatagccagaggtgtgagttttacaatgcccagagctagaaatatttgcaggtttgttttctactgagaagaggttcttaattaacccttattgcaaataagaatcatgtgggaaatacatatatttaaaaacacttgtttggggcccatcctcctcccagatttctgattgaattgatcttgggcaaagccctgggcatcagattttaaaaatttcccccaggctggagtgcactgacatgatctcggctcactgcaacctctacttcccagattcaagcaattcttgtgcctcagcctcccatatagctgggactacaggtgcatgccaccacacctggctaattttttgtatcttagtagagatggggtttcaccatgttgcccgggctggtctcgaactcctgagctcaggcaatctgcccacttcagcctcccaaagtgctaggattataggcacaaggcactgcacccagtctctccctaggtaatcttaacgtgcaattggagtagagatccaccgctccaaaacagagaatcatgcctgcagctgaggtgttctttcacccccactgtcttcagatattcattgtgaactcatcatggacagcatattatgcccaatatagctattttaaacagtaaattttgttatatcctggttttatcttactggctgacttctaactaacttttaggtaagatgaaactgcacagtttcactagtttcctatacggaaatctcaagaaccaggtcagacctcaggcatccaagctaactagacccttcatgagtgcagaaaccatgcctagtactttctcctcctggcacagcgttcatgctcagacatttgttgcatcaatctggatgttgatgatgtaaaatttcaattaacaggaagatcagaagaatgcacactctaggcaatttaactttcagcttttctcacttaattgcaataatctgttctcagatgtctccccacccagcactgaaccctctccaagacagaacaatgttttttgcctggtctctttttttaacctttgtattcttcaccaacaaacactataccagccctaagcgaaaggagaaccggtgatgtttgttgagctaatgacccaagacacaagtagaaccctttttattgaaattacttgtgaaatatggatctacttgattttcttgccaaaggagtagagtacactggaaaaagcagagtttgacaaacctgtgttccaagtcttttcctgtaccttcctacctgtggggatttgggcaaattgcttaaatttttgagcttaaatgttctcatcattaaatggagctaacaatagacagccaaagatgaaatcaggcatagtgttacatacagtagatgctcaataaatctttgttatctgaatgtatgtactcgtggatgaagggattaattaatatttaaaaacatccaaaaatcacctctaaaagcagaaggcagcaacacattttgattaatttagggttcttgaaatcaagttccagttaatctagatgtttctacataagcttcaagattctgggaggataaatgctctcactttaacccatcatatgggactatgctgacactgataggctcattgagttggaaggaaacatgtaaatcatattattcatcctcttcaatgctatagaatccctccaaaaatatgcctgtttgaaagcatcaggtaatagataactcagcaaggcccttttgaaataatgtaaattattaggtttctgggaatcaaagtgtactcttctagagcaacctttcttgtttgattttttaaaatatttctagctaaataaggtatgtaatttctcctctaatttcctgttccacttgaaaataggaaccagactttttgactatgtgaccttgggaaagtttatatcacctctctgcacttcgatttcctcatctgtaaaatagaagtaataataacagcacctatttaataagattatcttgagaattaaatgaattaaagctgtaaaatagtaaaaatagtgtctggctcataatatgcatgaacaaatgttaactatatacagctaaatgtagcatgttttctacattgtagctccttcaaccattattcatatgacctatcttcatcgttctggtcaaattattctgggcttgctcaaatagacagtgctcttttagggtgagtgcctcagaaccaagcaccatatttcactcatggtagggcacagtgtgattcttgcccttcttttttctgggctgtattctataatccaagattgtattcatttggagggatgtcagtgactcatctggataattcataagatgcttacaggcaaaccaaatgcttcataccttttcacatgaaccactgttaatcttctccactttgttcttatacaatgaagtttctgaattttagtgcagaatttatacttctctgatacatttcatctgaaaaacaagtagggtataagaaagagggttttcagtttgagtgtcagattgacctgtttgtaaatcccagctccagcattacctgtacaatgtcatagaaggtatgcaatttatttgaccttcagtttccttttctgtagcagaaatattatatatgtataaaattatttggaggccaggtgcagtggctcacgcctgtaatcccagcacttcgggaggctgaggtgggcagatcacctgaggtcaggagtttgagaccaacctgaccaacatggagaaactccctctctgctaaaaatacaaaattagccaggcatggtggtgcatgcttgtagtcccagctactcaggaggctgaggcaggagaatcacttgaacctgggaggcagaggttgcggtgagccgagatcgcaccattgcactccagcctgggcaacaggagcaaaactctgtctcaaaaaaagatattatttggaaaggcaaaggtaagcatctagcacattcagggcatacaataaatgagggttattagtaatattaataccctactatgatgattaaatgagataatatgtgcatggaaaaaaatcttcatattgctgttttaattcattacttttggcctaaaaattattttgaattctcatcctgatagctcacaaactatgcccttcctaccagaatttattatctaaagataataatgtattttatatttttgtttacagtttagtaaaatgttaactagaacaggactgggatgggtatgtgttaagctgcctaaagtctgcctcatcagcattgatccattagtcaatgttccatgggcaatggcactaagtcaattataaattcacctatacacaccatcacctaggccaatctggacaaaaacatatcaggaaaaatgtgatcaaagacttttctgaaattcagacataccatgtctaaagcatttgccttcttagtataatctattagctctaactaacggaggaaagagactgtgatagcatgtcttgtccttagggaattaatgctagttactgccctctcaaacggcctacaaaccatgagataataatccattccagaatttttcatacaattgatgtcatgcttgacatcgtgtagtgctggactctttctttctaaagagtgggaaaatatttgcctatcacacacccccagatttctggtctgctttgtgttctctctgatttctgatagatcaccaattataagccaaaaacacattgaaaagccctttcagtattgtgggaaatcatgtgcctagaaacatgaaactacttaaagaacagagatgctctcccaactcccctttgctttacgtggcaagtctagcagaagcacatgatatttgtgcacacggatgcaagttaaagacatattcttttaactgaagaacactgtcttcttccatcaaatacagtttcaaaaaggatccccatggagtagtgaaggatgacaggggaatctatctcatttgaatgggttcttcagaacctaccattgattaattcagtaaacatgtactgagtcctgaatactttcaggcactgttctaagacattgtccctatgttttaagtattggagtatataagaaaatggatgtacaaacaaaaaccttcagtccagtataagaaatgctgactaaagaaacacataaagaacacaaaattgggagcatctaactcctttgggagagtaaattagggaacatttctgatagaaggacaaggttgagtctttaagaatgtgtagaaagctgtcaataaacctggatcgagagatgaagagcaggaagaaatttgttacaggggaagggagagcatgtacaaagtagagaatgggaaagagtatttttgaggccattcataaattcatttatttcaaaactatttatagagtacatactgtggaccaagtattctattagaccttaaggatacagggacatacaagcagaggaaaaccctattcattaagtaaagctgcagtcaaagagacagataataacatttttaaaagtggatgtgttgggcgggtgcggtggctcatgcctgtaatctcagcactttgggaggccgagacgggcggatcatgaggtcaggagatcgagaccatcctggctaacacggtgaaaccctatctctactaaaaataaaaaaaattagccggcctggtggtggcacctgtagtcccagctactcaggagggtgaggcaggagaatggcgtgaacccgggaggcagagcttgcagtgagccgagatcgcgccactgcactctagcctgggcaagagagagagactctgtctcaaaaaaaaaaaaaaaaaaaaaaaagtggatgtgttattaggaattggtacaagttatccaaaggatggaaatacactaatgtgagactaatttttaaaaatcaccttggctaatttgtaagaaaaagggaagggagccctttatgactataaaaacaacttgtaataaagccccgtagtgagtgggaggagcagggcatccaggaggaactgaaagctgactggtttcacttggggtagtggaatcgtcagaatcaatgctggtgaggtggcacaggccaggtcccacaggacctgctggactattataagaatgagctctttcttaaacataatgagtgtctgccaacatttttaaatagggaaatgatatgatcagattccatttggaaagatcatcctaattgcagtgcaggaacaaatcttaagaggacaataaagaaatgggagatctgttagcaggctattgcagttatccagccaagatgagatgataccttggactaaagtgaggctgaaagatggatataaatggatggatgtagacttatttagacattgcatttatagatcttagtgatggattctgttgagaagaaaaagaatcaagactagatcccgagtttttgcccaatatgactagaaaggttaagtcattctctgaaaaaaagaaacactgggaaagtattagttggcacagaagcatgattccagttctgagtgtgttgatgtgagtggctttgtgacaccaaagtgcatgtgaagtagaccatggaatatgacagtctggaattcaaagaagtccaggataggaattatcacagggatcatacataaggaatctgaagccatgagatgtcccagggagagagtgtggaatgagaaaagttgtgagagacaagactgacacgtcaggtactctattagttcataagagacataaaaagatcggcatgtaaaggagattgataaagagaaaccaaagaactaggacaactaccaagagactctggcttctaagaaagctaaacaaagagagtaaagaaggacgtgggtcacaatattaaatcctcctgagagatttatttttttaaaaaaggaaaatatttattttatttagaaatacgaatatcactgatgaacttggagtgatggtacattagctagtttttagtaagtaaagagtaaaaaggaagtaagaaaaaaatagaggcagtgagaacacataagaagttcaggtgcaataaggaagattgagataaagcgctatctagaagaggatgagaggtaagggaaacttttcttttgaaagtactaaacatacttaagagctacttaagtatattttaatgaaaatggaaagcaccctgctaagacaaagcaattgaaaatagaggagagagattgaatcattgatactggctgcctgagaagcagaaataatgtattccaaagcactcacagagggattagtcctggaagaactttcacagtgttgtcgcagggctatatgcacagccccaccatatgtcatggtcttcttgataatattatgttaatctctgattctcttgcagatttagaagcggcaacacttctcttgcctgagattgggatgatgtggctgagactgccttcctggcagccaaatgggctattcagcagtcacaacccctatgggtggttgaccggggtgcccatttgagctgggtgtgctatgtgaccacagatggcttcggctggggcctccgcttttatgtaaccatgccacaagaggcacattaggtgatcacccacacgagcctgtgcttggctcagagccactattgtctgtaaaaggtatagttactctgctaacactgtacatacagcttgtgcccatggctcgcacccaggcttgcttgtgcctaggttcgctcatgtccagtgcatgaagcgcttgagaatgccagtaggcttttagtcccagtaatggaaggtagctgagctctggtattccttgacagagaaacagctagcagctgtatatgccgcccttcatgcttgtgggagtgtgacaggatgggctgcagttgtcatgcagatgatttaccagatagtgggatggggtaatgatgcgttcctgggtaatgacccccaggactgggacagcacagacacccaatttagcaaagtggggtgcctacttagagtagtggagtactctgagtacaagtcccttagcagcagagctgcaaaaggtcttgggacctgtagtcctaatgcaagataaggccataaggcctgaggcacccccatattcctgatggggcatagtatacagatgaatctagccggggtgctactgctgcctggaccactgttacagtccaagttactatagataccatatggtttgaaagcaggtgtggacaaatttgccaatggtctgaactcagggcagtgtgaatagtgaccactaaggaggtgacacctacagtaatctgcaccaatgactgggcagtttactgaggcttaaccttgtggttaaatacccagaagttacagaagtagctagatggtcaccggcccatgtagggccaagccatgtggcaaaacttatgggaggaaggatgacctcctctgaccaggtatggggatgaacagtaacatgttgttgcctgccccaatgcacataaaggtagggaaataaaaacctggcttaatgtagaaagcaacattggggtagtgtcaccatggggtggttacctgccataacttagagttgttgccccctgtattactactgtggcctctgggtccagggttcctctctgtgggtacgtctccccactagaaaaactccctcagccttacattccattcccattcccttgggggtggaatgtaaggcctatgtgtcagacccgtgtgtccagggcctgtgtgtccagaacctatgtataaggcctatgtgtcagacctgtgtgtccaaagctaatgtctcctttggcttagggggtggaatgtaaggaaaatagatgtgctgtggtcaagaataagctgaggcagataaccagtccagcatgactcagcaaatttggagcgcaggcacacacctccgctcttatgtaaccatgccgtaagaggcacattaggtgatcacccacatgagcctgtgcttggttcagagccactattgtctgtaaaaggtatagttaccctgctaacactgtacatacatcttgtgcccatggctcgcacccaggcttgcttgtgcctaggtttgctcatgtccagagacagaacaaagccacatcaaaactatatgattcaagtgtttttccagctacccacctgtcatccactgactccccttggacctcagttagaacctgacaccaggatatcgggctgttgtaaatttggagctggcatggtcactttctccaaagctgcctgttatttcctcctcaacagcaatctcttcctctttggttgtaattacatggaattgcaagtcccttagttacttcctcaattataaagaattaactttctgggacctgcttttaccaaactctcttgaatactaatgtttcttaagtagtctaaactatctcctctgagtcaaattattttgcctcttttgagctctctgtgtctaaattgtcactgtaagaatcctatcaatgccaaccttgatagtgtgtctaaccagtcatctgttggtcagtcagtcagtcaagaaaatgatttactaagtacctaagacctgctacgcgctttctagtaactggaataagtagttgctctttttgtcctgttagctctcctatttttccttttcctaggtcttttgcagttaatataataaacttaccctaccacctcaggtttttaacatgctataacttttctacaatctatcttgctctcctatccatttcacaggcacatagaactttagaattg

SEQ ID NO: 1631 - DNA, 3748 bp, Homo sapiens
atgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttgctggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaat

SEQ ID NO: 1632 - protein, 721 aa, Homo sapiens
MTAKDSSKELTASEPEVCIKTFKEQMHLELELPRLPGNRPTSPKISPRSSPRNSPCFFRKLLVNKSIRQRRRFTVAHTCFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 1633 - DNA, 50460 bp, Mus musculus
  misc_feature (1)...(50460): n = A,T,C or G
tggttatttaggttggcgtttgcctaaggtctttatatatttttagaaaagatttatttaatgtatatgagtacactgtagctgtcttcagacacaccagaagagggcattgaatcccattacacatgattgtgagccaccatgtggttgctgggaattgaactcaggacctctggaagagcagtcagtgctcttaacctctgagccatctcttcagccctggttctttatatttttacaagatattggtatcatcaacttcaaatctttcttatttgatattgttttttcctattttaactacatcattaacaggccttcagtttcagtgatgagaacaaggaaacatggcttacataattaagccatttcaccctctcacaaacaaaaaccataagaggtggtcagcaaggccaggcttctgctgtctctgcaggactcttggctttccagcccttggtactccacatctaatttagccctcaaagcaaggggaaaaaaaaaaaaaaaaaaggtagggcccctgcccacatcgcctggttctgctggttaggaaaaaagaagcaagaagattttcctccatgtttcattgacttgaactgagtgacatggacgcttagctgcaagggaggcgaggaagcaaagaagtagaaggttcttttttatcatctctgacgggacagcataagttacaacctggtatgggacattgtgcactgttcttttccaaatagagtttgttttagcaagaataagaataaatggctcctgggcatacaaggaaaattagaaatgacaggtgttattttgtggtaagcatcaagacaacacagagataatgagaactatagaagcgggttttttttgtgtgtgtgtgtgtgtgtgtgagtgggtttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagaggaattatttctaatgtcacacattcggttacctattactgttcctgtataattgttcttagcctttagacatatggattttttttcccacaaagaactgaggttgggggctagaaagatggctgaacagttaagaacatctgctgttcttccaagactacagatgaccccacttgagggggtctaatgcctcttctggcccctacgggcacacacacaccaaataattcttttaaaaattgtattttactgaacatataacttcataacattctagaatgtctatgacctctgtttgagagatgtcaaaggtcagttttgcatctcttgtgtccattcagtatgacctctcatattataaagagctaatttggaaaagctgtttgattcttgggtggtaacttgataggagtcaagtgatcccagcattcctcactccagctgtgtgcccttgtggaagtggctcagcctctctgagtttctgatttttcatttacaaaataaaatacagatgatgctaatgtttttgatgttttatggtaatctcatgaggtggtcagttctggtaatatttatagaagtgaaccataaattgaaaaataaagatttttaactaagctaaaataaaacttagaaatgttaatataatactttcaaagtactttaaagaagcttaaatttttataattaaaagatgaaaagacaggaattagcaaaaaaaagtactatattttggatgatgaacgtcataatgacaggttgttcaaatggtagcaaactgctttgcttttcatacacatttaagaaatgacaagtcttatttcatagaacgatgtatgcagttaaagaagtaaaatgaacagatatttatgactagtcttgaaatttttaaatgcaatttagacatcaagtgcccagttatgagagttacaagaagacttctttctcttctacatgataaaatatgcacagtcacaataacttaggtaataataatactaataagacgtgggcttggcttgaagctctgtctcgccattgttggctgcacctgccacaaacatgttttcctttaataagcatcaaccatttcccactaccgctttctttctgagctcagacactgagttaattttccggaaaccccactctcttgtttctgaacacttcttcatcttcccagaagaagataaagttggtagatagcccagatttgtccagccgtgactcccattttcagggaaagctgagacgggatttctaataggtttaatcccccacctctggagtttcccacggagggagggtctgactgcgagatgcagttcacatctggttggaatcctgtaaccgtgactctagagaggctgagtgatggcaggatgactttgctgggctccggtatggttcagtgattttcctctgagactcaatggctataacatcactggttgttacacaaaacatgttggggataaagcagtgctaagagtttatagaagaaacttaggtagacttgctcaatgcagttagagcttagctggcatctgttcgctgagcaaatttaagatttatttgtattttatttatttatttgtgtgtgtgtgtgtgtgtgtgtgtgtgtgtgcatgcctgaagaggccagagggggtgtcatatcccctggagctgtagctacaggtggttgtaagcatcctgatacccacctggtgttgggaattaaacttgggtcctctcgaagaccagaaaagaaagcgctcttaaccactgagccatctctgtagaccacagctagtggatatttctaaggcaagaaattagctggggccagggggttcatataaaacatatttcttcacttaagagctctctactaggttagatcatgaaccatcagttcattgtagaaaaagtaattcaaagtagaaaaaaaaacctactttgtgtgacatttataaggcagtagtatgccttatgtatgagtgaaggcatatctgtaagcttccagaaccttgtcaagaaagctaataaaagccattttcacacacggttcacactgaagcaaaactatttggtcgagggtgaaactcctcttgtttagttgtacagtgacaataactcataaaaatagcacctaaaaacgagtgtgtctgaaagctgtacctgtgtgcttacaggaagtgagagggagaagagagagagggaccagagagggaaaaaggggcagagggggaagagaaagagggagggagaaagagagagggaggaagggaggaagggagaaaaagagagagggagaaaactatttaaaggggcaaggaaaggagagagaaaatggaaactctctctttcagcaatgagactagtggttctttattactgagacaggatcttgttgcacagaccatgttgacttcaaattctccatcttcctgactcggcatctctagttttggggtcacagacacgaagcgggcctattgatagcaggttttaaagtttataattgatcctcacaagccattttgaattcagaggaagaccagtttcagaggttgaggcgccctgtctgatgcgggagaattaacaatatttaaagggtgtggctgtatcctgtcgtcaagcttatcacagacttgagccagattcaatggctatcactgtgaaacaaacagacccttgggtcaggctgggccatcttttatttgtgaccctaagctagacactttgctgctcagttccctcctttgtaaacccagataatgctggtatgtcttctcttcataactgttgggtgattagtaggaaaacccatagaaagtacgcagcgtgtacaggttaggtgctcggccgacagtttcaacagcggccactgatactattctacaagacagactggcaagctgaagaagaaaacagccttgtgacagacagacgctgggagttgcaggtgcacgagccattgtctagaggaaagccagcagtcagttcatggaaaaagacccgggatttggagaagagatacaagagaggctcagcaatgtgaagggtgaaagttgagaggagggctagggtagggtaaaaataagatgggtcccctattgctggggcagggctgccattcgcagcggagggggtcagaagacctggcagaagaggacgctgtttcctgttggcacatggaaggccagggcacagcgatgaaattaccattaagggattgatgcttactgtcaagcatctgtgtaaacaaaaaaggcaaaagatggctccaaaaagattttgtcttcctccccacaggactcccccgcctcccctgcctccaggcttcctctttctcccctgtcttattttcctttcggacgctcgctgttgcataaagcatcactgaaacacacacacacacacacacacacacacacacacacacacacacacacacacatacacgtgtgtgtgtgtgtgtgtgtgtgtgtgtgtgtgtgtgtgtgtgtatggttaactgtctccacaggcaaattcagaagaccaagttgtgtttttttttctttgttggtacacgctgccttcctagtgcctagcatagtgtctagtaaatagtaaaaatgttcagtagatatgggcccaatgagagagaacactattctaagcattcacagtgtgatgacatcaggagatattcttggatgttccatgatgttcatattatgtctaagagactctgttattgcgttgataaattaatacattgttaataattaataagttaatttgaaagtgaatatacgacactgcaactttgtctgtgatgtgcaggcttctgtgagtttatcctcaccaggatttggggcttgacaaaatgtcttcaatcctacaattcaacagttattatttaaggtggggtaaaggtgaccaggaaagatcccaggaggcaaacgctcacacgagtggctgtaacagcacccatggagtgtgtagccaccacatcccacacactgtgtagttttaattaattcatttgttacgcgatgggtctcgctttgtaaccaggggcctcggacttctgaactacccacactaaccttcctctcgctgggatctggagattgtagtaggcattggccacttcaccagactaggcttttattttttatttttaggtttttaatacaatccgtccaggttagatagtaaggaccttgttcttagtcagaagcggagttggattttagaatatgtctggctcgaacccgaacttaccctttctccacacttccaaactgccccgcgcatgcttcaggctgctccctcccaaacggcattgatcagtctgagatgaaggcacgtgagggctctccctgctctgcgggtaaccaaaatatttgcactctgtgctctgagcagatgtgctgggttacagttagcctgtgatgtctgcacccaaaccgatgatccctatcaaggcaacgagttctatcagagcgtgagaagagacagaggaggcctctcctcctcctcctgctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgggggaatgatggttctacagttatgtctgtaagaggaaagggagacagtgtttggtcagggagcctgtggcttgtcacgtattagcaactacaaagaggaaatcatacatgagatttctaagagatttttaatgtttgaaattttaaagaacattttctgcgagtgtaattttacatggaaaatgacatgtcataattaagatcttttaagtagagccaacgctttataatccctatcataaacatctcccaaccagaaggaatttcgtcttaatatgatcacttataacgacgtggagagtcccattagaacagttccagtctgactaacgccctgactagaaaccccaagtattaaaacaggattctgcacacagcccccaccttcagagatctgttttctcaggcagcacttcacaaacacgagtctgtgccaacaaatactcctcattgaaccaaaacaatgttgggtaatgcagcaatgaaaaaaaataaagaagaagaaaagaagagaagagaaaagagaagagaagaaaagaaaagaggtattatacaaactcagagtagaaacagctcagtaaacatcacctgtctgaaggtttccaaaatgtactgttcatcacaaactgtggttattacactagaggcctctcgacaacagctggcagagacctgatgtaagaccagactatgcccaagtgcagaatacagagtcagatgccatattattaagaaaaaaccaaaaaatcccaaaaacactctggatggaaaaccaccaagagctcctttgaccctatcagggagcatttaaaatcaactgaaggtgtttttgagaaagtctttggcttttatttatttatttagacggggggcgggggggctcatgtatctcaggctggttgtgaactcattgtacaatgactctgcaatgtttttttttttttgttttttgttttttgtttttttttaattaactgcttcattttttacagccagttcgtttgtttggtgtgtgtgtgtgtttgtggtggtgggttggtgaaagggtctctctccttttactgggtaggtttcagggatcaaatggagttgcccgtcttggtgatgggtgtctttatcaactcagccatttcactggcccaagtctttgcctcttcactgttggtggtatttgccctggaatctcaggggaggagtgcttgaaactaagacaatggaccacttgccttgtcttactgaccgtccctccttccccacagcggcccagctctgtctggagtgaaaggtttccttcttgcttgccattttgagccaccagtgttccccactccccatctgtccccaggctagactaaagtgtgagaagttatatccagagaggatggctatgtgtgtgcgcttgtctgtcctgctttaaatgtaaggtattgggtcccttcttttcttaccagccccatttatctctgttgagagagagagagagagagagagagagagagagagagagattcctcctggcgagagcaggcttctcagataggaagcatggtcaggaagggaaagaggaactttgcagcccgatgtgggtgctaccttctcggttccttccaggctgagtgggagtgctggggcttgggaaacactcaacccagcctaacccgggagtgtgtgtggccacacgcgtgcagaccatatgcaaaggacgaagcctggagtagctagatcctgctgtggatgtcttgcttcagattcagagcggcagaggcagaagcatctggaggaggaggtttggtccacgagggcagctgactttgcccttctctttcctcccaagagtaggcccagctcactggtaccctgaggaaccccccccccccgcagcctgcattctcccaccccccacaggtagatcattttgaactcttcggctttggagtaccagagctttcagaaactgggtgagaaaaaccgttggtaatgcctttctcaaagcacagttgacgtcagtcttcatctggattgaactggaacggcctggtgaaacccagagggtacatcattgccctgtcacacctgtccctagggtgtcgagatgaaatcagcctggccaaggagagactgcggaggattcactgcacagaccttgctacaggctgcttaagggtggcggtttggtttccttcctccctgtggaaatccaaaggcaaagtgtctatgtgggcttagcacccaggagccagaggaccaccatccccagctcggtaactagtgtcgcttatttgttcctgtgtttggggaacagcctccctctgtagcccaggctggccttgaattcttggtgaacgctgggattacagtattgagcacatgtttacccagtagtgctttgttttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgactgtctcctgctgggctggtggtgaactccgtgtacagctgagttttttttttttttttttacagagactctctgtgaagctctggatgttctagaattctctatgtagaccaggctggccttgaactcaaagaactccacctgctttttgcctcttgagcgctggaattaaaggcaggtgccatcatacctgggaaacctggaacttctgatccttctgaacattgggataacaggtgtgtgccaggaactatggcttttattcagtacggggcacaaacacagggccaggcaagtacgctacccataggctccattctcagcccggaagttaagttcttagttaagtgcttttacttaagcttaagttaaccgagaccagccaggacagtgaaaccgattttcctctcttgtttcatttcctgaaagaatcatcccagtttcaccccctttccttccctcaacaggagggaatggagagagagaaacgatccagaaaggataaaacggtaatcaaacagaaatccagccgtgcagcaaaagccctatttggcctcttgcttgggtaggtttcacaggctcatggagggaaacaaacgcacatgcgcacaggcccctaaacccacacaggcgaaacccctttgtggagaagccagccacaggaaactcacttcggcacaggaacttgctaatcgcttttgtcactttcggagtgttcctctgcctcggtcacctccgacactgaggcccaccaccttgggctggactctgccagtccggtgttgcagcttttccaacagtgactcattgggagccttggggaagagagagagagagagaggtagacctcaggagggactctcagcagtaatagatttgagctacgttagcttttacatggcgtggagagctacttagacttccggagtcagtcattttggtgatgagacttggcattctaccccaggtaagacttttgcctctttaaaaatgttttttcggtgtctcaggaatctctgtgattttgttaagatttttttcttcttctttaggctgaacattgtaatgaccttttttaatttgttgcaaagtgtagactaaactcagagatgggggtgtgttcggccgtctaccccaactctagagtcttaacaagacacactttggttttctttctattttgctttgtttttgttttgagatgaggtcttggatagcctgggctggctgatgtgaagtcaaagatggccttgaattcctgacccttctgcttccacctcccaggtgcaggagttacaggcatgtgccactgagtcttagtttctaaggtattcccatatgttcttggggctgtgtcagagcttgcttgtgtggggactttagacttcatgcagcagtgtttgatgaaggaaatctaagggccctccagcatccacagagagcagctttaaagttatctagctatgtagaaaaaaaaaaatcgaaataaaaaccatatcccagaattcctatctagctattctcaatcccaatggcccctttctgtacatttctagattaaatttagtttctcagcaggtttcatgctgtgcactgccaatagattggctgggctgtaacatccacagcaacaaaagcttgggggaaaatcaccggttttaggtgcttcactaaattaaagttgtgacagatgggttcaagcgaccggatctaagatggtgctgtgcatgagagaagagaaatataaggaaacccgtccttcggtggaccttcaagtctagtagttacagcgaaagatacaggttaggaaacagttgaagaagaagctgggtcacagaagctttaacagctgtagggtttcgagaagggttctgggagtgagctggagtgctcagaaggaaggatgcttataaaggatgggggcttagcaggaagccttaggaaggatgggggcttagcagatggagaaggggaaggttgttgtagacttggagggccatgtggactttccataaagaggagactgactggcctagagactggcccagtggtttaccctctgccggatcagggttagaaagacagggtgtgggccagctggagagatgaatgagaagagactacattctgtagttttaaaccttcttttagccatttgtagagggactcggccagttttgcatccttgggccaccttctgagtgcttaggactgttttgtgataccccttgggcctctagcagtgttccttagtccattgtggatgcagagaaaggcctggggtgggggtcggggggaacctctgtgtctgttttcctatttaaagactttcaatcatctgtctttcttctggggaggttgactaggtggataagcaagtctctgaccttgaagagcttctctttcaaagagagtgagccctttgggccatataacagttgtttccacggacattcccttagagagatagcatgttatagtgattcctggaccatgaaaactggaatctaaaaccatggcaaatgagcaagaacctggagtccaggggcccatgttgaagcttggctctgttatttctgggccatgggaacgtcagacaagtcactgaaattcttcaatgttcctttttgtgttgttattataagagacctttaaataacagtagcaataactgaaaattactccccccaaaggctgcagttgagataaaatatacaaagtgcttaatgtagtgtctagcttacaataaactctcaaaggtcagcccttaggacttgtaaggatttggctatggacaatgggggaaaaaaaaagggcgctgagctggcccaggggcaagctttctacaaacttacctttttaaatacattgttccttttaagggaaattgggggtgacaggtaaagggctgggaatgaactatagaccaaacacagagtttagatattttatagtgttcacatgtgaagaaaagagaacagatttgaaagcaatgttttaagcctttccatgccagctcttccagctggctctgagcatctgcagttgtttgtgagtgtctgtctggaagggtgtctgaaggtagtgggcagaattacagaggttcttggaacccaggacagagaaagatgcttatttcttgaccccatttaagtcaagcaatattacttcagtattttagttgcaatgctagcatgatacagctgagaattcatccctgctccacagttggaatacttttgaccgcgagttattgaagaagtggtttggggtctggatgcttagggccattgaaaacctgggttcaaagcttcctgctttcccttcctctagattgcaggttcatatggatcagaaagcctttttaggagtgcattgtgtagctggtatgctaattatgaagccggttctcaattatgtgtcaaagttgcgaggctctggcgagagatctcggggcagcagccagaaagtgggccatgaatgggaattgagaggcagcatggcaatattagactgaggtgatcagtgagagaaggaagcctttgatggaggggtggggatggggtaccagaagcacctggcctcggtcctcacctgcccagtcacccctgtgactgcttgaatgctctgagcaatctctggacagtctgcactaggaactttcacgctgttctgagatacggatgactgttgtaaggttgactagtctagttttggctggacaccagaaccacatggagaactttatgtgtcttaccatagccctggaaagggcatccaggaatccgtgtgattgaaaatacaagccccaaaatgacatggaaccagtttttttgcataagatgatctgagagccattaaacgaagctttctcctaccccaacaccaaacacgtccccaaacaccagcacggtaaacagtgctggggtgctcctgactgacctctctgtgttgtgattgacatttgtacaccgaagaggattctcctttgtcctgaatttattccttgagatgagtttctgggagtgacatgactggattaagggtatgagcagttttagctcaatcctgttttcataaagggccttctctaatacctctagaccagcggtgctcaaccctcctaacgctgtggccctttcacacacttctgcatgttgtggtgaccccccaaccacaaaactttttcgttgctacttcataaccctaattttgctactgttatgaatcgtaatgtaaatatctgatatgggacccccaaaggggtcatgactcacaggttgagaaccactgctaaagtgttgtatacatgtagagcgatacagtattattctgggagagctcaaagggagagatttactatcaaggagaaagtgtctgatcatttccccctctttctatccctgtagaatggggtgctagtgagtcacttgggaagagatttccagagcataactgatgtgtgatggcttcttctagtgtaagctgggaccttcttatcttgccatttggtttctggtaaaactgaagtcagcagtggcttcttccccatttcctagaaaagaaaaccaaggtcgagtctggtgaggtaacaggcgccaggcttctcactgtatccctggtgaggtaacaggatgcggggttctcactgtacccctgagagctacaagttgtcattcattcagtttattgttgtagcaactgggtagtgtgtgtacatgaccttattcagggaagtagatgtgaaataaatacattcagtgagttggtggttaatcaagtccaaagggacataggattgccctatcgtttttaaatgttttattggttatttgcatataaggctgacagaaatcctcctttgttgaacagacaagaataaggtgaattttcagaacctttcatgagaagaaaaattgcttttgggaagtgacaactgagactcttgctgatgtgtgctagtttgcaagagcagactgtagtatttgcagaagtttcggaagctgctcaagttgctggcgctgttgatctgggtgatggatgctgtgtgactctatgctatgtgaccatctcttcctcatcttcgtggttcagtgatcttgtgtccttagctagaaatcagtcatggaatgtttatttttaccaaagcagcaaacacagcaagctgcttagaacaagatgattaaaagtttgacttctatgctgattttatgatgaatgagaaacttgaaatgaaggcattggggttagagaggtggctcggtggttaaggttactggctgttcttccagtggacacaggttcaattcccagcaactgcatgacagtgtgtaactcaagttctgggggatctgatgccctcacacagacatacatgcagacaaatcaccagtgcacatgaaataaaagtaaaataataataaattatacctggacaattggaaggaaggaaggaaggaaggaaggaagaaagaaagaaagaaagaaagaaagaaagaaagaaagaaagaaaggaaggaaggaaggaaggaaaaaaggcattttgcatgttggaatggtaaaatagaatttatttttacttcatttatagtagctgtgcatgcatgtttttataaactagagaaagtaagaaggtgtggaaatttctagtctggctttgccttgtctctgacctgcatggctggagataagcccttggggcaggacacagtaaagggggtttggatccgggccatgcagtgttgtggaagctgaaggtttcctttggacatctgagaatgtaggaagtactgggctctgaggacgtgttaggtatcccataggctagaagaccaatgccgccataaactaagaccctaaacactttctggacacagtgcttctttgggtagactgagaactaacccacagagaggcttcagtctaagaccaggggagccagagatgctggtgcatgcctgtaatcccagcatttgggaagctgaggcaggaggtttgagagttggaggcaagcttagcttctctgcaagactgtctcagagcaaagcaaaacaaacaaacaagcaagcaaacaaacaaacaaacagcaacaacagcacaaaacaaaacaaaaaacctcacccaacagagccaactagtccagggtccacagtattgaggggagcactgtaataagtgcttagaaaatctttgaacccactcctcacttacagaagaataaagttctgatggggagggagagaaacagcaggactgatgacgacacaatgagaggagacgagagcacgtcctcaggaaaggaaagggtgacggttccagaggccacgagtgtaactagaaataaaaaatgaggatggatactggaaaggataaattcttctgaattgggggctggagagatggctcagtggttcaatccccaccacttacatggcagctcacaactatctgtaacttcctgttccagggggtctggcaccctcatacagacatacatgcagtcaaatcaccaacgtgcatcaaataaatgaattattacaattattctgaatcataggttctcaaatgagtgtgtccaagagtcacatgtgtgtgtatgtgtttgtgtgtgtgcatatgtgtttgtgtgtgtgtatgtgtttgtgtgtgtgtatgtgtgtgtgtgtgtgtgtgtgtgtgtgagagagagagagagagagagagagagagagagagagagaggtgggtgttaataagtacagcatcctaagttgtctccctccatgttttctgttggaaagaggcaggagggaatacacgtatacatttttgataaatctgatgtggatggtcttcaggtaatgttttgtgaaatgctatagattaaaggttatagtttggtttggtctgaggaaacacatactctctgggtctatgtgtttgcgtctctgtcagtttctgtctctgtctgtctgtctctctgatgtgggtgagactgggggctggagactcacaattcaagagcttatcgtgtgaaggtatagaaacagagaaggtaaagacagagttatttgcttgttatagaaagacactaaagccaggaggctgtactcgctacactccttagacagatgcagtgagtaccatggagttacccccccccccacacacacacacaagcaaacagctttgggcaggaatttgaatcatccagggaactttgaaaacccatgaacaccttggttttaaatgacagggaggtcatcattaggaataaacttacatgagagtatggtgagggggttatagcagaaagtattgggaatcttggtgcacgaaaatattatgttaaaggaagagggaaagaataatttttgataaaatggagtaccataaccagagacctgtaacactcacaataataatgacagatatacatcataaaatgaacaggacaggaaatggcacctctgcaataacccgtggtcctgagaccacctggttctgttttcctacctttagaatgtcagtgactgtcactaactctcacatgttcttcttatgctggaaatgagccgttctctccccatattcccatctctcaggtcaggacgtgataaatcaagaacaaactgggagctcatcctcacagcagagccttggcttagggtctgttggctatgaagcatcagaaacctagagtcagacttgtgggagtatttgctcaccatccccatccctgtgtgacctgtgtgttggtgttggcttaagccctggaagagccttcagcctctttctaccccaccatctatcggcctcttctccttcattttaattttccctccctcatccccccccccccattctgacagagtctcactcagtaacctgggggattctggaattcactttatagtctagggaagcctcatggaatgctgagactacaggttgagccaccagcctgagtaggggtgtgtttctttctctcttcttccaaaaaccaatttattttattttatttttattttgtgtgcattggtgttttgccggcatgtatgtttgtgggaggctgtcagatcccctggaactgaagttacagacagttgtgagctgagttgtgagctgccatgtgggttctgggaattgaactcagaacctctggaagagcagccggtgctcttaactgctgcgtcgtttctccagccccgagggacgtttcttaataagttttgggattactgagtcatttgggatctaatgagaagcaaggagctctgagaagaccctatataagaatatggacatttgccgtacagtttgggaatatgcacctagtctttatttaatttctttattttatttaaattctttaaagtcttcttaagattccgtaagtttcacattaagaaccctggcctcagaggctgtcagtagcacaggggaagcattatgggatggaggaaatcccgctctgttctttgtgatctcaggttaaacaaacagactctcccctgatcctgacctgaggacaagatggcggccggcggatgctttagagcatcagagccacaagctgcgctgcgcatgcgctcgagcaggttcctaccaaagagaatgtgcacactgccctaagtccgtccttccgaggcctgtagggagagctgcttcccaaaattccactgaagtatcctatatacaactgggtgtaacctcagagaacaccagagacacagtgacatttgcatacagagaggatcaacacagactacagtgtggagttaccgagtcagggtcagctgacacccccagccaggcggggaaaggtacacagctggcttgtgtgctgtttctgagtgtaagatgtagctttccctttctgtctgtctgtctctgtcatctctgtttctgtgtttctccctttccttctcttgtctgtcttgtctgtgtctgtgtctgtgtctgtgtctgtgtctgtgtctgtgtctgtgtctgtgtctgtgtctgtgtgtgtctatgtgtgcaggcatgctcagtgtgggaattgaacccatggcttcatgtatgcacaaggcaagcactccagaatgggagccagattctccatctaaatagtctttcttccctgaagctgacatggggttgggccttggcagctttggggacagcctttcccctgtacagtcttttgaccacagatgcccctttggccactgtgagtgtgagagcctgtagtctggggaactgtgggtgttggttgaaaactcaagcctcttctagttttttctcagcagagagacacttaccccaaatccacatgctttaaccagccagctttgctgaaagccataagatgatgtcatagggtgggttgcaggtgggggtggggagagggaatcctcaacccttcagagaccaaatatgtgaaactgcctatggatttatgaaatatgagttaagattctctttttctgggagtagtatgagaactgtatacctatctttgaggtagaagatgaaaatctctaacagatgtgttcatgtaaggcgtgtagcctgccttctattactgatttaatcattgtagccctgtggttaggttttatgccaagttctgtttgtatcagagtaataacattgcatcccataatccccgcttacagcccacctcagcttgcactccagaacagactcccggtggtcaggcttatgactggtctgactttacagtggtgctcatagacctgttccacctttccttttcagaataatattccctacgtcacataagatgctcaacactttactatgaaatagtcttcaagttagtgactgtgcccagacacgtgcagatgctagcgttctgagcatgttggtatgggttggataagcaaggatgctaacatgttacctagtggattctcagtaaacagtactttcagttgaggaaggctcatcagaccattgtaggccaaggaacagtctctgtacaccacccactcagcttcatcgctgcccttagctagctggtagagccctttgttactgcaggtgagtagctggctcctctccctccctcctttgtctcccacccctccaggcccgtcttcctgtctcttgagatacctctaaggatgtatacctcaccgtgaatccttttctgcctccttctcttgtatttttttctcagttgccacaagacttcctattagctttattccaactgtgtgctgaaggcaacgcctgccatggtggggaagtctaagaacatgatggatcagccctccttaaaaggaaagggaaagcagatatttaaaatcaaatttaaannnnnnnnnnnnnnnnnnnntgttttgtatcatttgcttttataatacttctcttcagataaagcctgactttcgttagttctagtatctttggacagtaactggctcacttgatgttggtggcatctcttccttctggtcatgctgaggggatagatggcactagatgtctgtacaggaaatgggaggaggtaagccagaaaacccgtacacattggcagtgccacaatttcctctgtctgctaagacaatgttgttatctcgctccagtatctcgattctctggctgtatcagagaaatgtccacagtactgttggctttaagacctaatagtaaatgtaggttcataatagtagtgcccatctgcagtaacaaatgtgacatatgctttttaacacaaggacaccaagaatatgcttttgcatctgtaagatttggtttactgaaatccctattactccagggtcttcactccaaggtgtacagaccccataagggagagtcccaatgttgcttcccagtggaagagaacacccccaccccatgccctgctaactcccagagggagcatttgatttaaagggaagctttggcagtctgtccagtgcctttcttctttttgttatctgtgtctcagggaaagtaattaaaagggaagttgtgtcaatattaatattaaattctagagctgtgaacataatgtggatagcagggaggcctgtataaaatttagatagaaagttccaaaccagattgatggctttggatttccccaagttctgctctctgacttgagaaagacctcttacctgcttgtctgggagaaatgttaatttctcttccaaaaggggtgagatgcctatggtttcaatttaagattagatggctagttttcaatattgtagtcaagaaaaaaaaacccagaattttcaacttaagttcatgtttttgtttgtttgacctgtgacaaactaaccttacattttaagctttttggacatagttgtcctttctttggatgactgaaattcttgcactgcaaatttcttttcaacatgtattgatgctgttttgcagttgaatttgatcatgactgcctagtctcctttttcaacaggtggagagctcaccgtattccccaccagttatggtttctttctttcttttcatttctttgtcaattttgagaatggttgttgtctctgaagtatgcactgcattattcaaacaactaataatcatagcgagatgcagttatggtgtgaaaatcactgtgacattttgaagaaaattgatgctttaaaatctatatatttatattttatcttttaaaattctgaggatcttagattagagatctaaggttcttgggtcttacactttgatatgcacagaaaccacttttaatgaagggtattggagttaataggttggtgagtctatatttttaaagttagagaatttattgctagctgtagagctctgtagctaattttggaatttaagtaaaacaaaattttcaaatgatgaatacagctgaatatttctaatttcatcacatgtcagaaatttcccaaaggaaccatacatatttgattcggtgcatgtgtgtatataggcatatggatttgtgtgtatgtgtgtgctgtgcatgtgtatgtaggcatgtgggtttgtgtatgtatacacatatatgtatacatttaagcatatgtatacatgtgctgtgcatgtgtgtatagacatgtgggtttgtgtgtgcatatgcacatatatgtatatgtttaatcatgtgtatatgtgtgctgtgcatgtgtgtataagcatgtgggtttgtgtgtgtatgcatgcacacacatgtatgtgtttaggtttgtgtgtgtgcatgcacacacatgtgtgtgtttaggtgtgtatgcacattcatgtgtgtgtttaggccagaggttgatgctgggtgccttcccccagcactcttcgccttgtctgttgaggcagcatctcttgcttgaatccagagctcactgatttagctgggctagatggctgtagggatcacttgtctctatatcccgaggccaagattacaggcaggtcactatgcttattgacacctatatgggtgctaggattctagcgatggcatctgtgtgtcgtgtgctttactactgagccacctggccatcccagcagactgatcttctcttcctcatttcctgttacttcttcagctctagtttgaggtatagtagagcatctgcatggtccccagacacacacttgttacttctccaggcctttgcactttcccctcttttggttttgtgaaactcctctccagcttgtattcggtgcgcctcctgtgtgccacttgagtggtttcagccattggcagtcttcattgcttcctcgctaatctttaatatccttctctggagtccagcttcctccatacgtctttaatggggtcctcacctgagcatctcatttccagtctggtttcttctttgatgcacctacttaattggcgcatctcctgtctccatttgtttcttccccagcagcagaatctgtatcttgtccgcacagtcagccaaatcccaggcaagctgggactactgtgaccagtgagtgctgtatataaagcaagtaactaagaaaagttgtttaaacaagataagatgcacagtaaactcagtggacaaaatggaagccataggtggttggaacactgttctacaccctactttatttgtgtcttaatatagttacgtctaccatcatgggtatagctcacggctacataaaactctaaagctctaagctgggtgtggtggttcacatttataatctcagcatttgagaagctgcgaccggaggattgttgtgagttcaaggctatagggaacacacacacacacacacacacacacacacacacacacacacgagtgctagacagcctggctagagtaaaaacccgttcacctgctctgtcctgcctcccagttcttgcccctctatgggaagagatggtgggatggtgagatgacataatgctcagctttggtccaattaacagtgaatgcaatcagaggctatacattttccttattgccttggccagtaggtctataaatttggggtattttctaccatatgagactattgtgaagagaaaatgagctaacacgaaagtgcctgcatcatggtctagaactttctagacactgaataaatagtgtagtgtgtaacagccgggcttatggacttggatgtttaaatgggctgaaattccttgttttactgtgtctgcttctaaaagaatagttatctctgaggagtacttgtttaaaagaaatgtcatttaatgccataggcaggttctagaaaatgtttccttaatttagtcactgtgtagacttcataaaatgtactgacataaatcaagtcagctacgaaactggacatggtgacatagcttgtaattgcaggagaccgcggtgggagaattttaagtcaagacctatctgggctagagtgagttcaaagcctgcctggacagcttagtttaaatccctggctcaaaaataaaaatataaaaataaaaataaaaaaaaatgagatgaaaacaaagagagctgagggcaaagctcagtggtagaatgcctacctcgcttgttcagatctctaggttccatcttcagtacggggtaggagtgggggcagcgatggcatcacagatgctataatgtgatggagccattgttgggtatgcagcccattatggacagatgtgcagggcatagatgtatttctaggtactgaaataaatagcacacacccctcctaggtcctcctggcattttgacctgggatgaaatcctcttgtttcacaccatgataaaactaagtccagaagatggtaacttgctcctggtgaccaagcagaatttaatccatttgttctctgtatgcaggcaggccttgacattgccccagcagcccagcttcagccggctggtggtctgggctctagattaggttcccctttctaacttaactaggggtgttatagcttgcaaataaaataccagggaccagctaaaactgaatttcagatagagaactagtgatatctttactaaacaagtatcccatgaccaccaattaaaaaaaataaattgttttggaggaaaaaaatagaaaaatgaataggtaagggaatatcagatgttaattatgctgtcggcacgctgtttctgttggccttgcgaatgtgcctttaaagggtggaaaaggactctggaagagtgaggatattgttgtcgtcattgttttttaagttgttttattccaaaaatgttagtacagctaaagacaagcaacttgcgaagtgaggctggagtggaagagaatgacggataagggcacgtagatatttgaagatgccacaaggaagctctttcctgtgtgtgctaaactgaaaaatcaatacgaaatatggggctggcaagatggctccgtgggtaaaaaggcacctgaaaaaaagtctgatgatctgagttcaatccccaggacccacatggtacgagtagggcattggccacaagataaacaaacaaataaataaatgtaattaaaaattcattactagaataccatgaaaaaactgtccttgatttttcatttttaaaatttctaggctaagccgggcagtggtggcacacacctttaagcccagcacttggaaggcagaggcaggcagatatctgagtttgaggccagcctggtctacagagtgagttccaggatagccaggaacacacagagaaacactgtctcaaagaacaaacaatccttctaggatatgtcaagtccccccagcccttgacgttttggagacagtttaaaggtcagttgtgactggtttgctataggggtactcaaatggggagtgttcagaaatggaatcgggaagcggtctcctggtgccccattcttgtgtatttatttgcatggttcacgtgggtaatttttttcttccagtgagattggctttgaggagagcatgggaccagaagtacagtggactgtgaaaaagacttgaccttctacctcattaatggagggccacctaggcaggaggtaccttctcgtaaggtggtcccctcctggatacttgatgcaacctctttttctcctcctctttggggtatctgattagattctggtctgtaatccttaaaaaaaaccgaggggcccagaatattctgctctgtgcacaaaatagcagtgataaggcagccaaggagaccctggaattcatccaggagaggacacataaagaaggaagatgataacaggctttcatgtgatggagagaggaagcccctgaatcatgtgcctcgtggggcacagaggagggaaaggactctgcctgctcaagatgaaccccagatagcagggatgctttggaccttgtttctgaaaaatgccatgtgtggttctcactgctctagtacctgaacacaaatacacacacacacacacacacgcacgcacgcacgcacgcacacacacgcgcgcacgcatgcacgaacgcaaacgcacacgcacacgcacaagcatgcgcacgcacacacataccctcatttaacttggaccaagttagaaatgaaacagaagatcccattgaaaagtttttaggtgtactctttgggtaagacttattcatacaaaacagcaacaacaacaacaacaacaaagtctctgaaataaataagcccatcatgggatatgcttgggagggcctggagcaatatgttccagggcatagtgtactgtagcatcctgatcagaggtgataagaggcaagaattccacgtggttcctaagagcagtgactgctcttagcagtgcagccctgtgtttctctgttgggatagtctctcttctagttcctctgtgttagaagcctgagtgcacaaaacacagaatactggggagactgcttgattcgtcactgtagcaatattgcattaatgcaaattattgaatatcctcagtggatatggggtgaatgggtagggtggcatttttttgtaatgtctgtagtctgtctgttactataataaaatacctgaggttaggtaaggctgcccgctttctctcaaactgaagcatggataattgggaaggttctccttacatagcaggagtctcagaaatgggggatcaggacatcactaatttgaacagcaaagccacctctcttcaacttttgtcactcctgctttcagtggcagcacatatactggtatgatttttaaatgattttgtgtgctctgtattgccttcgaaaagttatttgcctggattttccagcggacggggcagtgctgaagaggatgggagatggtcatgtccctgtggtcacgtccctgggcttgtccaaagccatttttctagcccatcccaccctgactcaagtctcctgtgccatacttccttgaaagtgactgtccagctgggcgaggtggcaagtgtctttaatgcctgcagaagaggaaggagggcagcatagtcaaggataccaaggtggggaaaggtaggagggtttggggatagccagtcaatgctgtagacacagaccagaagagactggaatgcagagagaaggcacctgcaatgctaaatcaggccaggaatctcctgtgtcacccccagcctctgcttcagacactatctccacccacctatgcatgctttcccttatgctagcctgaactaagggctatgtcctctgtttggacaaggtccactctcctcttgtcctttctactccaggatctagttcaaatggtaccctcaggatctcacacattaacattttcttcgttaccttctgtccccattagaccaagtttaggttaaagtcaattaaaggtagatggttctaatttttcagacttctgtgaatgtttaagttaatgttaatagagcattatatatgtataagcaatacattaagccattaaaagaagaaaagaagagccctacacagaggtgccccagtgtctttatgggtgctataacttcgtgtctcagtctcttgaccttttcagctgagcatcagggagacatttaattgcatagctgtggactatatctgtgatgcaatccatataaaaaggacttgtgtctgtgttccaaaggaaggtataaaacttaagacagcgtcaggatctcgtgttctcacctgactcttctcttacttagaggatttaaggatcaggcaatttaaggtttggcagccatgcacctatcagatttgctctccagaggggcaagggtaaggtgaggtaaggacctccagcaggctgcagtggccacttactgatgagagcaagggcttttacctacgtatgtcttttgctctgcctggctcagcgttcttttggacaagggaagttggctctcattagggccactgggttgtatctacacatttagttttatatgaatgggaaggaagaatcctttaccaagccaagaacttgcttctgcgtgtatagtgtttactgctgggcagtgcacaaagagtgatttgactttctccgtgtgtgtgtgtgtgtgtgtgtgtgtgtgcctgccctgtgacagctctattgtgtggttatggcattgttagtctaatcactccctcttcatggaccattcactttagtgtacttatttattgtgttgctgttacaagatctgcagcaatggacattatcacctgcctctactacatgcgtgaatattccagcacagtgtgttcagataatggatctgctggttagaaagtgtttgcatttaaacttttggtagatatagaaaaagtggggtgaacaaggtaataaggtagagagtcctcttggctgatcactgtgctctggcagtgatgaagtcagactgagttcttttctttcttgctcctctcttctcttttctcctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtcccaaactcatgtcaatcctcctgcctcagtactctcaagtgttggcattacggatgggtgccaccatgcctgtctgagtaagttctttatagtgtgtgcagattcagaattccctgatgagaacagggcagccgtagtgacaaagaagcagatctagagttacctgagtccttgtcttccagaggacctcttgaaattttgtattttaattaattctgactgataagtgttccacccctgtctcctcggatgctagtggccaccagcctgagaggacaaagcgaacagggtttggaaggctgagtgtggcagagtgacctccagagacattgcaacgaagtgagtctactttattgtttcagaaatagggtgtgtaaagggtcagttaggggtgtgggtggaaagggccaattggacatagcttcaatcaaacaggaagggatggttggctatgatacagcagctaattatcatgcgggtgggaagcaggccgtgtttgctgggctatacagcattgtagagagctttgtacaaggtcacttctcagccaaagcccagtcaaggccagccacctgtgttcagggacactctccagacaaagacaggtagagacagggaagagaggaagttgagggaggaagcccccccattttacaccgagctcagaaagccatccagtcatggggggactgacaacttaataacaggctctccaacagggaagaacaagtcttagtgcatatataaactatgttactgaatgtaagtaagattttgggactgaagtgtatcttataacttagtggcaatgagattgaatcaagagcatggttgttcttagaaacagctttgtcacatggaggagtgttcagccctgtctaatacacatccactgagttttgtccaacaacatttatcaaaaacaacagatcttttgtttttgttgtttctctctaccggggattgaacccagggccttatgctggcaagaggttatattagtgagcccccactgctgccaacaacaacaacaacaacaacaacaagaaaaaagaacagaaaagaaatctgttttgtgtttggtgtttggaataaggaagaaatcactcacacactgcagaatgtcattttgttatttcctctccacactgccgttattttttatcttagtcttattaaggttataggggtaggcaggcctaacccaagagagaacaggaaactggaggggacagagagactgatgttggtctcctcagctcactgctggtgtctagaccccagcggtctacctcactagcgtgtcatcttgggcaatgctcattacatctctgtgtcttatttactgtcccctttgtaaactgcagggacagtggagctgacagcagggtacagttgccatcaaatgaggcagtttttgtaaagcgcttaaaacagcgtctggcaagtgctggtgttttataattctttgccaaaggtcgagcattcagcttggtgtgggataatagcatcctctcagatgactcagaagtcatgtaggctcccagttatcctgcatgctttgtggccccagttctgtgactcacctaaggttatgttattgatcagcaggttatgttattgatcagctgaagagcctccgcacctgggtcctccacagattcctgatgttagatgttctcactaaccaaaatcacggctctcttctcagggcgaagaggcccgccttcttcatcatttaaatatgccaagagttaagagtttatcctaattctaaaggacttatggtaacgattacctgaaaaagaaatgatctgtctaaaaagtatgtcacaagaaagagaatagctgtttggagaaataatttcatattagaattgggagcaactttctgagtgaaaaaggtcacttttgtgaggtagaatctttcccctggagagatgcgggggacttggttaatttagaatgaatgatttggaggcattagctagctttatgagctctgtgcttaaatatgaaagaaaagtcagggagcatttgaaacatgcccagccgatggaaaatgtgctgactcagcaggttccattctgggtgtggaagtcggtcgcagctgagctgctttctgtaactcttggcttccttgtgggggaagtgagtgggttgacgctgatgaccttttggtcctttcaacacactgaatttgtttccacagtggggggacttgttaccctacagactagaggttgttcagtatgagggagcaccagtaatcaggggaatttccatatgggcacaccatatgtattaaacaaatattggcaatgcatttaatcaagaaaagagttaatatcctcccatccctaagaagaatttttaaaagtctttaagaaacgatgaccatctcgtttggctgggaaaagctgaagacttaggaaattttaaaaagggcctggatatagttggctcacatttcactgagacacaaagcaggttggactggaatcacaaggtttttattttagtatccttaaccggggtggtggcttccacctggaggggacatgctctgagctcctgcctgtttgtctcagtcacttgtcacctgatgtcccaacagcattcctccaaacactttacgaagtcattagagcagtcaggcagtgtaacacaggcctgtaagcacagtacttgggaggccgagacaggaggattgtgggcttaaggcaaattattattggtgatgcttacaataaaagaccccgctgtttaaaaccttacaacttattatttttttaatctatttgttggggacaggaagtcactgcatatgctacgctaggttgtgtgtgtgtagaggcctcaggacatcttatgggagtgagttctctcctctggacatgtggattcccggatcaaactcaggttgtcagacttgatggcagatgtcttcacccacgaagccacctcaccaatctgtttttaaaataatgtttaatttaaaatttttgaattaaacacaaaaacagaaaggaaacttacattctttcacatatccaacactcaacttcgatatgtcttcagttgtttaaaaatctttctttattccatgtgtactgatgcttgtggcctgtatgtatgcgtgaacgtctgtgctgagagtgtcgaatcctcccggagagggagacatttggtgagctgccacatgggtgctgagaattgaagctgggtcctctggaagagtagacagagttcttaaccacggagccatctctccagcttgctttccagtcttatttcattcatcaccctcttttctcacttgctgtcactgttttctagagagatataagcatttgtatttatttcacttacaaatgggtcaccatctctgttagataaggatacacacatgtgcctgcacatgcaagaacatgtgtgtgcatgtgcactgaacatcccttgtctaaattgcttggaacaaaaatattttaaatagtgaatattttagactggaatatttgcataggtatgatgataaatgttggtaataggacccaagtttaaatatgaaagtcattaacatttcacatataattcatatatacataacagaaggtaataatagacggtatctttaaataattttgtgcatggacagaatttccctggtgtgaaatcttcaatgtaagattatgttgatacaaagtttcagactctgggccacccggatggctcagccggtgacctgagttcagtgcctggaacccacaagatgggaggagagactcaacttgggcaagtcttcctctgatccataaacagcacacgccatgcactctgcctccctacaagtaaatacacgtgaggagctaaacacagtttctgattttgtattttcaccttggcgatgaaaacaacaagattgtcacccaacaaagccagcaatggcttctttgtgccacttaatacacaggtgcgattccaatttctttgactatataaaacaagccagcaagcaaacaaaccaaaccaaaccctgtgtaagcaggaagggcgagggaggctgggtggaacgcacccgtgataatctgtcactggaggcagcggctcactttcctatgtcttcttccaaaaggagaaagtaagattgatagtttaaaaaggaaccaaaaattagagtgagtgcttccaggagacttaagcaaatctagttgtccagagctagattattttaagatcaaagacactggtatacctctcataaatttattttttggggttgggtggggggattaaatctagagacacacatgctacgtgagtgatgcaccacgaggctatatcctcaacccggaaactttgtttctttcaagggtccagttcagcctttcctttcctttcaaagcccaaactaaaggaacagtgacccgtatagagaggaacagtgacccgtatagagaggaacagtgacccgtatagagaggaacagtgacccgtatagagaggaacagtgacccgtatagagcacttctttggaactgcacaggttggtggttagggatgtagctcagcaggtgatgtttgcctcacaagtgcaagactctggggtttgatctccagcaaaacacacacacacacacacacacacacacacacacacacacgcacacacacttagacaaatcacacaagtcaagcatgcctattttagtaattgtatcttaaatacacataaacaaaatgaaggaaaggagattcacctatagtcgcaggtcccaggaacaacccaccatggccccgtcaagcaacacgtcggaaagctacatggtgcagcatagataacgtagattagaggagcctgctctccgttgtagagaactctgcagagggtcctccccatctgaggccggccttataaaagattctcaagggagaaaccacagctaactgctagtgttccagtgatttctccagcttcaatgcaaattcccaaataaaccaaggatgaaggaaattacatataatattcattgcttattaatttctttcccttccacacctttgggatcattactatcttcaattgtacttttgctgtttcaatttaacaccttctgttatttattttattttattttattttattttattttattttattttatttgagacaggttttctctgtgtgtagccctggctgtcctggaactcactctgtagaccaggctgacctcgaactcagagatcctcctgccactgttttctaagtgcggggactaaaggtgtttgccaccactgctgggttctccactgttattttaaaggatctcaattacaggaagaaactagtttatctgatagctcactattcttagatgaagcctgttattttaaacagcataaaaaaaaaaaaaagagtgcagtcctagttagaaattgaatgtcacaaagttcctgcgaaggtcctcgctgtcatgtgtcttccgccatgttgggtaaaggataacctcacacctgtgatttctccagctcattggtggagaccagactgaagtgcccacctcttcctgggtgtggcttggtctagggatagtataagaactcatgacttggagactttggatgcagacgtgtgggaagccttgggtttggaaggtgatgctcattctgttttagtgtcactgtgatgaggttaaatgcaccttggatttaggaatgcaaagcttgcttagacccttggccctggagcacacattaacagttgcagcaggtaccttgccaaggtgagtcctgagcaggatctgactggaacggaggccatctgtgtacagaaaataaactgacaagcgaatgtatgctcttttttattttgaaagggaatttcatgactgtttgtagcattgagcagcatagtagggctgaaccattcaagtaggattgagaattagtgaaattaaataggataaaatagaatttaaggtaaagactttgctgggcagtggtggcccatgcctttgatcccatcacttgggaggcagagtcaggtgcatctctgagttcaaggccagcctggtctacagagtgagttccaggatagccagggctacaagtttggggcagggcagtggggggaacgaaataccaaacaaacaacaacaacaaaagaaaataaaagagaagagaaaaagcaagataaagacaatatttatttacatttttcatcatttttcatgcacatggtgtatcctgtccatgcacgccctgccaggtccctaccacctctgtctgccccacccccacaaatgtttctttcctgttcatgtctacttattttgttttgtggcccactgagtttcaccaggactgtgtgaccatgaattgggagttgtctcgtgaagcccgggggcttagcagtgggtataaaactgaagaaggcaactctctcctctccagaggcaaccaatagccaacagttcagcagtaacggttagagtcctggggaccccttctatttctatgactgattgttagtagagaggcctgaactgccgaactgttgtggtctcatctttttgggaggtcagagggggagcacatgctcccatgcctctgtagcccaggctagcctggaactcacagcaaccctcctgcctcagcctcatcatagcgctaggcttacaagcacaaactgctgtacacggagggggcagtgcttgtgtaaagttacctccaccaaagcctccactcaaaaccctccacacagttacaattcaaggtttgtttttaaataggatgtactctgaaggggctttgctttacagggcaaaatgagagcagttctctatgtcaacgtgtggtaagtgcagcaggaactagcagccacctttgctctagagctggtcctcacgcggaaatagcgatctggttctattttacaaatggggctaactgttttagctgtgtgccaattctggcatcaagtaaacacagagggaactatggggacaacacagagcaactgagagagcatgtagaagtagcaatgggagatgcagggtcaagaaagatgtttgaaaaggggtgagtgagggacaggttcccggccactagagaatcagtttgtctatggaagggtcgtagtgagaatcagtctgtctgtgccagctgagagttgtgtggtaaatgttagtcctcggaggaagaggacaaaaatacctcgtgccccaagttctctctctgcctccttttgttcctttgtcagagtagaccgaaggaccagcttgtcccttggagctctctctcatgtgactctgtgtctgaactgtggaggcctgcagaaggtgccgtgccccctttcacagaaacagtaggaatagagcaaagggaaatcaagctacgagatgagactcagacgcactgggacgggaggttcattcattccagaccgaagagccagagaggcagcttaactgcctaacactaagggggttccttaaaacatcaccagaggacattgaagtaactcttcccagtggagagccccacagaggacacctggctggttagacacactgctcaaaactcacttttattttcctcccacaaaccgtagaagggataacgtccttctttaagagaaatttcactgaaagtccgtcagcctacatgctgcctgtgtgggccacagtggctctccccagggtgcatgtgacaagtgctgggcactgaagatcatgtctatatagggtgttgctctagcctgaactgctgtgttctcttccactcccccagctccatatatggccatctgctgaggcctggcccctcacttcacctttcagaactgtgcatgggggttggttcttgtgctaccaccaggtcaggcaataaaggctttcctttgccttcgtctcagggaggccaccaagaaagcctgccacgcctcactgtttacagcatgggcaactgaagccctgggtgtgtcattctttgacagtggacttctgtgggaaggccaacgcactcagaacagagcctttttctcctgtctggcatttcttttgatatctatgggggacacatctcagcatttctttattccggtactatcttatttttatgctataagaagaaatttcttgtctttttttttaaatctcatttctatgagatctctttagagaggtttcaagttcctcgtgtgaatgagtaatcgcttgtcattatatttagtaatgactgctcgcccgtgtcgctgatcatgcgtgctttgtgtttatatacatatatacacacattttgttcgtgggatgtgttaagccaagggtttaagcccacaggggactctcaacaaccatgtgagacaggtattaggacgttggtttttactaggaagaaactgagatattgtgaggctaagaaactgtttgaatatgcccatacaggttgctaattagacacttcggattccattctaacgctacctgcccccttttctcccagtccttttttcctttattctttcttttctttctttctttctttctttctttctttctttctttctttctttcttccttccttccttccttccttccttccttccttcctttctttctctttctttctctttctttctctctttctttctttctttctttctttctttctttcttcctttctttttttttgagacagggtttctctgtgtagccctggctgtcctggaactcactctatagaccaggctgactttgaattcaaagatcagctgcctctgcctgctgagtgctgggattaaaggtgtgcgacgacatctgagggatgttcttttataggtattcactcaggaaccctggccataaatccgttagaaataacccacaagtctgatccatgaaccactttactaattctgtcctgctacactggcaggaaaaattaaagaatgtggtctcatctgtaaacaaggtcacacattcatgtttaggctgtctataggtctaaggagcttatgtctaactgaaatattatggagcccttctgtcaaagatctggtgacaaatgggtgtccaggccatcctgcgtgagcgtgtcccacatgtgtggcattgcagccgctatgccagggacattcaaggttgggcatctttagtgtaaaagcagagaacatgatggatctccatacaactcatttttagaggaaaccaagattcggacacgttaagtaactttgcctcggccacatagcttatgtgtaagaagacggaattcataaaaatcatgtgttatttatttaactcatttgcaaaggctatcacgtctaattaaacagaaactgcaagttggcaaggatataaaaagtctttggaggaatccttagggctaagaagggtgatttgaacccttgcccttcacaggaatccgccttgggtgtgctttatgtgggataagcgtgacaattgctgtcgggaggtgaagaaagccaattacaccgaccacctttactctaaacgttggtctcagacacctttcgtttgactgaagtgaggctggccttgggagaatgtacgcatcggagagcatactgtgtacaagtctgaactctccgcttggcactctcaaacccacaaacaattgagaatctcttctcccctttataaaattcgggtcctgccatctttgggcagtcctgtttaaaagttggtgttgaacataattgctttcaagcaagtagttttgtttaactaggggcctgctctgcagatgactggcccatattgttgaagagagaaataacttagtctccacatctttaaactcattacaggcttacatgcttgtaaaccgagtattagagtttaagcaacaagtcagtgcctacacacagcagcataggtcacagacccgctttcagctgtggagaacaagaactccacagagcatcttccccatctgcagccaaccttaacaaagaatctcgagggagaaaccactgcacttgttatgccggtccagtgatttctcctgcttcggtgccaattcctacggaaaccaaggactggatggctactcaatgagagaaggaaattatatatggcatttgtcgctcattaatttgtcttccttgcagttcccaaagtggctgagatctatgagaacctgaggccacgcacgcccagctgcctttgccaggctgcctgcccgcttcttggccagtcaagagctgttcacgagtcattcgcacaccaggtgggcatcggaggctttttccatgtggcagtcagaacggttccttgtgttattatcagacttgtcctttttgcctcctcctctcccctctcctctctcccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctttttctgttccagttggcacccaaacttcagtaggtttcccaagcggtcactgtttctcacctgggcagactggagaggtacgatctgtaactggtgtctgaggttctgagcacataagccctggttgccgtttccttactctatggaactgctacagtagcccattgagcccttgagggttctttcccttgggagcctggactcttcagtaggacttcagacaaggaaagatgctgagctcaatcaagtgcgtgctggtaggggacagtgctgtggggaaaacctcactgttggtgcgcttcacctctgagaccttcccggaggcctacaaacccacggtgtacgagaatacgggtgtagacgtcttcatggatggcatccagatcagcctgggtctctgggacactgccggcaacgacgccttcagaagtatccggcccctgtcctaccagcaggcagacgtggtactgatgtgctactctgtggccaaccataactcgttcctgaacttgaagaacaaatggattagtgagatcaggagcaacctacccctgtaccccggtgctggttgtggccacacagacggaccagagagaggtgggacctcacagggcttcctgcatcaatgccatagaagggaagagacttgcccaggatgtgagagccaagggctacctggagtgctcagccctcagcaaccggggagtacagcaggtatttgaatgtgctgtccgaacagctgtcaaccaggccaggaggcgaaacagaaggaagctgttctccatcaatgaatgcaagatcttctaaaccccaaggtcctgtgcccaacattcatgaatgtatgaatgtacctcagagactcataggagaggggaaagggcaagccaagaggactgatgctctgtcttgaaacatctgaacaagctttctgcatggggttatgagggagtctgccgctgctgcttccactaactctactctgcagaagaactctgtgcccagcacaaccagagagattccttgggaagccatatgagtagtccatcttcaatgagagactaaaacaaccatcctaatttagacaatgaagtgcatttcccaactatgccatatttaaatccacatcttatttaaataataaccaaatatcgagctcttgttttcatgctttggaagtcttttctttgaaaaggcaaactgctgtatgaggagaaaataaccttgtggggttcaaccatatgtctgtggcgttattgttactcctgaatttaatttggttggaactactttgtgtgctgtgtttttttctagctcatcagactttccaatgaccataaactgatctctgtaattcatcttccatttccctgttattcagagttgtgtataaaatacagctctggcccagaaggtattttaacactgccaaatgactttctctgtaattacaaaagaaaatttcttctttacgatattacctgtcactcagagaactccagttgcacaccaagtgttcctttctcactcattaagacagagatggaaagaaaaaaaaatctttcatctcgagagtcacatggatgctgttgagggaccccttctccttgcctgtgtcatctgacatgtacttcctgattggttacaggtctcgggaaaagagggcaggcaagtgttgttataaataatagttaattggctggcacaaccccatcatttattaattttaagactgaatcaaagcaattagaaaggcgcctatatagcatgcctgtgtatatgtataagggaaaaggcagtgtttatgacttttactgtttcatgaatagatacgcacttgtgaaaaaaattacagatctcaggttcagagaatgagtaagtctccctactcagataataaagagtcgttgggaaatactaactcaatagggaggtgtgcatatatgcaatcctccttcctgattgtatgaaagtgatagtgtcgatcaccttttctttttttttctttttttttggtttttcgagacagggcttctgtatagccctggctgtcctggaactcactttgtaaaccaggctggcctcgagctcagaaatccacctgcccctgcctcccgagtgctgggattaaaggcgtgtgccaccacgcccagcttcgatcaccttttctacaccctgatgtatcatttgtagttccaatctgataactgggaacacttgtagcgcctttcttggagcccagcactgtagaggggttgtatggctgtcatcatgaagagtgaggagcctgcaggagcaaccctactgtggattatactgacataagcaagtcagcttgtcacacggattctctggctgactctctgtggatacagtctgttaaacatatcctaggacgcctcccccaccctccatgctgttttctcctctgtctgtctctctcccaagctcagtcacaagcctggaacctgggtcttggtctgggtagaagaagcacttgccatttcccagggctaataggtgtgctgtcagctaatctctcagccttctggttctgcggctggaccacctccgtcccttgccttgagagctcatgtcttctgttcacggcactgggcatcctgaaggttggaatgagcagacagaggaggagacagggactatgtcttccaggtccctcatgtccctctgattctctcctcattctccaacacacaaaggattttgtgtttatttttcttttggagtgtgtgtatacactcttattgctgtaaattgaaacttttttttttctcctcacattgttgcccaggatgacctcagacttgcaatggtgctcctgtctcagcctctccggtgctgtgacgataggtgtgagctactaggcctacgaaaggtctttcataacaaacccggcttcaagtttaatctgtggaatagtttaaaacacactgaagaaattaatttctacacactcagttctacacactcagtaggctgtcccttaatgcttttctttctattgaagggaggtagggttggggagcatctaaccgtgggaaggccccagggaggaagaggaagtttcatgctggagacaggaggggaggccatcgaggctgctgatagacctgagtgaggtttgcctgttgacaggagccggtggtaaagctcctttaaggaaggaagcctcacactggagggcagaaattcaagtgtgaagcctccttcatgtgcacctggtggaaactgagccaggcagggcctttcttctctgtgtccctgaggctatgctgcctcatagttcactccgtgtcctcagggcccagcgcagggaagaaaccatagctagatgaagttgtgtgagaggaaggaagagattgatcttcacgggtctgtaggtttagctttgcacacatccatgaaggtgtaggagacttccccttcaataggtggtgctttttgtatgcttcaccttcaagtgtcccaagtagcaaaattacagatgctcatgtttccataagaaagtggatttaagtggttaagttcatttgttctggcctaagcagaatcccagaggctgggaagtctgggatcaggtgtcagcacagtcaagctcagtggaaggacctcttcatctgattggtggcttcttgctatgtcctcatgtgtgtggtgggagtttgatctattctcataagagccttcgtgccatctgtgaaggtcccgcctttctgaccacgttatctcttaatcctatcacagttgatcaggcctcagaggagcagtttgagggggaagggacccacattccctcacgccagtgcttttctgtcttactttattcagcctagctaaatagggcaacagaataggttggccccatacaatgggttaggtgacaagatgacaaaaaaagcatcccgatggtgcaagtatgtcgagcacttcagatagctgggcactgtgttaagctcttgtgtggtatgtaagtggctcacacgagcaacttggccctcagcatgttaatgggacaagcccgagccatacagtgggtgagtatcagaactcctaagtctggagcaggtctgtgtggctccaaagctctactcaaaaccatcatggcccacttcctccctgagcagttacctgcatggctttgccacatctgatatcccatagctgcaggcctctccccctactagtcaaagggcttgtatttaaaagatggtggtgatgatgatgatggtggtggtgatggtggtgatgatgattttggcttgttcatttgttactgttgttgctgttttgagaaaggatcttgctatgaccttaaactcatggtgctctttctgtcttatattatccagtgctggcgttataggcacacatcaccacacacaacttaaaaggttatttttatttattgttttgcattttactggttatcaaaatcaaggcctcttgaataccaggcaagtgccccaccctgagctatgcccccagccccaaaagattgtttttaaataaaatattctaagtctaatctccctcttccccttttgctgttatttctggtaatgaggctatgctctagtaactcacccagtatcatctattgcaggattcctatctccaccctgggattttcagtgtaatttcctgcttgtgactgcttgtgtgagaagaggcagacacgaaatccagctcaacttcatgctttcaacagcttggaaaaattctgatttcttgttatctcactcttaaggtctcacatattccctgaatgagcaacaggggagaggagagcctgactctgcccttttgagaatttgatacccagtaagggcactttatgcagcctgagatgtggtagaagcattccagtttggcagatctgtggtgttataaagagacagggggtggggggaggtgggggtgtgtggggggcagcagacctctgtgagtgtcggtccccagggttagaaggcagtcctttggggttgagtaacttcaacatagctctgtgacaggacttaccaatcctcagatgctgtctctttggatgaggtaaagaaatacaatctcgctgggcgtggtggcgcacgcctttaatcccagcactcgggaggcagaggcagacggatttttgagtttgaggccagcctggtttacaaagtgagttccaggacagccagggctacacagagaaaccctgtctcaaaaaaaaaaaaaaaaaaaaaaaaaaaaaaaacaatctccagccaagatctccaacagcttttgtcaagataacaacaaggcatagtagctacatgtgctgggagctcatgaaggcccatgactagacctactgtctgaattatatattgatataaaactcagtgctatgtaaaaagtcataaataatgaaagagtaagaagttcgacagtgaacactttggagtcaggaaatctgagttgaatgtcttacatcccgaattccctcttcttaaaacataggtcctatgtttctagaacattctatagagggattcaataatcattgtgggagaactttgtgcctgtaaacttttgttcagtcacattattgtgtgtctgctggatccctgtgccgaaatctctaatcagatcagaattttctagaggtttcatcatgtgggcaacatgacgggaaacccacacagaagcagattctgcttataatattgtcaactaaagcaaggtggataatgacacatagagtaataaaaatagcaacaaactccatctgaatgcctactgtctccaggcctgtgtcagcactttagatacctcagcacacatgtgtatacacacacacacacacacacacaggatgtggtgggttagtattattttgctgagtttcagacatctacatagagatgtttcttttcacagtcacttttcaaatgtcccagttgaccatctaatttccatacccataaacttggcctgctaagttatatgaccaatgatgttcagtggccattatggttgctagtttagacaacatgaccgttccctgtcacacacgggagtgcatgctgccagttagtgcttagcagtcttcctgagtgacctgccttctgtcattctttctgtaactttctcaggtgagcataccctgccctgacaggctctgtttgctctctacatttctgttgtccactgtttctgccttccaggcttgtccatgcacccagcatcccagatttcttcctagctgtttctgctctcgaagggctctctccttttacccattatcccttggtgctgtctgtctacaatgaccccatgggaccccatggttggggctccagctgtagcttcctctggtctctgagatggcatttcctctcctggtcttcagccctaaagaaggctgaggtcagcaccccagtggggtctgtttatggaggtctctcaagcattgttttcattcacatcttttcgttgaaccacacaggatgaatttgacttcttgctggactctggatgacatgcacactaaatagtaacttatctgtatgttctggtgtttgctgttcaaatccccactggtaggtgagggtaggcggtgtgggtaactaactgcccttccctgagccacaaaatccaaaacaaaaccacacacctcatccatctgccatgactagaaaggaggacttgattaactagtacgatggctctgggggagaaatgttacacaagatgagttttccatgacacagtcaatgctgaagaaactgtcagtctgcatggtgcatcaagagggactagcagccaagcagagaagcatttcaacttaaagagagatatttgacctcaacaccaccgtgcttatctaggatcctgtgctgaggcaggaggatcaaaagtctgagctgagactggggaatatattcagaccctgtctaaagaaataaaaggctatttcttagttgagaaactacatttagccaatgaacaagagaaaatatgctaatcatatacctactcatcatagacctgttgcaaaacccatccatgacatacctttttcaaaccaccatatcagcaaaagaatttaaaggtatgataatgccaagcatcggtgggggcgtgaagcagtgggagggcctgcatgctgccgatggagtgtgattggtatagcttctgtctttgcttaggacatcagggtatcttatactggtgaacccttgtccccaaatccaggcccagagataagcttacatagatttccaggaagacacaagtaagagcgcttggtagcatggcaggtaatggcgaagctggagacaagacaatgtcacgatcagacgaaggccaattaagttttggggaactcacacatagaccacaaggaagcacaggaaaggaatgatctatagctgcatattgcaacatgaatgagtgtagacaaatgtgagggagaaaaatgtgaataaaaaataacgtagacttattccatttctatgacattcaaatgtgagcaaaacttaacatttagggttaaaggcattttaaagaatagaatagaactcaagtaagtggttacctcttttttatgagaccacggagtatgaatgtacaaggccaccagaggtgtgacatatattggacaccttcttaaatttggaaaatcagtaactgagtgtttgttgggatttttcttttattatctagccttcaaaaattcttacacattttttctgcatacacacacacacacacacacacacacacacactgtcactgtcttcagacacaccagaagggcatcagattacagatggttgtgaaccaccatagttaatgggaattgaacacaggacctctagaagagcagtcaatgctcttagccagtgaactatctctccagcctctttatctgcttttaaaagtatggtataattaataacttaaaatattattgagaagttggagtctaaggtcaaattcccatatctgaagcccggctctgccacccctgagctccccagcctcgtgtgagtggactaacctctttgtgtgtcgtgttcctcatagcgtggagcaggtaaaatgaaatcatagacttgtgagcgctatcagctaagacagcaaggccttactaagcctggtgcccagtaaatgcccaagaaacagcatgtgtgacatctgattatcatgtcttttgtgggtgaggacaccaagtctttggcagatcacagactcacgagctggcaagcctggaccctctcagtctcccaaccaacttgagaggttgactcctgtgctctatgaacagacaaagaccctgaggggcttaccatatcatgtgcctatcattatctatctccatttcatggtggccttcttagccccagactatgcaaatagccaacgttcctgattttgtggtattcacctctagttaggaatgggtgggcagacagtatttgtatgaagaagtaagatcaagggaggagagcgatctgtgcaaagaatagaacaaactgggagaagggagagagccttcccttggtgtctgggttgtgcaaacaggcctaactgaagaggaggtgagtgaccagacgtacctgtgttgccattttgaaataaacagcccctctggaagagaaagcctgctggagaaggatgcacaggtgttacattaattagtgttcgatgctgcagagcctttcacaggagggaaggattttcctggggtctgctgcggtctgcccacctgtgaggaagccctgactggggctgtctgcagtgggggttagcaaacagcctacagtagcacagttcgcagaagcagaacacagcctagagctcctgccagccggtcgtttctaacggattctgaacaaaaggaaggaaatgactagaactcaggatggaggagatagggctcagagccaagaccacagagtgatgctgagaagcagcgaggccacaccctccagagcccaccccttgaagcagctggactcgttcacccttgtggcagggctgtgatagacaggcatatggtgaggtctagaactttcacatggactgaaacagactggagttaattcaagtgcatcactggcattaacttcagggcagctgggcctgtcatcttgggaatttcctgaggagagccttgaattaatcgctgtacatgtgtcgtgtacttatgtctcaattccatcttgtcccacgcccctgtttttatctcctcttcctctcatcatccctatccacaaccgggtacccatcttagccatctgaaacggtagatgctggcctctgtggtgtgtgtgtgtgtgtgtgtgtgtgtgtgtgtgagagagagagagagagagagagagagagagagagagagagagagggagagagagagagagagagaagggggggtctcaagggaggagtgaggattgaaaaaagaagaaaaacaattagacaaccttataacatgactccagtcagtgctgaggcagaggaaggcttatttttctccagcctgcttttatgtcattttaggtacacccccccccccaaaaaaaggtcagtttttagatcaaagacaaagaaatcaagcaaagtagtaaacaaggagatcacacaagatagtaattaagtagccgggtgtgttggtgcacgcctttaatcccagcactcgggaggcagaggcaggtggatttctgagttcgaggccagcctggtctacagagtgagttccaggacagccagggctacacagagaaaccctgtctcaaaaaacaaaacaaaagatagtaaagtagtgagcaaaaggatcacacaaggtaataattacttaaaacagtccagccccgcgctagtggtctctgatattcttatctggacctacttccttgtccgagactagtagcaaaggccaaattcctagaagcagcaccaaatctctccgcgggtgtgcggtctgccgcagcacctgcttgcttcgtttctgcctaagtgttacccgtggaaaggtcagcacacaaggtttgggagtcctttttgctttctaccatgcttgaggcaggatcttttagaatactacaaactagcaggcccttgggcttccagagattctcctgccctgtctctggtcttgctgtaggagccccaggactacaaacacactctattgcatccgtactggctggttttgtgttaacttgacacaagctagagtcatcagaggggagagagccttggttgaggaaataacctctattacagctgaatctaatgagacccagctgtaaggcatcttctcagtttgtgatccatttgtggttggggacatccctgggctggtggtcctgggtcatctaagaaagcaggctgagcaagacatggaaagcaagccattaagcagcacccctccatggcttctgcatcaactcctacctccagggtcctgccctgcttgagttcctgtcctgacttcctctggcgatgaacagcagtgtgggcgtgtcggctggatgagacccctgtcctccccaacttgcttttggtcgtggtgttttgtctccgcaataggaaccctgcctaaaacagcatctgactttattatgtgggtccaagagatccaatctcaagttgttagccatctccttggccagaagcctgtttctctccctgtaatcattgtctttccccaacgactcctgggatgctcgtagatgcctctgaagtgcttttccaggtcttatcttaaggacggcaggatcggccagcacctaggactgggtgcacggtcttccatgacctcagcgcagccctgcagctagtcttactgggtcactttgcaggcaggcactttgagctagggctcaggaagcttgaatgactcatccatgcgctgtaactcatgctcacagaagcagactttatgcttatttctctcgaccccaattcccctcctccaccctctgccagcacactaaagatgctctgggagtggggtgaggtgacacggcttggccaggtgggactcataattattgaccagaaacaaggtgtgctaactcgagtaagctgggagacgggaccctcagctgaagcactgcttctgtctcattggcttgtgggcatgccggtctgcagggcagtttcttgattgttgattgatatgcaagagtcctatccagtgtgggtggtgctacccctgggcaggcaatcctgggagatttaagaaaggtcactaaatgtgaatctaacagtaagcagcactcttcgaggtctctgtttcagttcctgcctctggttcctgcctgtcgctgttgctctgacttccctcaatggtgtaagctgaagtaaatgtcttcttccctcactttgtgttttagcatagcaacaggaagcaaactgggacgtgaggtctcctgtccta

SEQ ID NO: 1634 - DNA, 2399 bp, Mus musculus
gactctctgtgaagctctggatgttctagaattctctatgtagaccaggctggccttgaactcaaagaactccacctgctttttgcctcttgagcgctggaattaaaggcaggtgccatcatacctgggaaacctggaacttctgatccttctgaacattgggataacaggtgtgtgccaggaactatggcttttattcagtacggggcacaaacacagggccaggcaagtacgctacccataggctccattctcagcccggaagttaagttcttagttaagtgcttttacttaagcttaagttaaccgagaccagccaggacagtgaaaccgattttcctctcttgtttcatttcctgaaagaatcatcccagtttcaccccctttccttccctcaacaggagggaatggagagagagaaacgatccagaaaggataaaacggtaatcaaacagaaatccagccgtgcagcaaaagccctatttggcctcttgcttgggtaggtttcacaggctcatggagggaaacaaacgcacatgcgcacaggcccctaaacccacacaggcgaaacccctttgtggagaagccagccacaggaaactcacttcggcacaggaacttgctaatcgcttttgtcactttcggagtgttcctctgcctcggtcacctccgacactgaggcccaccaccttgggctggactctgccagtccggtgttgcagcttttccaacagtgactcattgggagccttggggaagagagagagagagagaggtagacctcaggagggactctcagcagtaatagatttgagctacgttagcttttacatggcgtggagagctacttagacttccggagtcagtcattttggtgatgagacttggcattctaccccagttcccaaagtggctgagatctatgagaacctgaggccacgcacgcccagctgcctttgccaggctgcctgcccgcttcttggccagtcaagagctgttcacgagtcattcgcacaccagttggcacccaaacttcagtaggtttcccaagcggtcactgtttctcacctgggcagactggagaggtacgatctgtaactggtgtctgaggttctgagcacataagccctggttgccgtttccttactctatggaactgctacagtagcccattgagcccttgagggttctttcccttgggagcctggactcttcagtaggacttcagacaaggaaagatgctgagctcaatcaagtgcgtgctggtaggggacagtgctgtggggaaaacctcactgttggtgcgcttcacctctgagaccttcccggaggcctacaaacccacggtgtacgagaatacgggtgtagacgtcttcatggatggcatccagatcagcctgggtctctgggacactgccggcaacgacgccttcagaagtatccggcccctgtcctaccagcaggcagacgtggtactgatgtgctactctgtggccaaccataactcgttcctgaacttgaagaacaaatggattagtgagatcaggagcaacctacccctgtaccccggtgctggttgtggccacacagacggaccagagagagaagggaagagacttgcccaggatgtgagagccaagggctacctggagtgctcagccctcagcaaccggggagtacagcaggtatttgaatgtgctgtccgaacagctgtcaaccaggccaggaggcgaaacagaaggaagctgttctccatcaatgaatgcaagatcttctaaaccccaaggtcctgtgcccaacattcatgaatgtatgaatgtacctcagagactcataggagaggggaaagggcaagccaagaggactgatgctctgtcttgaaacatctgaacaagctttctgcatggggttatgagggagtctgccgctgctgcttccactaactctactctgcagaagaactctgtgcccagcacaaccagagagattccttgggaagccatatgagtagtccatcttcaatgagagactaaaacaaccatcctaatttagacaatgaagtgcatttcccaactatgccatatttaaatccacatcttatttaaataataaccaaatatcgagctcttgttttcatgctttggaagtcttttctttgaaaaggcaaactgctgtatgaggagaaaataaccttgtggggttcaaccatatgtctgtggcgttattgttactcctgaatttaatttggttggaactactttgtgtgctgtgtttttttctagctcatcagactttccaatgaccataaactgatctctgtaattcatcttccatttccctgttattcagagttgtgtataaaatacagctctggcccagaaggtattttaacactgcca

SEQ ID NO: 1635 - protein, 185 aa, Mus musculus
DFRQGKMLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWISEIRSNLPLYPGAGCGHTDGPEREGKRLAQDVRAKGYLECSALSNRGVQQVFECAVRTAVNQARRRNRRKLFSINECKIF

SEQ ID NO: 1636 - DNA, 73771 bp, Homo sapiens
  misc_feature (1)...(73771): n = A,T,C or G
cttgaaacttccccaactttctgttcgtttcttccggatagcaattcagtgctactgttgtcatcccttcttctcaaaacattttcgatactagctcatcttgtagattaacatatcaattaggattagattaaattgtatgtgacagaaaacccccaagcaatggtgggctgtgcaagatagaagttggtttttccctactgtgcaaatgaaactgagaggtaggtgctccaaggctggtatggcagcaatgtcatcttcagggacttggctttcttctctcttgttcctccgagctcaactcgcggctttcatttcacagttcaaggtggctgctcaaacttaagtaagcacttaagaaggaaaggacaaagaagtccgggtgcggtggctcacgcctgttagtcccagcactttgggaggctaaggcaggcagatcacctgaggtcaggagttcaagaccagcctggccaacatggtgaaaccccgtctctactaaaaaatacaaaaattagccgagcatggtggcacacaccggtagtcccaactactatggaggctgaggcatgacaattgcttgaacccaggtggcggaggttgcagtgagctgagatcatgctactgcactccagcctgtgcaacagagcaagactctgtctccaaaaaagagaaaggacaaagaagagagtacttcttcccattaaagacattcctgggattgcctggaggttgcttacaccccattacccaggacttagccacatgactacattcagctgaaaagaagattgggaaaaataacctttattattggctacagtgctcagttgaaaattatgttctgttgctaaggaaacggattttgggggatagtcagcagtctctaacacaactaacagtgttttaccttgcatacagtaaaggcttttcaggctgatacaagaacatgcgcagagacaggaaaaggtgttcatgtgcttcgaacaggacatgggtgaaagatcaggctagaaagagaggcagatgccacgttaggaaaggctttgagggtcaggctgagaagtttccttttgtcctgtaggcagtagggagccaaatagatccttgtatttggtataaatccttccagggatgtaagctaattgcttgtctgagttcattttatttatttatttattttgagacagggtctcactttgtcacccaggctggagtgcagtggcgggaacacagctcactgcagtctccacctcccaggctcaagcgatcctcccacctcagtgcccaagaagctgagactacaggtgcacgccaccatgccgggctaaaattttttttttgtagagacgaggtttcgccatgttgcccaggctggtccatttaatatatatatacatatgtatagagagacagagtcttgttctgttgcccagactggagtgcagtggctggatctcagctcaatggaacctctgcctcccaggttcaagcgattctcctgtctcagcctcccaagtagctgggattacaggcacctgtcaccacgcccagctaatgtttgcatttttagtagagacggggtttcaccatgttggccaggctggtcttgaacttctgacctcaggtgatctgcccacctcagcctcccaatgtgctgggattacagacatgagccaccatgcgtggccccatttaatattttttaatataaaaattgtgtaagttccaacatttagaaaatagaggaatgtataaaaccaaccatgttaccctaagacaattcctgttagtggtttggctttgcttcctcatagtctttggaaacactgttgtagtcataatgcacagatacaatcccaagtcctgtttctctttttgcacgtaaccttgtatcatgagcatctccttatgtggtcacatgatcttcccaaatactattttcaaatgaccgtgtgtaacatcccagtaagataatctaccaatcatttctatacagtattctacatttttggccatttaggttgggtattggctaaactactttttacattttttttttttttttgagacggcgtctggctctgtcgcccaggctggagtgcagtggcgcgatctctgctcactgcaagctccgcctcccgggtttacgccattctcctgcctcagcctcccgagtagctgggactacaggagcccgctaccgtgcccagctaatttttttgtatttttagtagagacggggtttcaccatgttagccaggatggtctcgaccttctgacctcgtgatccgcccgcctcggcctcccaaagtgccgggattacaggcgtgagccactgcgaccggcctactttttacattttataagaggttggtagcttcaacgtcataagctttttgttatttgttactatatcattagaagacagtcaagtattagagtaatgaactgtggcttaggtaagacatttatctcacataataaaaagtaagaggtggtaagtgagtcaacaatgccaggcttctgctgtgtctctctgcagttttttgggtttctttgcttgtcctcagggctgctgcaaccttcaaggcatctaattctccacggctacacccaaagcatgtaaggaagacgggtgctcctgcccgtgtctactttaactggtgaggaggacctctcccaggagcaagcaagactttcccgaacatttcgttgatgaggactgggtcacacagccactcatagctgcaggggaagctgagaagcaggaatcagaagattctttttcagtcttagacatcatgattcaccccctggaacagaacattttgtccatctcaaaatagaggttctttagcaaggaagaagacatgactatcgggcaggtagtcatctatgttaaacgtgggacttactgtggagacaaagaaaaccacaaaaatggttttcagattaagttctcagaagcttccctgtatggctgcacgggctagaatggagaaacaggccctcaaaatgcagcactggacttcacattatttttttttctttacaatgaaacttcatctgcctttttttttttaaataaaaaattcccagcaaagcaaaaaactgaagtgaaaccaaatacattagagaatcactgaagagaataaactatatgagtacagctctttattaaaaatagattgtaatgtttatttttctgattatagagttaatccttactgatcattaaaaatctgcagagtacaaaaaattaaagaaaaaagtgaaaaaattatctccaattttaccattcagagacagtcactattactatcgggtctaattatttgttgcctttcagacgtgaaaaatttttttcatattaaattgagatttgggctgggcatggtggctcatgcctgtaatcccagcactttgggaggccgaggcaggtggatcatcaaagatcaggagttcgagactagcctggccaacatggagaaaccccatctctactgaaaacacaaaaattatctgggcgtggtggcacacatttgtaatcccagctgctcgggaggctgaggcgtaagaatcgcttgaacctgggaggcggaggttgcagtgagccgacattgcgccactgcactccagcctgggcaacagagcaagactctgtctcaaaaaataaataaataaataaataaataaaataaaaaataaattgggattttactgtacagatagtttaattttatagcttactctttgtaataataaatccatgtccctttaaaaataacagtttttctctatttttttcaggtctcccttccattcgacgtgtgcctcttgttgtcctgtaatgaattaatttgaaaagtaatttgtcttctgtaaggggaaatgctgtagaagtaaattgattcagggagtccccttactcattggctgtgtggccttatgtaagttgcttaacctttctgaacttcacttttctcatttacaaagtgaagatgttgctaataatagcaatagtggtttttgctgttttatggttttcttgtgataaatgataatataaaaggctattgtaaattgaatttgaaagaaaaaaatttaaagttaaaagaaaacttagtaatgtgaataccctttcaaagtatttttagaaatctcattattgtatatttagaagattaaaagacaagaatcagagaacaaaaacaattttattttctattttgaataataaatactatagagataggtttgctcaaaattgtaaagcttgttttgtttttggtaaacatttgagaacttaaacttattatttggaaaaaaacattttaatagaaattttactttttaaaaggtttatgtggtttttaaaaaaagcaaaaaacatttgtttatgactaatcttgaaattttatatgtaatttaaaatgccatgtaagcaggaaggtactcatttaggagaaattacaaaactacttccttttcttttaaatgattaaaaaaatgcacagctacaataatttaggtaataataataataatgagaacgcagcaggcttagtttgaaaccagaccttgcaatccttgactgcacttgtcacaaacatgttttcctctaatgatcctcaagcatttcccactacctctttctttttgagcacagacactgaattaattacccagaaacctcacttttttatttttgagtactcctttatcttcccatgagaagagaaagctactgagattgcccaggatgtgtttcccaggtataatttccattttaagggaaagttaagacaggccttttaagaggtttgatgcaaaagcctctggaatcccttgtttttggagtctgtctggaagtttgaattggcattgggttggaatcctctaaatatgatcctatgtaagctgagtaatgaggaagatgactttgctatgcttagctgtggttcagtgattctcccctgagaatcaactgctataaaaatcactggttattatgtaaaacattgtgaccgaagcagtgacaagggtttatagagaaaacttaggtagacttgctcaatgaaattaagaaaaataaaaaaggaacaacaacttttcatctggttcatctaaatgatagatgctcattacagaacatttgggaaatatgtggctgggcagcatggctcatgcctgaaatactcacttgcccactgctcacctcctgctgtgcggcccagttcctaacaggccacgggtgggtactggtctgcagccccaggactggggacccctgacctagaggttgcctctataaacattggcatgtgtgtatacaacaagttgaatccaaattcgttttgtaacctgcttttttcacttaacagtatattgtgagcatgttcccatgtcattaaagattttttgatttgcagtgagctgatattgtctgcttcctaggactgagccaccaggatcaaagaaaggaaatcattgccttcaagaagaacatggttgactcgtgcccatacttgtctctctttcattgagcccatgactatttttcctgataagtcatgccaactggtgtcaagtctcatctggatgacatattttgttgttgtcactgttgttttttatctatgggcccaattgcaatttataaataagtactcattttcacacagatattttaagctggttcttttcatgataattgcatcagtaataaagtgaatgaaattcacaattttacttcactgactcaacatttatcatttatcttaagcagggaatactaccaagacaagaaattaattggtgaggaagaagggatatgctaatctgaatctggcctcccaaagctttagccagattattcctgatttgccaataggtcaactataaaatttctcttgaagtaaggaaaacttaaggagtgtgctgtgttctggtaagctgattttcttgaccatttttaatactgtaaatggaatctttaaaaacaaacaaacaaagcctacattcatccaaagccaaaaatctgtacacattctggacatttgtgcaaaaaaaaatttaaatggctacatgtaattaaaacgacactggtcatttactttccaactcaggacataccctgacttccttgtgttggttatatgtcactatatgacacagttatttatttatttttaaaattgttctatttttttgtagagatggggtcttgctatgttgcccaggctggtctcaaactcctgggctcaagtgatcctcccaccttggcctcccaaagcactaggattacaagcgtgagccactgtgcccagcctaagatgcattttattcacttaagagagctaacctgttcagattatgaattgacaagtcatatcaattctagttttgagtgacttccagaagacaatcacacacctcatctataaatcagcatatgtctgtaacatcttccaaaactcaggagggcagatgaaagccattctcacacatgtcgttcacatcatcagcagaaactgtgcgttagtgggtggaattccttttgcttagttgtatgatggtgatagctaataaaaatggcatttaaaaatgaatgtctaaaacttgggctaacccaggaaattacaggcatcttaggaataaaaagacaaaaagagacaaagaactgttctttaaaagtgcaaggaacagagtgagggcaaaggaaaaggtttcttctggaggagggaggaaaaacaacaacaacaaaagaaaatgtttcttcttttttggatgagaataatagtagcctttgaagtttcaaattgatctttgtcaatgagccatttggaattcaggatcaggcaaaccagcttgagaggctggggtactcacttagtggagagaccaaacaagtaatatttaaatgatgtagccacagcctgaagtcaaggataccaaagatattggcaaaagtcaaccggctaccatcataaagatgtgcaaaggtagactatggaatcacaggctgtgctgtttattgcccatgtggccctgagcaagatacttaatctctctgtgcctcagtttcctcctttgcaaatggagataacagtggtacctacctcataattattgggatgattaagtgggaaaatgcatataaagtgcttaactgggccggatgcagtggctcacacctgcaatcccagcactttgagaggctgaggcaggcggatcccttgagcccaggattttccgaccagcctgggcaacatagggaaacccgactctacaaaaagtacaaaaattagctgggcggggtggtgtgtgcctgtggttccagctactcaggaggctgaggttgggaggatcacctgagcctgggaggcgcaggttgcaatgagctgagatggcgccagtgcactcgggcctgggtgacagagtgagactccatctcaaaaaaaaaaaaaaaaaaaaaagtgctttactgactaatgtagtgcctaataaatggtaaggcagtgtgaccattattatgaaattatcagtatgctctgattacaaagatcaagggaggccgggtgcagtggctcatgcctgtaatcccaacattttgggaggccgaggcgggtggatcacctgaggtcaggagtttgagaccagcctggccaatatggcaaaaccccgtctctactaaaaatacaaaaaattagccgggcatggtggtgtgtgcctttaattccagctactcaggaggctgaggcaagagaatcgcttgaacctgggagggggaggttgcagtgagccacgattgcgccactgcactccagcctggcgccagagcgggactctgtctcaaacacaaaacaaaacaaaacaaaacaaaacaaaacaaaacaaaacaccatcaagggagcagagaataacaagctgaagaagaaagcagcatggtggtgctgcgtcttgaaaaagctcctacaaccctacaaccctggaattttccactaggtacttggctctggttatagttctctctccatggcagtctgtgatggaaaagactttcaaagattcagagaagagactcagaaaggactcagaagggtggaggactgagcagtgaagtggaggaatggggctgagagatgagcaccaacttggcccccgagtaaagctgcgtgatcagcttctcccgctcgcaggtatgggcagaataggaagcggactgtgcatcagcaaggaggagccaggacttggtgatacctgatgatcattaaacctacggatttacgccgatgataaagaccattgaacattatggcgaggcgcggtggctcacgcctgtaatcccagcactctgggaggctgaggggggcagatcacctaaggtcaggagtttgagaccagtctggcctacatgctgaaaccccatctctactaaaaatacaaaaattagctgggcatggtggtaggcccctgtaatcccagctacttaggaggctgaggcaggagaatcgcttgaacccgggaggtggaggttgcagtgagcagagattgtgctgctgcactccagcctgggcgacatggggagaggggagagtctgtctcaaacacacacacacacacagacacatacacacacacacacacacaaacataaaataagaccattgaacattaaaatggctttaggatattttttaaaagactttacatttttcgtctttctatgaaggactttcctgaccatcctttttaaatatgcaccctccaagttttctatcccccttccttactttgcttttcttcttagtaattagctcactgtaacatattctactactagagtttcatattcattgcttgtcttcctaatacgtagatataaactcaggcgagcaggctatttctgttcttgttgttcgctgctgtctccctggcacctagccgagtgctcaataagtattatagcaagtgttcagtaaatatttgttgaatgaaaggataaattctcatttatcttagggcatttgtaacggggcaaccagatggcttcaggaggcacctctgaagattctgcattgctcagattatgcataaggaataaaatgtcattaacaatttgattttaaattttctgtgtccttttaactcattgtgacaataaacacatgacattagaatcctctgagtgatgtgtgagtttctgtgactttattccacgtgaatttgggccctgccaaagcttctcaaatttttcaattcaacagttgttatttaaagagggggtacggatggagggggaaaaaaactccagaaagcaaaaatccaaaagaggagtggctaataacagccactgtgtattgagcattcactgtattccaagcatgagtcaggttttttttttttttttttaaatagaactcttccaagctagatattatacctgttttgcagttgggtagatcggggcctcatccttagtaataagtggagccgggattcgaatcttgctttgtctgaatccaaatgtatactttctccaaaatttcagattgcctttcagtttaagcttcaacctgttccctccagaacagtgaggagatctgttactttgaaaagatggcaaattaacactcggtctgccctgccttacaactgaaatgtttgcaacgcccgctgtgagcagatgtgctgggttgcagttaccctgtgatgtttgtgctcaaactgaagatccctatcaatgcaacgagtaaggcatgagtttgagaagaagcagtgatcaccttcttcttcactcttcacgctgatgaatttctacatcactgtgcatgtcctgtgctttgcagtcattccctaggagctcgggcccttgacccaaagatactgctcttactaacactacattttaaactcctcctctggactcactctcagagcctgccgcacaatctttaaaaactttgtcaatgattgcaaaatctttttccttttagagtggatttgattttaggagacagccattcggagctacatccagtgaataaggtgggttaaaaagccatatactattttgagtcaaaaacaagttgtgaacagaatgcagatactggttttgttttgtagtttattaagctgtctctcaaggatattgtaaaaagggtctaaatgcactttgactcatgtctgtgatgttgcaaaagcgcatcaactatcgagggactgctttgaagggaaacggtcatttgactacatttgctctgctctgacagactttttagaaaaagttgtatcataactttagagccacagcttgaattattactttgggtgctatcatcttccgcaacaagactctgtcttcttatgaattatggctctgcaataaaacgaaccaggatgtgaatgtttgctagatcaacacagtaatccagggcaaacaaaccagaataaacatggcagctgagaatcctgagaaccgaatattcactgaaacaaaaagcaatatgttatgatacattaacatatttaaagagaaaataaatgatgagaataacagcaggggaaatgatgtttttatggttatggcaataagagggaagctagaagatgtttcaaatgctattatctggttagggaggctggttttttttttttaataatgaattaaaatgcataaagaggaaatcacccatgagatttctagcctgtggcattttgaagctatttcaatattcagcatttaaaaagtattttatatgaatgtatttttacactaaaagttacatcagaattaagatcattctcttaacattttatagttcccatcatgaaatctctcaatcagaaagaaaggatattttgttttaatacagttgttcatcatccagtggggagctgggtgagaataattgcaatacgactaatggcctgagtttgaaattcaaagccttcagacaaggttttagtacatattacctatcttcacaactcactgaaatattttattaggtggcataaatgagggtctgtgtaaacattaaaagctacccactgaatctacatcatttctgttaatatgctaatagcaagggggagggaaaggcatcttactaacccagcgttgaaataatttagtagatgactcaagtctcaaggtttctaagatttactattcatacaattacaattgtcattaagagttttcgctggcgtaagtggcacaacacctttgcaatgagcaaacatagtacttatgcatgagttcagggtacacaagtagttgtcatattatttaaaaaacctcaataaaagaggtctttgttcacaggagaatattaaagtaagctgttcttttgccatatcagagaacatttctgatgaaggtggttttgagaaagtaagtctttgctttttcaccttgacctgaaggggaccgtttgcacagggaatcctggagggggcatgtttagggccaagaaaatgggccttggggctctggctgctcctcgttgcccacggtggttcagttctctctgtggggaggcagcgggagtgacagccaggacagatgaatggggtgaatcttggttctggttttcttaggccatagggtcttatgcaaatcatttaaccagctgaagtctctgtttccttggctgttaaaatagggtttaaagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttggtgagtgctctggccgtgttaacacgacgtgctatggagcccttgggagggcacctcactgggcttgcaatggaggtgggtggtggctacagatggcttcctggaagatggctcagaggggggctctgattcccagttacgaactgtggacccatggtttccctcctcctgccactctgaagtccccaggatttctcccaaccccatcccaaggacagactgcacagcgtcagaagggacacgccctggggcttgggtgcgtgtatgtctgtgaatgtttgcatgtattttcagcgtttgcttcctcccctcaccactacccctgtcggttaaaagtctgttaaaagaatgagagcgagagagagagagagagagagagagagaggagaggaggggcggggtgggggaggaggggagtggggagagagaaagagagaaacaccaaaaagacattttcaaggaaggaagaaaattagatggcaaccccctgtcccctccccctaagaaaatcctctctgagattaaactgtgtgaagattagaggcgtgtaggtcaggagcaggaggaagcccaacgctggactgtaccagatcatctaaaactggcaattccaggcacagaaaaccagttcttcagaagcagaagggtggtcagccagggggtgaaagggacaggggtctcgcagccaggtatgacaatgcccttcctagtcctttccaggatggggtgggacacacccagtccatcctgactctggagtacgtctccactttcgtgcagaaaatggtacaaggcctgaggcctggagctcgttataaatcatgctggtggcgtttcttgctttgtttcccaaagggcagagcctcatctccccttctacttaggagatggaggggatctgtccatacaggcagctgtccttgtctgactcctctgctttctgaaggggagacattgtcccccttaaaggacactggatctcctgttggaggggcaaccaattttgaactctttgcctctttaaatcttttagaaacttggatgagagaaactttttatcctgaattttctgaagcatatctgaagtcatttttctttattattattattattattattttttaggctgacgtctcactctgttgcccaggctggagtgcagtggtatgatcttgcctcactacaacctctgcctactgggttcaagcaattatcctgcctcagcctctcgagtagctgggattacaggcatgagctaccgtgcctggctaatttttgtatttttagaagagacggggtttcaccatgttggccaggctggtctcgaactcctgacctcaagcgatctgccctcctcggcctcccaaagttttgggattataggcgtgagccacagcactcggcctattgtcattgttattattagtattattttagagactgggtgtcgctatgttgctcaggctggtcttggactcctgggctcaaacaattcgcctgcctcggcctcccaaagtgtggggattataggcgtgagccactgcgcccggcccatgaagtcatttttcatctctggataaaactggaacatcaaagtggtgctgtggggtggcacattcttactaatctcctgctgcactctccctgccgcacaccctggagttgcttttagtaaactcttcggtgagatgcaatcagcatatatggaggaacagcgtaaggaaccacctcacggacttgtggctggctgcgtggagtctaaacatggtgtttcacttcagccgtgttgtcttctctatgggaatccagggggcaaagtttctctttaatctcagcactggggagccaggaagacctcatgattctgagctatgtgtttatgtttctcccgcgggcaatgagctttctgtgtggtgatatttcctgcttcataccagttgctgaagagcatagaaccacgtggcatacattctctgtaattaacctcacccccagttttagtgtcatttttgtcttcacttctcttggcctcattttcaaatttcttgtttttaattgtttcattttgctaaggtgtaagtatttttgccagatgctctaaatcctttgatgaacaaaaccagaagtagataaagaaaatatccacaagcttatgttctgctcagctgataacatcaccatggtgatctggctttccacagaggattttccctttctttcctttctttcttttccttccttccttccttccttccttccttccttccttccttccttccttccttccttccttccttccctccccttctcttccttttccttcccttccctccttctgtctgtccctctctctcttttttcgagacagggtcttgctgtgtccccaggctggagtgtggtggtggatcacagctcactgcaacctcaacctcatgggttcaagcaatcctcctgcctcggactcctgagtagctgggactacaggtgtggttgcccagctaatttttgtagagatgggatctcactacgttgcccaggctggtcccgaactcctaggttcaagcaatgctccccgctcagcctcctaaagtgctggcattacaggtgtgagccaccgccactgcacctggcctcccacagaggattttctaggagataatgtgctcttcagaaggctcgaggatctcagctggcagattgagttcttactgtgcattaacaaattgacacatgggttcatgtggaagtcttgtgaacttggtaattgggtgtctattgataagaatgctcaccttgtaccattgattccctctacaactatgctgcaagcacagtcatctgctttcacttctttgaacatgccaacctctttcccacctcagggcctttgcacatactatttgcctctacgtggaatgttctttcctccttctcatccattagagtggcagcagtactttagaataatcagaggggtttaaaataatattgatgtccggtcccaacccagctcaattaaactcaaatctttgagtgtggggccgatgcactgataaaataaaataaaaggcatggagttgactttatccttacggtcggcaggtattttgaccaagctatcaccgtgagcagtagcatcaacagttagttattcagggatttggggcacaggcggttgtgaccacatcacaaaagttcaatttgttgggttaggcgtttagccataacctaagtagttgcagatggtctctacacctggattgcccattaggacaaaacaagtaaacttgtgtttttaggcaaataatgaaactctgaggagtctgaaaaaacaactcatcgccaggtaactcccagcccaggtgctcgtccatacaggggtgaacgcacggcagggggctgctcgaactctcactaagcctgcctctgttctttgcaaaatatttgatagtttttaatgcagcaaagcgaagcagacaatccacctcttgttttccccaagctgatggggggaaagttctaaggtgttgtttcctaagctcaaattaaccaagattggtcagtggcatggactttttttttttttttttttggtaattttacttccatgaggaatcatttggactcttcagtcttcctttcttcagttttacgtagggctttgctggaggaaaatggggctaagggggagagaaacatagtctcggagtagggtgggggataaattaaacgcaaacccagcggtgcggcaaaggccttattctgcctctgatctggggaagtttcatattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttgggcattctgcaacaggtaaggattttgcttccttaaaagtatttctttggtgtcaaaagaaatttttctaattttatttagcttttactctaggccaaacatcgtaatgactctgagctacctgctgtaaggtgtagaatcaatttatagggggacgggggtcgggggggtgagtgttgctttgatattcactgcccctcaccacagtcctaacaagatttttgaaacatgaaaagttacaatagttggctttttggttttccagatattctagagaatgcatatgcttgtgactgtggctgagctcaactgtatgggtagtttaaatactacccaaggtttgatgaagtaaatctaaagatgctctaagttgtgcaaatatgaattttaaagttgtctagttcagaaaagaaacagaaccgaagtctaaatgatgtagatttcaatctggaatttctagcttgtgtttttcacctattgccaatgttaatgaccatttcccaaaagtgctctatgatgtataacatgtattttttaattaaatttaatctttcttctgaggtggtttgatttggagatatgctacgaggtaccagtcagtagcctgagttgtaactaaacaaagtttgggaaatcaccggttttaggtgctttactaaatgaaagttgccattgacgtattcaagcaggcaacaagtagttggtgtccccttattggttctaagctggtgccgtggaggatataagagaaatattttaaaaatctctactttgaaggaccctataatctggtagttgtgataagaagtaaaatttaggaagcaatgcaagatgagaattcagtgatgagtggggcagcacaggcttgaagagttctgtgaattccatggagggggcctgggggcaaactggagttgtcaggaagatctgggctttggaagaatgcgaagtgtcggtagaaggagaaggggcaggtgatttcagactgggaggaccttgtgggcaaaggcacaaaggcgagactgacctggagatgataaggccagttgaagagacactggagaagagaagacagtttgttttacacattgcaggaaatcagattagacagttagggtgtggacacaaaagcgaggaccttgcaggcactggggagaagtgaccccattcaatagtccttggtctccttctgccctgcggctgcgcttcctcggctctcacggcaccagcagaattccatgtgagagggagcttgtcgagcgtggcctcttcccacttggggctgctttctgcatccctgtgcctggctgtgggcctccatttgccctctactgtcttcccttaggacatcatttatgcagagaaaggttcgtgtggctcggggtaccagtaagacctccacctctggtttcttcattttaaggaggcccttcaattatccaggaattaaagtggccttcctcttgggagaacgagttggttgatgaatgataagcaagtctctattcctcaaaagccagtccccaaattccatgaaatatgtgctactttctttgcatgtctaaatgagatggcacgggtatgcttctgttctttttctggacgttgtttagagagtcagtagatcataataattcagacactttttttctggaccataaaatatctgaacccatataataacaaacatacagcacggtgaataagaacccaacttttgagccagatcactttgcatggaatccccattctatcattctatcatttctgggctgtgggaacctcagacaagttacttaacttcttcaatgctcagattaaaaaaaaaattcacaaaatatctctaataacagtaataataactgaaaatacctacctcagagggttgtcgtagagatcaaatgagataaaaatatgtaaagcatgtagcctagtgcctgactgaaaaaaaaatctctcaatagatgcaactcttatgattcttattaaggacttggctattgccacaaatgaaggtgttatgagccctggcttaagagcaagaagcctgcaaagctaactctcctaatcccaacattcctttccagggaaagtagggtgacaggtggaggctgggaattaacgttttttgagcaccaaatatggacaaggcacaggggttgggtgtttttctagtgagaatacatatgaaagaaggaaaacaaacttggaaaccgctattttaagccatttggtaacagtttctctagcttatgagatgagagaggtcctctcagtatccgctgcattacttgtgggcctccttggttgacgtcgctctctgaacgcttggggtggaattctagaggtgcttttcattagaggcagagagcatgacctttcttccttgcccagtttaaattaaattattttatcttacaatgtgttaattttagtgctagcaaggcacagctaaaattccatttctacttaggagtggggatcattgtggcagtgagtgcttatttgggtttgggatgcttggatctgggtgaaagccaggattaaaaagcatcctccttccccattccactctctaggttataaatatttttttggattaaaagcctcctttaaaaaaatgcaaatccacctggcatgttaattgtgcaggggattcctaattatgtgtgcagatgacgtgagtcaaacggtgatagtgttccttctagagtcccactggtgtcctaagggaggagactctggagctttgtgtatgaaaagggatgggcacaagtcaggatggggtgcacaggtggaggctgggaggcagcatgacagtgtgggggctggggtgggctgtgagagcaaggagggtgtcagagatggaaaggatgaccccaggggggtggaagggtgccagaaacttagggctcctctgtgagctctttagccatttgactctagcaactgcttgaatgccctgaacaaccttttgacgacttgcacaagaagttgtcatactgttccccggatgtggacagttgttcagagaccacgatcatgtgtctggtgtctcactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttttctggtaaaatagaatactaatgaattgcttttggaagaaatttccagagcattactgaatgttcaagtgcttcttagagcacaagttgaacctttcttatctctgcactcagtttctcgtaaaactgaagtcacagtgacctcttccccatttcgtagaaaagaaacccaaggaagagagtggttaagaaacagaagatacggttctcatcacatttgcctgagaactacgtatagtcatccattcagtgcctcgttaagtaaataaatgattgaatcatttgtatacatgacctcatggaaaaaagcacggtaaaatgaatgtttgagggtgggtagacagaattattcaacccggacaggtgttagatgttcactctatccccccctttttttttgcattaggttttattcattatttgcatcatctatggacctaaaagcatgctcattgtcacacagatgggaacagggtgaattttcaatgatttcaatgaaaaaaaaaaaaagatgtgctgttgcaaaatatcaagggagatgtttacagtggtgttctagaaccggcttgctctcaagtgctgattgtaatattttcagaaattttccaagccagtgacattattgacttctctttatctgtgtgatggaaatgctatataatattgtgctatctgagcatctgttttcaattttgcattcagcgatgtcatgatggtggcttgaaattggctatggtaaaagtacactgtgaaaatcagcaaacacaataaatcaggctccccaccttttttttttcggggcggggggcaagcatgttgttaaacgtttactagcatgctactgaggaactgtgtaaaatacaaatatggcaatttgacgatatgtatcaagagccattaaagtgttcatacactttgatccattcattccacccctggaaatttattctgaataaataattcaaagaaaagtaatatgcatgaacatattcactgtattatcatttatagcagcaaaatctgaaaataccctgaacactaagcaataggagttctggcaacattaactccatgagtttttttttttttttttttttttttaagacagggtcttgttttgtcacccaggctggagtgcagtgtgtaatcacagctcactcagccttgacctcctgtgctcatttgatcctcctgccttagcctcccaagtagctgggaccacaggcgtgtgccaccacacttggctaactttttttttgtagagacggggtctcactttgttgcccagcctggtctccatctcctgggatcaagtgatcctcctgccttggcctcccaaagtgctaggattacaggcacgtcactgcgcacagcccatgggttcttttaaagtcattaaaaatcatagttatgatggttatgaaaatatgtttgatatgatgttaggttagaaaatcagaattaaaaattttaattacattctgattttgttgtgaataagaattaaatgtgagccgtaaaaaaatgaatgacagcatttggtatgttagaatggtgaaatagtagaatttgtttttattttgtttattgtagtcgtggtgtgtgttcatttaagaaatttggagaacacctgttaataagtgatcttgagtagttttaacatttaggaggaaggctatgagttttgtgaaccacatggggctttacctttaaccggtagatgttactgtgaatccctgggcagggtattgtaaagggagtttggagctaggcagtgtgagctgtggatgctaaaggggtttctttagagcagcttaaggaggaggaagaagtaagtaactgtgtcctgaggacttgctaaaagtagactgcaaggactgagaaatagcccagagaaaaactaccatcaaaggccagagagacaggcgagagaaggtttcttaggaagagacaaggagacgctgatctcagaggtgaacaacatggataagaaattaactccattttgacctgaaaaaaataggggctgacaccagaaaggaaatgatttttgtagagcaatggttctcaagttttatttatttatttatttttagttttttttaaattttttattttttgagatggagtctcgctctgttgcccaggctggagtgcagtggcatgatcttggctcactgcaagctccgcttcccgggttcacgccattctcctgcctcagcctccggagtagctgggaatacaggtgcccgccaccaggccccgctaattattttgtatttttagttgagacggagtttcaccgtgttagccaggatggtctcgatctcctgacctcgtgatccgcccgcctcggcctcccaaagtgctgggattacaggcgtgagccaccgcgcccggccagttctcaagttttagtgtgtttaagaatcacctggatgagtgcgggaagagttaactaatttagcatccaggttccatctccatgcattctgatacggttggtctagaggttggcaggaatatgcatttttaacaaatcctcccaccctatgaagactctgatgtgaattgcctgcagattacactttgagaaacactagtggaataaatgcaacagtttggttttgtccagggaaggtatatctgtgagtgtgtgtgtgtgtgtgtgtgtgagagagagagagtgtgtgtgtgtgtgttgaaggtgaagccgctacttaaaggctcagaattgaaggacttataatgtaaaaggggaatgaaaacagagaaagcccagagggacaagttatttatttgttatagaaacaaacagcaaaaaccaggaagctgtacttacgatattccttaaaggaatatagtttgtggcacaaaatcctcttccacagttaaacaattttgtccagcacttgaaccaattaaaagtagctgtgactaggggaactatgagcacagagaaagatggtcatggggagagtctgggacccataaacattctatttcaggccatcgagcggtggttattaaacccgtggtagaatatgggagtgctacggacagaaaacactctggaccttactgtatgataacattatgttaaagaagaaaagaaagtatattttttgatgaaatgtagtattttatatacagaactcagcactcaaaatagtaataacaattagacttatgccacaacaacattatatcacaaaataaacatatgaaagtgaatgacatcgcagtagccacggttctgagattatctgcttcacctggctttggaagtttagtgattgtaatagctttcaaatagccttcaatgtctcgtgctcttcttacagtggagatgattcttttactttaatcacattccccatcgtcagggcctctgatctcttgagacatgatgtggtaaatcaaggataagttaacaacccatcttcacattggaggcgcaagtcacagggtctgtcggatgtgcaagggtctaacgcctgaaatcagacctctttctacaagcacgcgctgactattctattccccacctaacagggtttttcatggactgattggcttgtgctttggagcaatgtttcctaatcactagttttggtcacagattcgtttgacaatgtgatgagagccaaagactttctcacacagggccatgaacatttgctgcacagtcctaggggatataaggaccctctaaaacccattcatggactctcagggatctagaggcctcaagtgaggagctctgccctcagcagagggagcattgcagaggaagttctggttattactgacatcagattaagcccctaaagacagaaatgctgcttctccaattgatggctgaaatgagggcaagatggcggatacaggtgtagttttatagcatcagatccttaaaatgagtagcatgtggggctagagttgtttcccttcagataacatatgattaatgctctaaatccttagttctgaattctctcatgtgaagccagggttggttcccatttgggaaagcagtctctcaagatgccactttaatgtcttacttatcagctcgtgatgccttgggtggcacaagaaatgcaggcagggccgggcgaggtggctcacacttgtaatcccagcactttgggaggccgaggcaggcagatcatctgaggtcaggagttcgaaatcagcctggccaacatggcaaagccccagctctactaaaaatacaaaattagctgggcgtggtggcacatgagcctgtaatcctagctactctggaggctgaggcaggagaatcgcttgaatccaggagacagaggtttcagtgagccaagatcgtgtcactgcactgcagtctgggcaacaaagtgagactcagtttacaagaaaaagaaatgcaggcaggttgtaagcactgatctggccaactctagagtgtagtgagtagtgtggggtcagctgatgcccctaagcaacgtactggatacccagcccagctgcttttagggtgaaaggcattagcattagccggtgggtaaagtgctcccttctgggtgtaagatgtagttgtcttatctgaagctgaacatctggttgggctttgataactttgaagatagttcttttcctgtgtagccttttgatcacagaagccctgttggtcatcttccattagtgggtatctgacctgcaatttggggaactgagtgttttcagctgaaagctcagggctttgttcatttcctgtcctcccagactgtggtatcaggcagggtatggagacttaccccaaacccgtctgtttaaattagccaaccctactggaagtggtaagatgaggccacattctcatgtcacggtcatacagtggattgacactggatgagaaagagaaacgcacttcatcttcatccctccggagaaaaagaatgtgaaattgactaaatacatggtgagtcaaggttctcttggtgtgggatagcataaaaattggaaatctgtctttgagatagaaagggaaaatctataacaaatatgttccagtaatcagtgtgccttcatgtctataaccattttaattattgcacatccatgactacatttcttgtaagtttcaatatctattttaataataatattgcatcatacagtcacagccctcaaaacacaaatattccatgtacaccaaaggctggtagcaaagtctctactcctcttacctcctggagattattttcccctgccaggtcattatgtctagcaacctagttgcccatgcagagaatggactggcacaaatctcttccttggctcttttcctttctttcaggcaggacccctacttttaatttgtcttccctccaggtccagctgtcaccttcttgagagactctaaatatacaacccttactacgaacctttttctccctttcttgcatttttttttctcagttgccacaaaaaattcttctggtctttgttccagttttgagctgaaaatgatcccaactgtggttgagaagcataagaatgcctgtaattattccttctaacaaggaaaaggaaactcaatatatttagagtcaaatttaaatgatgtaaaatcaattacaaaaacctttaaggggcctaaaagtcccctttggcatactttttcttgataaaacctgattttcctcaagctctactctttgggcagtaacttgctgaaaattatatcaatagtagtctttctctgtcttcttcatgtgataaggaagtaggagagagggttggaggcacgtacaggaaataggaggggaaaagccagaaaaacccttacttattgacaataccacaatttcctatatgtgccaaaacaatattgtcactatattcctaaacacagaatatccggcaatatcagagaaatatctataataatttctactttaaaaatataatagtaatggatatttgttgtagcaaatatgtcatatgccttttaggttaaatatacttgtatacatcttatttgtaagtgtttatgtattaaaattgccatcaggctgggcgcggtggctcatgcctgtaatcccagcactttgggaggctgaagcgggcggatcacgaggtcaggagttcaagaccagcctggccaagatggtgaaaccccgtctcttctaaaactacaaaaattagccaggcatggtggcaggcacctttaatcccagctactcgggaggctgaggcagggaattgcttgaacctgggaggcagagtttgcagtgagcagagatcgtgccactgcactccggcccagacaacagactgagactccatctcaaaaaaaaaaaaaaagtcatcatcccagtgtttttcctccacgatgtgcaaaatctatagaaagaagcataaacattgcttcctaatgtgatagaaatacagctaataattgtaggatcatttgaattaacaaaaggcaactatgagtattttttctgagtcctatagctatctttccttttttttcatcctctacatttcaggaaaagcaattgaaatgtacattgtggcagtgtttctattacattctagagctatgaaaacacatggatggttttcaggatgcagcaggagggttctacgtaaaacgtcggtccagagttcaaaccccaaactaatagttttggatttccccaagtactacccacttaatatgtcaccaggaaagacccatcacacacatatatggaaggaaaaattaaagtttctcctccagcaggggctagatgcttgtggtttctgtttaaaaactagatggtggccgggcactgtggctcacgcctgtaatcccggcactttgggaggccaaggcgaacggattacctgaggtcaggagttcgagaccagcctggccaacatagtgaaacctggtctctactaaaaatacaaaaattagccaggcgtggttgctcacacctgtaatcccagctacatgggaggctgaggcacagaattgcttgaacccaggaggcggaggttgcagtgagctgagatcatgccactgcactccagcctgggcaacagagtgagacttggtctcaaaaaacaaataaataaataataatttaaaaaaactagatggtacaattgtgttaaaaaaaaaaatcaccagcgttttcagcctacgtttatatctacttttttttggacctgtgaccgatcaaccttaaaaagttatattatcttccagcttcctctgatttacttgtcctttctttggaggactaaaatgatcatactctttttatttccctacaatcaatcgagctatttggaatttaaatgttagtgctccttcctttataaatttggtcgtgattgattttatttctcaacaggtacgtagctcattattttatccattaattatagttactttttgtttcctttgccaattttgggagtgcttaacaactcttaagaactgtttcattaacgaattagtaaccaatgtaaaatgcagaataaataacaagttcagttgcctttatagtctttaaggtttgcttagaaacttttaaattataatcaagttttttcttttcctaccaaatattggccaaagtacaatttataaacaatatcatcagccagtcaggaaaacgagctaaatattccttcttctctccacttaatatgctctgttctcaattattattttgaatttttttaggaggctttcgaaaggccttttttcagaaaaattgtgagttttgggcagcaacatgaatgatcagctttaaattgttcatagtctttgaccatgtttaagaattattcctaagacaacaacgcaaggtgttttattataaaagcaagacttctcaacacaatggtgtctgctaataatagagaaaccaagaaacaacttaaaatgcccaacagaaatgtataaggtgataaaggtgacaaagtgagaccctgtctcaaaaaatatatacatataatatttgtatttataatataaaaaggcctatatatgtattcttatacatgaattcagaatatggaggtaaataaatatgttagaaattatctagtgtgtgataagattacatgatttaaaatgtttttcattttttcctgtcttttttataagtagcatatattgtttgtatataaaaaaggccaataatccttattaacagaatgtcagtttttggtgtgaggttaataaagaaattagttaaaatgattctgacatgagagttttttctgacattttgaaagaaacctaatgctttgaaagccctaagtctataattaaattgtatctaataaaatttagaggctctttagatttagagggattttgagtttctcaaagcatagaaaacgacttttagtgagagatgttggaattatcagttaagtttgtgagtggtttctgtttttaaaatatgagataattagcattagctagtatcaggctttaagcaaaatataaaatattcaagtgatgaatacagacgattatttctacattttaacctgtaaaaaggttcccaaagagatttttttttcttttttcttttagtgagacaggatgtcactctgttgcccaggctagagtgcagtggcatgatgatggctcactgcaccttccacctcctggggtcaggtgattctcccacctcagcctcccgaattgctgggactacaggaatgcaccaccatgccggctaagttttgtatttttttgtagagatggggtttcaccatgttgcccagactggtcttgaattcttcaagcatattcacccacctcggcctcccaaagtgctgggattacaggcctgagccatggcgcccagtcaagagatcctttaagaagcacattttccttatgcatcttaaatattcaattagaaaagaattgactttcaaatattttgaaagacatatcttctaggtaaatcataaatatattcattctgtgtaaagtaggaaaataaaggaaaattaccttgtatcttttcatggccatttctctacacagtaataccaaatatctaaaagtttgttaattcaaaatgccaaatattagttggaatatcatataactctttgaaaagttgattcgtttagtgaaaaagacttttcctcttaaacggagtgaaatctcgtgtctgatttgtgtaatattcctgattacattgtgtgcgtgtgtgtgtgtgtgtgtgtgtgtgtgtgtgtgtgtttctgtgtttctttccggcttggtttaacaataattcatgatcataagaggacagctattgcttgtaatgaacccagctgatcaatgaacaatgctttgtataacaattgtgtaattgaaagtgatacaatacctaccaacggggacttaaagcaaccaggattcatttctccacgtaacaggaattcggaggtctgcgtttcccgccctgggccaatggctcaatgagactgcctgccattttgttgtctttcgtcatggctgcacgatgattgctgcagcttctagccatgtactccattcaagacgcacgggaaggttggggtggaaaggaggatgagttggcagtggttgtctcattttccaggaaaccaagaattttcccggaggcctcccagatatcagcttccgtgtcattggtagaactaggttacacagccactccagctgccgtgaaggtgggaaacaggaaatagacttattattaacaattcccttagagcatacattcctaacaggcagggtgggtgggtgtggggaacatggtggagaatagggtgagggttgtggtggggcgtagatggggtggtgctgttgatatcatcccttaagggaaggatattgcttttgtgggagggaaaaggcaggaaaaatatcccactctatatgtataaagcacagttatacatacagcatatatgcagacatataatttgtctatggtattaaaatttcatgcatggggcaattaggaaaaaagcgtctaaaaatgctcttagggagatgatgttgaaaaaaagttgagaaatactgggctagaccaaacatgatccattgcctgaagcttacgtattatctattactgatgacaaagagaggcacaggtatggagtggcaaactaacaatgcgtgccgtagagaatgtcatacattaaattaatgaacagcttactttatgttgtaattgttgttggtcttctctcattgtactgtaaacatcttaaaagtgggaactgtgtcttatttcgatgtatatctttgtatattagcacactagtccctcaagaggtatgttttgtaagttgaatggaacaaacaacattttatttaacatatactttatttctattttttttaaattttatttatttatttattttgagacagcctctctctttgtcaccgaggccagagtgcagtggtgcaatctcagctcactgcaacctctgcctcctgggctcaagagattctcgtgcctcagcctcacaagtagctgggattacagacgtgtaccaccatgcctggctaatttttttgttgttgtatttttagcagagacgggctttcactatgttggccaggctggtcttgaactcccggcctcaagtgatccgcctgcctcggcctcccaaagtgtaatgttgattatttttaatggcaaaaatgaagtgatgcaggaagacatttaagcgtcataggtgatgtcttgggggtagtttcacaggatttttagcgagctgtttgattgctcttatgtggatggtacaaagaccaaaagaggttttgcaaacagtggagtcataaatgattgtgcatgagataattagttctgatagttccgttagtttgtttgtaagagatgaaaaggaaataaaatggaaaaagagagaagatttgttttgttttgttttactttttagctggattgttttttctgtgcctaagctgcttcagttgtaaaatgggaattataatgtcaaaatccttccttctcgaattgtgatggtcaaatgaaaagctgtctgagaaagctgccccgagctgtctaacagtattcctccagctggactatgcttctgagtcatccgatgctttaaaaatacatcttcccaggaaaacattgtaaacaactcccagggtacataatgatttagatgattaaatttggaggctgccctgacttcactaccctgggcctcaactgctttataaattatgaatacagatacttcctaggactgtagggtggatagcaaatgaagcgaattaactgccaaatccttccttaacatcttcgttatgatcaatattatgaacctaggcaatcttcatccatacattggacacttgaccttgggatggattagacttcctcagtttcctttgtcctctgtgcaaaatctagaatattgccagcctatcgtcagagtgcaacacgtttgaggaattattgcatgattgatattgttgagagttcagattaatgtcacttcagataatccacagatgacatggaaaactggtgggctaccggtgctatttgaagtcaacgagggcttgcacttagctgggaatgggcgagagaataggattaatgcccaggaagatatatcttctgatcctcacctctcttttgtatataggtgattttttaaaaaacttccttctcctccaatcaaaactggctttgaggaaagaatgggactggatgcacatttgtgtaaacatgctaatggtaaaaaaaagtctttacctttcagggatatttgcatttcaacaaagtaccaaacctcaagagaaagggctgctccaaggatggaagatatatttggtagggagaggactttttatcacccttgattcactccatgtaagcagggaccttctggtaagatgctccctgatggggacttgttggatgctggccgtgccagctggctgaaacccccagggtcagacttccttgcaggggatccttatcatgtggatggcagccactgctgatagattggggaactgcttcctttgccgtctccctatagggaaggttcccctaaactgagtccctaataatctcagagcgagacgtgtgctgtggggatcttatcatcttatcagatttttctaaactatagtccttcttagaagtgagaggcccagaacactctactttatgcaggaatagcagagatgactcatggttgggaagacactagaattcagccaggagaatatcattaaaagagggagaagggaaaacagactttttgtgtggtacaaaaacaaaaccctctgtatcattatgtgaacaacggtgcaaaaaagaggagacacagtttacccatgggtagctaactatgatagtgaaagttgccttgaaccttgttttagaaaaatggcaagtgtgggtctcactcttctagttcctgacttctctctctctctctctcgtttctcttttttttttttctctctctctctctctcacacacacacccatcttgggccaggtttgtaaagcctcatgggaaatggaacacggaagagtcttctgggaggttttaaaatttaattttagtcagatttagtaagatttcttcatacaaaacaaaacaaaaattctctaaaaaaaatccttgttagggtctggttaagacaactaataacaacagatgtgagggcatagttcctagttaccaaagaatcgctctggtgagagaggagtggaggcaaaaattccagatggtacctgggtagcgattgcactcagatgggtcatctgaggacagctgccctagaccgctgctcctgagcctctccattgtaattttccttcttctagttcctttttaaaaatttttcttttttgttgagatagagtcttgctctgtctcccaggctggagtgcagtggcatgatccccagtcactgcaacttccgcctcccaggtttaagtgattctcctgctcagcctcctgagtagctgggattacaggtgtgtgccaccacgcccggctaatttttgtatttttagtggagacagggtttcaccatgttggccagactgctctcaaactcctgtgctcaagtgatctgcccgcctcagcttcccaaagtgttgggattacaggtgtgagccactgtgcctggcctagttcctttgttttaaaagcttaaatgcatgaagcatacagtactgtgaagacttgcttgatgtgatgcaggttccttaatctcctcctttgctatttggttcgcagatggtggtacgggtggcactttggggaaggcggggcggaaggaagctttctgatgaatgtttgcacagtatacgagaaggttacaagatatgggcatcatgcacaggtggcgaggtggttagagaaaggtagatggtgtttggggattaccctctggtacatttcaattcactttggggttatgagatttcagaaggttagctaatgcttacgtcctggggtgggctcttttgtatttctttgttgtctcttttttattttttagagacagagttttactatattgcccagactggtctcagactcctggcctcaagcgatcctcccacctcagcctctgagttacaattgtctcttgaaagtaatttcaggtaggcttggggctaccaaggcaagcctagggaagcctactacatgaagaggattagagtcctctggagaagttggattcatatgaagagatactaatcagaaagttgggagttagtcatccatggaaaacaggcatgtttgagaatcatattctggcagtgcccatccatgcattatcagtggagagagaaccttggctaatggacttccccagttttgatcccatggataagaccatgggggagagggtaaggcttaggctaatgcatattcttggatcattcagtcacctccttccactctgagtccctgttgaccagggaatgtcttggtgtcatagcttggctttccaatggctctccccgtggggaaagaatacacaggctgtgttgatggtattctagtcctgacgagagctgcgtttctcatggtcagcaaatgaattggcatccgatatataagcaaatcttgtgactgtaaagtcatatactttcttgttagttgagggaatcagatttctgagggtaagaggtgaagccaagaacatggcaaattcattatcttgataaaaactacccggtaaggctgcccattttctttcaaactgcaacaccatatgtccagcgaggttcctcttacgagacatcaggggtatcaggagtgggtgccaagctggagtcctgagaatgagggaaataggagaccatgagttttgagcaccaccgcaatttctcttctccttttgtccctcttgctttaggtagtaatgcatgccttaagataataaaaggtctgtctttgtgggctcttcattgccatagaaaaatgattggtatgagtttcccaaggcctcggataaaaatatttcttcagagagggttttgaaaacttatgccagttacctgggtggactccaatctttcaagcactgtgtgtcttttcctggtcctccctcgctccctccttcctttccttccttctctaaacagagtctaaggtaatgcccctctccagtttcttgggatagggaagggggtggaattacttctgactcacccttacccttatggtgtaccctttggggttctggctaaaatatatgtattgggaagtgggacgcagtggctcacgcctgtaatcccagcactttgggaggccaaggcgggtggatcacttgaggtcaagagttcaagaccagcctggccaacacccatctctactaaaaatgcaaaaattagcctggtgtggtggtgcatgcctgtaatcccagctactcaggagactgaggcatgagaatcgcttgaacctgggaggtggagagggtggtgagccaaaatcacgccactgcagtccagcctgggtgacagagcgagactctgtatcaaaaaacaaacaaataagtaaaatatatatattggggtccattagtttttccaccctgggtggactctgacctttgacttctgtcatccttgccccatgaagccatcggaactgcagctcgttttccgctttttcatcgccatttctttcagctgacaaatgctgtctacctcactggcttctcctttattcttaggttttggcctgacagttgctatttttttttttttttttagctctttgatacttttaagaaaatggtttttaggccatgcacaggggctcatgcttgtaatcccagaactttgggagaccgaggtgggtgaattgcttgagctcaggagtttgagaccagcctggccaacatggtgaaaccccgtctcgattaaaaatacaaaaactagccgggcgtggtggcaggtgcctgtaatcccagctactccagaggctgaggcaggagaattgcttcaacccgggaggcagaggtggcagtaagccgagatcgcaccactgcactccagcctgggcgacacagtgagactccatctcaataaaaaaaaagaaacaaaaaataaaaacataaggacttttgacaaaaatatgattctttaggcaagaggtttatttctctaagtgtcagtttctctgaaaactttgaggattggattggatataaatttccccaagcacaatgtgtgtaccaatggtgggaaacaagatctttttagggcaagcatttaaaaaatgtttttagtaggtatatgtttctttgaatgttttcagaaaaaaattataagtgacaatcaaatctatgatttcatctatttaattgcttaggacaaggccatatgagttcacttagagttgatttttaaaacataccacataaatgatagttcaaatatggttatcagatgactgaaatttgggggcaggattagaagatgatctttcagattttgactaacttgactattctggtctcaatgacgaaaggaaacaagttcccataagtcattacagtggaatccaatgatattatccaagaaaccaatattcctaggatcttagttctcctagaaatctttctagcatgctgagcaggatgggttggacacagtccaaatcactggaatattacaaatttaaaaaattgttttgagtggtgtgtgaaagagacctgctctgaggacttctagaatgagtgagaagggaacttacagacctactgagacttgctcctctgtcagatgtggcaggagggtcggggtcttggagttgttcaagtaatttcatcagttaggggttaatcctgacccaggatccagtcctgctgggccatactttcttaaagtgactatccagtgacactagcaaatgttacctcttcccgggaagaaatgacaggatgtgtttgtattttcttttacaaaggatcatgcgattttatttttactttttttttgttatagaagtggtatatgtctgtgaaggaaactcagaaaacatagataagcacacacaaaaaatttgtaattgcaccagtatgagcattgttaaaatcttagtatagtttcttacttttttcctctctctatttttactaaaaaatcaggattacgttgcacataccgatttgaacttgcctttctttgatccatataacaatgttgtcacatacttttccccacattattaaatattgttctacaatagtaaggaattcaatgataaaagaggcatattgtcttcctcccaccttatacaagttattttgtgtggcagcttgacttgtattttagaagtagagacaaattaaggcaaaaataaatagaaatggcaaattaattccacaaggagtgtgttttctgaaagtccctgctgctagaaacggaattaggattatgcctcctggtttcaaacatgtcgataatagctgtgtgtgctactcgagtggcgtcaaagatggatgtccaactccatattggagctgtgggtaacctagtgacagccacaaatcacccttctaagagcagatggtcagggagcacctttccagtttagagcatataccagttgctctcctgatggacatctggtccatgatatttgactgttttaaggtatggagtgctttgtacaaggtacaaaacttctgtccttggtatgaacatttgggaggcaagtgagtgataatgacccacggctgcctttttgtccggcaaagcacgaggatgctttggagaacggaaggatttcatcgagtccaaaggacactcacctctaggcctctcagcctccttggccacgtggttgttctgctactgagagtctgcagatgagctggtggtttctctaagcttccgagagctctctcgggtatttattatatgcacgttctgtctacaatgaccagtggactctaaactgggctggaacatgttcccaggaaaacatgcccaaattctgttctaccttgtgtaaatctaagacaggggctactgaacacagtcttggaaatcagacacgtgctagggccccctgtgcttagctcggctaatgagcccaggctgagggcttttttgcaggcatgccaaaaaatgcagggccaaggctgggggtggagaggtaaggctagggaagtcaaggaaggcatgaggaacagcttgggaggggaaaaagttcatctggtggcaggagctttaggctctctctgctccttcacccttttctctgttcaaatctgctctcaaggcagcatgtgatattgatggttcacagaaacatgaactaccagccttggaggggccctgagagcccatctagttcaatgcctcattttgcggatgaaaaaacaggtttggagtggctaaatggcgtaagcaaggtcgtgtcactaggagtagagctgggattcaagcctgatggttagtccagggctctgatcaccacaagctgcctctatatacagtatagtgagaaagtctcaaccaccacattgactcttcatttatatttaatattatatttgtattttaagattgatccataatggaaggaattgtttagtcctgtactaaaggaatttagaaagagttgggtgactcaatctactgataaggaaaaagatttacaatctattactaagtgagaaaggcatcatggagtacagtatagtatgctgtagtttgtatataaaaatgtgtgtgtggctgggcgcggtggctcacgcctgtaatcctagcactttgggaggccaaggtgggtggatcacctgaagtcaggagtttgagaccatcctggccaacatggtgaaactccatctctactaaaaatacaaaaattagctgggcatggtggcacatgcctgaagtcccagctacatgggaggctgaggcaggcgaatcacttgaacccaggaggcggaggttgcagtgagccgagatcgcaccactgcactccagcttggggacagagtgagactccatctcaaaaaaaaaaaaaaaaaaagtgtgtgtgataattatacacatacattcatatatatatgcatgtggattcatgtaataatgtaatagctttggaaaaatgcatgagaaacttagtctgatggttgcgtctgggaaaatggcctgggcaccataggagggaggtatatttttcacttttatacttttaaaatgttactataggcatgtaatcactattcaaaaaatgtaaaaacatttaaagatgccatgtgagctcaaataagggagaaatatattgcttattgggaaggcctcatacaagaggtagcatctgagctgggctctgggatgggtagaagttcaccaggaagagccagggcaggaaagcttgcagcagcaggactgaagctgtcaaagcaggaaagaccagggagagtgtcagcaatgttgcatagtctggagaaattgcagcaaagtagtatgctgttgtttgaatataaaaatgtgtgtgtaattattatatgcattcgtacttacagcatgtgaatttatgtaataatgtaatagcttcagaaaaatgcatgagaaactgcattggctaggtaaagcagagacagggccgaggagaaaagtaaagagagagaactcggctggatggaggttattttatacttaatatggcataaagggctttttacaaattggccccattgtccctttccaacatcatcttccacctgtgcttcagccaccatagccagctgtctattctccaaatacccacgtgcacacctgggcaccagccgcttcctctgcctgcatgcggtccaccagtcctatttctttctctcctccaagaccaagttcaaatgttcctcctctccccctccccaccccaccaccctggaagattttaacactctgtccttagtgttctcttggcattttgcatttacctttattatagaacttggctgtttaaattttaattttttgcaggacgaaccggagagtgaggtcatttatacgcagaacattgcgtctcctctctttaatttagcattttattctctgaggtcctagctatatggtactttatggtgatgaagtacagccacaccattctgcctttgtgtggccattgcatgacctctccaaatgaaatcatttcttctatagagaaaaaaaagtgaggatcagagacattattaactaagtaaaaaaaaaaatttttttaacctctgggcctagtctaaactacattaacattttctttattatcttctgccccattaggctccttaaaagtaggcctagtttaaagacaattaaaggcagatattctgtccctttttttagacttctatggatttgaaatgtcatgttaatagaacactatatatgcgtaagcaatgaactgaaccattaaaaaagaattttgctctggaatatcctggtagtttcagggtcattatatatttgttttgctcagtttcttgatctttctgatccttaatcagaagctgagcatctaaggaaatattttatcctattgctatgtatctataatattatctgtataaaaagtacatatgtctatatttcaaaagaagattgaaaaaattaagaaaatctgaataaacttgtgttcttagattattcctctttgttcctcttctcccttaggcaattgagggagtaactgctatgttcctagtacaatttattctatagagggacatgtgaaaggtgagctgagaattcccagtaaatctcgatttacccatcattgcagagacctttcctctgcctgggccaatgtccttctcggcaagggaagatagatcgcaccagacaaagtttggacatttatctttctacataaatggaaaacccttcccagattgttcaactggttgctttttttcagttactaatacaggaatacctcatttgattgcgctccacagatattgcattttatacaaactgaaggtttgtggcaactctgtgttgagcgagtctatcggcaccattttcccaacagcgtatgctcacttcatggctctgtcacattttggtaattctcaaaataattcaaacgttttcattattattgtatctgttatggtcatctgtgatcagtgatctttgatgttactgttgcaattgttttggggcacgatgaatcatgcccatataagatagcaaacttaatggataaatgttgtacgtgttctgactgctccggctgttcccccacctctcttcctccctttgggcctccctattctctgagacacaatgatattgaaattaggccagttaataaacctataatggcctctcagtgtttaagtgaaaggaagagtcatgtgtctctcactttaaatcaaaagctagaaatcattaagtttaatgaggaaggcatgttgaaagctgagagaggccgaaaactaggtctcttgccagttagccaggttgtcaatgcaaaggaaaatttattgaagaaatgaaaagttcaactcctgggaacacatgaatgataaggaagtgaaacagccttactgcttggacaaagctttagtggtctgggtagaagatcaaaccagctatacaatttctttaagccaaagactaatccagaacaagggcctaacttgcttcaattctatgaaggttgaatgaagtgaggaagctgcagaagaaaagtatgaagatagcagaagttggttcactaggtttaaggaaagaagccatcttcataacaccaaagtataaagagaggcagcaggtcctgatgaataaactacagcaagttatccagaagatctagctaaggtcattgatgaaggtggctacagtgtacaatagaattttcaatggaaacaaaatggccttctattggaagaagatgccatctaggactttcacagctagtaagaggtcaatacttggcttcaaagcttcaaagaacaggctgactgtctagttaggggctaatgcagctggttgctttaaggtaaagccagtgctcatttaccattccaacagatcctagggccttaagaattatgctaaatctactttgcctgtgctctataaatggaacaactaaagcctgaatgacaacacatctatttacagcaatgtctactgaataatttaagcccactgttgagacctactgctcaggaaaaagattcctttcaaaatattacagctcatggacaacgcacctagtcacccaagagctctgatggagatgtacaaggagattaatgctgttttcatgcctgttaacacaatatctattctgcaacccatggatcaaggagtcatttcaactttcaaatcttattatttaagaatacattttgtaaggctataggtgctatagatagtgattcctttgatgaatctaggcaaagtaaatttaaaatcttctgaaaggatctaccattttagatgccattcagaacatttgtgattcatggcagaaggtcaaaatagcaacattaactggagtttggaagaagttgattccaagcctcatgactgacttgagggatttaagatgctagtggaggaagtaactgcagatgtggtagaaggagcaagagagctagaattagaagaggaggctgaaggtgggactgaatgtctgtaatctcatgttaaaatttaatgtatgaggaattgcttcttacagatgagccaagaaagtaatttcttgagacagaatctacttctggtgaatatactgtgaaaactgttgaaatggcaacaaaagatttagaatattacataaacttacttgataaagcagtggcagggtttgagaggattagctctaatttgcaagaagttctgctgtggataaaatgcatttcatgctacagagaaatctttcatgaaaggaagaatcaatcagtgtggcaaacttcattgttgtcttattttaagaaatagccacagccactccaacctgcagcaaccactaccctgatcaattggcagccatcaacattgaggcaaaaagattaggacttgctgaaggctcagatgattgttagctttttttttttttttttttttttagagagggtcttgctctgttgcccaggctggagtgcagtggtgcaatcatagctcactgtagcctcccggagtcaagtgatcctcccacctcagcctcctgagtagctgggattacaagtgtgcattaccatacctggctaattaaaaaaaaatttttatctagacagagtcccattgtgttgtccaggctgtattgttagcatttttaagcaataaaatatttttaaattaagccatgtatacttttagacatcatgtatagtgtaaacataacttgtttttttttttttttttttttgagatggagtttcgctcttgttgcccaggctggagtgcaatggcacgatcttggctcactgcaacttctgcctcctgggttcaagcaattctcctgcctcagcctcccaagtagctgggattacaggcatgtgccaccatgcctggctaagtttgtatttttagtagagacagggtttctccatgttggtcaggctggtcttgaactctcgacctcaggtgatctgcctgcctcggcctcccaaagtgctgggattacaggctcgagccactgctcctggccaacataacttttatgtgcactaggaaacaaaaaaaactgtgtgactcactttattgcaagattcactttattgcagtggtctggaactgaacccgcgatatctgtaaggtatgtctgtatatcatacccttcctgggcaatacgaacaggctgacctaattccttctaatgctgagtggattctatcgaatggatatggcataattaatttaacccctgcgtcttaatggacctttcagatctttccagttctttttttgctgtcgtgaataatgtagcaatggaaattcttgcatatcttgactacttgtgtagacacatcagtacaacgtgttgaaagaattggaattgctggattaaaaggtctccgcatttaaaagtttaatagatactggcaaggacttaaaggatggagtggtgcaaggggtcccccctaagtacaggaagtaagggggtatatcatttatatagaattttaaaacagtaataaaaccagtgtgggtctgttttttattatcaccatgcgctggcagtgaaaaagtcagagtaagttcttaatggtgtgtacagctttcactagagctttggggccaagttgcatcttcagcttctatggcacagcatagtcctgagtttaagctgcagattagacataaacaatgatagcacagtgattgtagaaaccccggaacagaactcgagttacctcaattccgttattctctcagagttttgtatttaaatttgaaacaacaaaggagaatgcaaactacaaagtataattaatgctgattggtaagtgcaagttttaattcatacatgaaatatcttactgaattattgttattattttttagagacagggtctcactttgtcatccaggctggagtgcagtgttgtgatcatggctcactgcagccttgatctcctgggctcaagccattccctgtctcagcctcctgagtagctaaggctacaggtacatgctaccatgcccaactaattaaaagaactttttggtagagatgtttgttcatttttgttttttgtttgtttgttttcagacagtctcactttgtcacctaggctggagtgcactggcgaaatcggctcactgcaacctccacctcccaggttcaagtgattctcatatctcagcctcccaagtagctggacttacaggcatgcaccaccacacccggctaatcttgctgtgtttcccaggctggtctcaaactcctggccttgagcaatcctcctgcctcggccttccaaagttctgggattatagatgtcggccagtacacctgacctgaatgatttttttaaagttcaattaaaaaaaaaagtaacttgtttcttttaaagctaaagaaggaataaaaaataaacagtctgttcctgattcttacgcattgctaggaaaataattttgtcacctagaggagagaggttgatagatgatcagttgtgggtgtcaaatacacgaaggacgccgctggattctgttcaagtgcgctctgcaaagatggtggtcttctgctcatcaaatggtgtgtgagagtgtctgactgaggaagaatctttaaaatgctgtaagaaatcaggcttgtagtaagaaggaaatcacccaccagcagaaaaatgtatttccggcctttcttcctcaccctctgccactgttttaggattgctcagtttcatcaaggtttgaaggataggcaggctctcactaagagagaggtagggagaggggaggtagagacctatgaatgggctcagaggctggactgccagagtctgaaccccagcatctcttctcattagcttgtcatcttggacaaggtactttacttctctgtgccctagttcccccagctgtaaaaatgagacaaaaatgatattgaccacatgcagtcttgttgtaatgattaaaggaggtaatttttataaagcacttcaaacagcgtctggcaaacgtgtttattgttatccttatctgctaagggccaggcattcatctaggcatgggagatagattcttttcagttgccttaaaaaaaaaatcctgcaaacgatgcatgattaattcacattttgcagttgtagttatgtgacttgcccaaggttatactgctgctcagcaagggagatgaaaatctaaccgtgactgtctgggtgcggtggctcatgcctgtagtcccagcactttgggaggctgaggcgggcggatcacctgaggtcgggagttcaagactagcctgaccaacatggagaaaccccatctctactaaaaatacaaaattagctgggtgtggtggcgcatgcctgttattccagctacttgggaggctgaggcaggagaatcgcatgaacccaggaggtggagtttgtggtgagccgagatcacgccattgcactccagcctgggtaacaagagtgaaactccatctcaaaaaaaaaaaaaaaaaaagaaaaagaaaaaaatatctaaccgtgactgtcaactccacaacatgggccctttgcaaacaattgcatatcggcagccttacacactgaaactaaaactaaatcacctcactccttccagtgctctgggctgcatatccagaacaaattattaaatgccttgacttcttttatagcttaagcaatctgcaagttaaggggttatcctacttctagagaatgctggaaagcttaatgatttctcctaaaaagagatgatccatctcgaaggaagtggatgagaaagggaacaggtgtttaaaaagtatttttatattaaaactgggagctgtggctgggtgtggtggctcacgcctgtaatctcagcactttgggaggccaaggcaggtggatcacttgaggtcaggagttcgagaccagcctggccaacatggcgaaatcccgtttctactaaaaatacaaaaattatccgggtgtggtggtgcatgcctgtaattccagctactcgggaggctgagacacgagaatcacttgaacctgagaggtggaggttgcagtgagccgatctcgccactgcactccagcctgggtgacagtgagactctgaaaacaagcaaacaaaaaacaaaaacaaaaacaaacaaaaaacattgacagctaccttttgagtaaaaagccatcagtacacaataaaatctttctgtgggaaaaaggcaaagaaataaaggttgctactgtgtgaataatttggcatgtctatctagctatatgagcattgtgcttaaaatattaaggaaattaagtatgggctatacaatgtaggcataatgtgtatctgaaaaaatcctgtgtagatggaaagtgtgctgactcagctggttcagtttctgggcctcgtgtgggcccccagcagcttaaccacttctctcaagtccttggtttcctcatgggagaaatgagtatgttgaattagatgacctttcaggcatctcatcatgctgagttttttttccgcagcagggaacatgctactttacattctgtttagggtttgctcagtgaagggggagtaccaggaatctggggaattcccagaatacctgggcactatatatatatatatatttgcaacacatttaatcataaaagattaatatccttaatctctaaaaggattttaaaagtcattaagaaacaatgaccgtcttgctggaaaagtaggtaaaactgatgacttacaaaagaaaaaatatatgttgtcaagaaacagatgagcaaattttaatcttcaccagttgtaaatgaaatgcaaatgaaaacaagtcaaacttgcaaatattatacccagtgagagttgatagagagatgcagtgataggcccatacatggaatataaattggttcaattttttatctcttctgttccagcagttgctctcatatctatttatcctaaagaaataatcatatatttatattaaaaatattcactcaatgttgctatagtgaaaataaggaattattaaactatccaacagtaggcaattggttaaataaatgatgctatatttacataatgaaattttatgcagccattttctatgtcaagaatcttgacatagaatgttaaattaagacctaaatgttaaattaagaaaaacaagatgccaaactgcatataaagtatggtattcttagttttggaaaaaaatgatgcactgaataaaaaaccccagaaaaatgtatgctaatattttacagcttttggttctaggtggtaactgatttttatcttctttggatcagtgttttcgaaatgttctataatgtgtatgtactacttttataatcagaaaataggatatatagaaatggtctggaaaaaatgaggagagaagttacaatagggaggtcatcttcaatctgtttggaccagcaagtaaaagcaggaaatgctgtccaccaccaatggcttaaatatgtgtgttggatggtggtggtggttggtggttctggggttggggatggggggaaccttgagatgtgatggttttcttagtcagagatggtgctttacagctgggaagtatcttgaacttggtggaggtctatccagacatcaggcagatttcatattttcacagacaaaggctacgtttacgtctaaggggaaaacacaaaatactaagatagaaacctccaaagccccctcaccttttcagacaacaagaacccccagggcagagggtcttcctcactctcagagttactttgacttctcatctggtttcgtgtgggtaatgcattttcactcttgagtttcttttctttttaaggtattttcattatgacgtttgttcttttgcaaagagctaattctgcagaattctacccagggagggccgagggaagttagtgaaggtaacgataccagttagaaagttgagtttgggtcatctcaggggcctcctttggcctcctttggcttatgttctagagatggcccttacttcccaggaatagatagtgatgtcttactgagttgcaggtagagtctgtattgaagcgcaagattttcttccctgacttgtctgggaatccttacccaggactgtggctttcctcttccatatccctccaccaggaggcaggctctaagcctctgtgctgtcatccttttgccacttccatgaacatgccttcaaatacttgaaaaagtcactatagcgtaaagtatacttttctcttttggtgatgcttttctgcattttctctataaccagagagtaagaataaaactacagcttgggacctggcgcggtggctcacacctgtaatcccaacactttggaaggctgaggagggtggatcacctgaggtcgggagtttgagaccagcctgaccaacatggagaaaccccgtctctactaaaagtacaaaattagctggcatggtggcacatgcctgtagtctgagctactcgggaggctgaggcaggagaatcgcttgaaccttgggggtggaggttgcagtgagttgagatcttgccattgcactccagcctgggcaacaagagtgaaacgccatctcaaaaaaaaaaaaaaaaagaaagaaagaaaacaaaagcccccacgctttaaaacttttaacacgaaaagttttgaagctacaccaaagaggagagaataggctaatatacccctgtatacccaccactcaacctcaatagttcttaacacttttccaatcttactttatccattgtttttgcttgttttctggaataatataaaataaatccctgacatcttattgattttcctcatcaatacatcaacatctctatcagataagggccttaaaatacaattgacaaattgattgataaataaggacctgacaatacagttatcacctaacaaaattagcaatagttcttaaatgtcatctaatacccaggccatattcatatttatttgaatatctaaaagaatataaaaaggacttcttttttttttgagacggagtctcactctgccatccaggctggagtgcagtggcacgatcccccctcactgcgacctctgcctcctaagttcaagcgattctcctgccacagcctcctgagtagctgggattattaaccaccatgacgggctaatttttgtatttttagtagaaacggggtttcgccatgttggccaggctggtctagaattcctgacctcaagtgatccacctgccttggcctcccagagtgctgtgaatacaggtgtgagtcatggcacccggcctggacttttttgagtccaggcctccctctgttgtccaggatggagtgcagtagtgtgatctcagctcactgcagcctctgcctcccaggttcaagcgattttcctgacccagcctcccgaatagctgggactacaggcacaggccaccaggcccagctaattttttttgtctgtgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctcagcctggacttttaaaactcttatgagtaagaagaaagaagaggtggcttggggctgaggatagctatgaacagctgtgattcaggaggcagaattattcagctttgctcatctcctttgcaaggaggagagaatgaaacagacctttaaaagggaatcagaagttggagttagtgcttctaggaattgtaaacgaattcagcagtgtagacctagaaaaattttcagagtcactgatagggattcacagaaattttctgtagcttcaagggaccagcccagcctttttgttcccttctgagaccacattaaaaagacaaaacaacatacaggaagcacttcttcaaaactgcgcaaatagcacatgcgtatcgtggacacatttttaaatgcacttaagcaaggagaagaaaatgggaatcacatacaaccccaggacccagagacaagccagtgggcaccactctagacattttcacagctctggaatctcctgtacaggccattttgaaacctgccattttgaaacctgctttccacccatttagcttaggaagccttttcctgtgtctgtgaatagacccgtacgatgttatgttaatggatttcaatataggagcaaattggtttgtgcaagacccacctattcttaggtgattttttttttttttttttttgctatacataacatagaagagaacatgtttctagctaaagatttcatgtcaaagctcatgggagaggaagatgaccctggctaccccacttctcttccccttcattcagtaaacgatagccttgtcatatgacggcagcctgtggctctcctgaaagcgctctgtctcttcagcaggccccccagtgggaaacacccacctcttcatggatctcacagatctgtctctctcctctggtgctgcctatgtttgccagcagcttctcccaggcccccaggcctacagcctcagaatcaccttgtttcaggcctgcgtgtcagttccgcctcgtggatgttgctggggcttctctccctctttcttgtctcacagcatctgctctggataaagtcatccttgatcccaacggcaggagcctcccacttgcctctttggtctttcccacctgcaatccagcctaacctgccacaagaatgagcttcctacagcccagcttgatctcccattctgggctccgccttttagcccaactgagctgcctctcacccttctaggtgccctaggtttttccttcattgctcatgtttctctttcttctctgtgcatctcaagctcagtggttttaagggtcatgttctaataccatggcctccacaaagccttccttgattcctgctagttgcaggtagcacctttttccctttgttggcactttatttgttcctccctcagatccttgctgaagtttatgtctggtgttgccattagactgtaagtttttttgaaggcagaagctgtgttttctttaacttggcttcaatgcctgacacagagtaggtgctcaaagaggttagtaacatttaagttaaaagagaatggattggtaacagtttttttattttttgagacagggtcttgctttgttgcccaggctggagtgcagtggtgtgataatggcttactgcagcttcagcttcctgggctcaagtaatcctcctgcctcagcctcccaactagctgggactataggcatgctccaccatgcctggctaatttttttttttttagtatagacttggtggtgaggcaccggaggcggggggcaggggtctcatcatgttgcccaggctggtcttgaactcctgggttcaggtgatcctcctgccttggcttcccaaagtgctgggattataggcaggagccactgtgcctggctagtaacattttatgtgccaaagacccagggattttaattgactgttaactgattttaactggagtcagctggagctaatagtgtgctgtggctgctgatgagcagaaggcaaccttggattgtataaaatcacaggctcatctcccataatccctccaccggccacttcctgctccccactgagcagcccacagtgcaacctccctgaacttcttctacttccccaaatcaaacatgtattttcatgcccctgggcctttgcacatgcttctccccacccccaaagcctttcttctctgttgcttatcaaaatcttactcatcctacagatcagctgtcaccttttaaatgcggggctcccaaatcaccactcctttctcccgtctcgagaattaatgctccctctcctgtgtgtctgtagtactggttcatatcatcatcatcatagcagctactatttgctagtacctgttttgttccaggcactgttttaggctcatgacatacactagctcagaaccatcttacgacaacccctcaaggtaaattataataatggtaaatacttctacggtactcactctgtgccaggcactattcaatgtggtttacatgcactacccatttaattctgtacaaccaccttgtaaggtaggtatcattattttattttaatttttattattaaaaataataccatcaaccaactcacaccaggtaggcaccattattattgcctatttacaattagggaagaggggcttagagaagttaagtgacctttatgagatcacatagccagtggggctgaaaggcagtatggttccagagtccgtgctgtagacactatgcatagttgactttgttgtcaaaggaaccgaaggtcagagacgttaagtaattgccccaaggtcacacatttaagtggcagacattggagccaaacccaagcctgcctgaccccaggtctacatgccccttcttactctgaactacctttctgtctagtaggagttggcaaacttttttgtgtaaagaccaaattgaaaatattttaggcttggttgcaactttatgttgcagcgagaaagcagtcataggcaacatgtcaatgaatgggcatgactgtgttccaataaaatgctatttgtgaaacctgaaacttgaatttcatataattttcacatgtcataaaatattttcctcctttggatttttttcaaccattaaaaaatgtaaaaaccacctgtaatcccagctacttgggaggctgaggcaggagaatcgcttgaacttgggaggcagaggttgcagtgagccgggatcatgccactgcagtccagcctgggcgacagagtaatactccctctcaaataaaataaaataaaataaaataaaataaaataaaataaaatgaaataaaatgtaaaaaccattctcaatttatggccctacaaaaccaggtggcgggctggattcagccatgcgtgggccatagtttgacaaccttactttatagcatcgtgacattatagaatgattagataggcatgatttgcctttttgctctctttttcctagaacagttcagctcaggccccaaacatggatacccaactgagaaaacacgagtctttggtaaacaagatccacattccctaaaagaagttcagagaccacgtgtccttccctgagcacacctcttggggttgcaccctcaactccaagcagtttttcaggctattccaactattttgagaaaagaagtaggaaatgcatttccccatcactttagttttgagatgagtttctaagggtgctctgggtggttgcctagctggctagtcttgtatttgactctgaaattgaaccggactaagaactctagacctcaggcaacgattccttgattgtgctcctgggagtggaagagaccagtcagggcagagttgctggaccagaggaggggaaggggaccacggtcccggtgtgattggggaccagagggcaggacacacggctcagagaggcttcagagcttaatatgttgaaataataaaaggcttcaggacttggcaatgttttgttttaattcaactataaaggggtttaatatgcttcaggcttaggaacataaatactgcttaacattttttattctggtgaacttatgttaaaagttgcaaatcagcatcttttttttttttttttttttttttttgtagaaacagggtcttgctatgttgcccaggctggcattgaactcctggcctcaagtggtccttccacatcagcctcccaaagcactgggattacaaatgtgagccactgtgcctggccaagcaaaccagcatcttgcaaacaaactttcagaacaaaatctgtttcaaacagagatgatctatgtatgaaagtacactgacttaaaaatgatttctttctgtggttttgagagaaaatctagtgattatttgtagcaattagcaacacagtagggggaattattaagataggattcagattggtgaaataaattcttgcaagtaaaacttaagataaaatgccacttgagaagatgttcaccacaaaggtggtaaccttatttttaaaaatgctttttattgaagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaaggtgggtggatcacctgaggtcaggagtttgagaccagcctggccaacatggtgaaaccccgtctctactaaaattacaaaattagctgggcttggtggcatgcaccttgtaatcccagctactcgggaggctgaggcaggagaatcacttgaacccaggaggtggagattgcagtgagctgagattgcgccattgcattccagcctgggcaaaaagagcgaaacttcatctcaaaaaaaaaaaaaaaaaaagaaaaaagaaaaaaaaaaagcaagaactggtttattttcaggaagagaataggagtagagacctggtctgaagagctgggtacaacctagggcagtagctcatgcctgtaatcccagcactttgggaggctgaggcaagaggattgcttgaacccaggagttggagaccagcttgggcaacatagtgagacctttgtttatacaaaaataaaaaataaaaataattagctggtcatagtagcacgcaactgtagtcccagctcttcaggaatgtgaggcaggaggattgtttgaacccgggaggtccaggctgcagtgagctgtgattgtgccactgcactccagcctggcacacagagtaagagcctgtcttaaagaaaaaaaaaaaaagaaaaaaaaaaggggtggctaggaaaaatgtcttgaaactgggtctgcatagaaaacaactttgtttgagatgtcttggagaaggctgatgggaattacagtgtgtgttggtgacacttggagctgccaatgctttgaagtcagactctagttgggtctaactttgcctctgccattccttgctgtgtgactgtggccaagattgccaacctcttgaagcctctgtgattgtgacatgataatctctaaaatacagcatctcttgttcacgattatttcctcagaacctgttacagtgcctgccatacaggacaccctaagtaaatgtcttttttaaaggacatgaataaaacaattaataaataatatgtgcaaagtactcagtatagtacttggaagatgttcaataaatgtaaaatcaagtcacaaaatgacccattgacccagtaatgccacacttgtgaatatacacattcccaagaaaatcatcccccataaaagtaacttaccggctggctgcggtggctcatgcctgtaatcccagcactttgggaagctgaggcaggtgaatcacgaggtcaggagatcgagaccatcctggccaacatggtgaaaccccatctcaactaaaaacaaaaattagctgggcgtggtggtgtgctcccgtagtcccaagctacttgggaggctgaggcaaaagaattgcttgaacccgggaggtggaggttgcagtgagccgagatcgtgccagtgcagtccagcctggcgacagagtgagactccattaaaaaaaaaaaaagtaacttacctataccttacgtatataaagttatatctctgcacatacacttatgtacacatatatagctaattatggtgaaatacggaactaacccaaagacagtgaggaataggtgtgcagttaggaattgtcgaaaccgtggaaatctatttagctgaaatctagccagtgtgtagacaatgttgaaattttaaaaagcttaaatctgaaaaatatttagaagatatatacaagtgtctatttgttagatagtgaaaactagtaaggttttggagtgaaaaagtttagagatggttacaccttttttttctaaagttgcttaaggtttttggaattgcttccctttccccacaagaacaaagcactggccgggtaaggtggctcacgcctgtaatcccggcactttgggaggccgaggtgggtggatcacctgaggtcaggcgttcaagaccatcctggccaacatggcaaaaccccttctctactaaaaaatacaaaaaaatagccggtcatggtgatggatgcctgtagtcccagctactcaggagactgaggcaggagaatcacttgaacccgggaggtggaggcggcagtgagccaatatcgtgccactgcatacaagcctgggggacagagtgagactccgtctcaaaaaaaaaaaaaaaagaacaaagcactcagccccacttcccagctggggagccccatggcctcatccatcctgagaaaggcctgcttttgctgtgatgtccctgctaggctatgaaggggctattgaaggtgctggctagagatgggttgctgaggagcatggtgacttcctggccatttaattgtgttagattcatggtggaatcaattttcttagtgaatgaatcagctgctaccagcacaggtcctttgtccaaagctccttgaggaggatgacatttagatgtattctctgtaattgataggccatccccaactggcgatggactcatatttttaaaaaaagacagctgaggattccatcagcattttgaagtaagctacctccaccaaagcccagctaacttcaaacctgcaataataacaatcggttaataatagtcataatttcactttagctctatattatgatgtattgttctaaaaagactttctcgcaaaaccaagaagagagcatttccaaatgtacaaagtattgtaaaagtacaaacggaaattatttctgtattgttatcatttccacctgatccgtatgagctcacagtgaagagggcagggcaaatctgattccattttacaactgagaagacgagccatttcatcagagtggtggtttccatgtcaaatgtacatagaggtattttgggaacacagcagggggcatctgatctggcgggggcatctgatctggcgggggcatctgatctggcagcggctggggagcactggtggtcaaggaaggctttccagaaggagtgggagttgggggctgagtgaagagcaggtctttccagccaataggatggcacagagcgagcctgtggagggcgtcaggtggagaattggtgtctgttagcatggccgttagaattgaggccaaaaggaaaccaggatttcctactgaacagccctcagttctccggaggaggaaatgggttaggatgtctcttcccctaatccctcacttgtgtctatcttggtctctttgccagagtgggcagaagggcccaactctgttgcttttgcaacgtgaagcctcccttccctcctctgtctctgtgcgtgtgaaccctggaggcctgttgagggacccttttctatgaaaatggtagaaagaggaaaaagggcaagagcatcaaattatggagaccccggaggctctggaggtgaaggctcattaattctatctgattcaaagcctgagaagaacggcctggagggccactcagtgtcatcacccatgacgctctcgtaactcttccgtatgaagagacatacttgggccactcttgccagttagccacttgggaaataccacggaagactcactttttttcacccagaagcccttttagggagaatttctttaggagaaattccgctgaattcaagcccatcagactcacatgctgatgatgtaacccgcggcagctcactcctggacacatgtgacccattctgaagattatctgtcatgtccttatagggtatggctctgccttggactgcagctcctcccctacctcccctcctcccacagctccatatttaggcatctgccaaggctcctcccctcctcaaggcttatcatccatctttactgccgcacaatgatgcggtggtttgttttcgtattcactgcagcaggtaataaatgttcctactttggcttcagttttaataaaactatcagaaactgctttacagtttgggaaactgaggccctgaaagctgacttgatgggccacttggggtcagaactggctggcacatgagggtcacttgattgaacagagactttttctcctttctgactctctaggtagcaaagcttagacaggagtctctctctttctttctctttttgtagccatgtctgggtatgagacacacagaacaccctttgctggagaaacctcttttgtgctactttaaattccctacttagagttaataactgtttatcattatatttagtaattgttatttgagaatgttattaatagggactacttactgtgtgtttactatgtacatacaatgtgtttatattatgcacctgctaagaattttgcactctaggccaggcacagtggctcacgcctgtaatcccagcactttgggaggccaaggtgggcagatcacttgagcccaggagtttgagagcagtctggccaacatggtgaaaccccatctccactaaaaatacaaaaattagccaggcgtggtggtggtgcctgtaatcccagctactcgggaggttgaggcaggagaatcacttgaacccgggagttggaggttgcagtgagctgagatcacaccactgcactccagcctgagcaacagagcgagactccgtctcaagaaaaaaaaaaaagaattttgcactctcagctctaagcacacttaatactctcaacaacctgtgatacagatataatattattacattgattttacagaggaggaaactgaggcttaaggaggttaagaaaatcttccaagttcgtcacataggtagtcggttgggcagctcagattcaatgccaggtccacctgactttaaagcccatgaccttaacaattatgccttattaatttccttttgcagatattcactcaggaaatttggctttagctcagtcagtttattggaaagtttatttaaataaccaaaagggctgagtgtggtgactcatgcctgtaattccaacactttgggaggctgaggcgagaagatcacttgagcccaggagttcgggaccagcctcagcaacatagtgagaccttgtctctacacaaactaaacaaaattagctgatcttggtggtgagtgctcatagtcctagctacttgggaggctgaggtgggaagatcacttgggaggtggaggctgcagtgaaccaccattgtactctgtctccagcatgggagatagagcaagactctgtctcaaaaaataaataaaggtggccagtggctgtgtgtggtgactcacgcctgtaatcccagcactttgggaggccaaggcgggtggatcatttgaggtcaggagttcaagaccaaccttggcaacatggtgaaaccctgtctgtactaaaaatacaaaaattagctgggtatgatagtgcatgcctgtagtcccagctgctcgggaggctgaggcatgagaattgcttaaacccaggaggcagaggttgcagtgagccgagatcgagccactgcactccagcctgggcaacagagcaaaactccatttcaaaaaaataaaattaaaataaataaataaataaatgtccgaagcatgtacatttttcctaattctggccctgctacactggggtcaaataaaacttaaggccaggtgcagtagctcatgcctgtaatcccagcactttgggaggctgaggtgggaggactgcttgagctcaggagtttgagaccagcctgaacaatataatgagacccccactctatttataaaaaataagataattaaattaaattaaaaaaataaaacatagaaatgtcttaagaggtcttggctctggactaagtcacaaatgcatatatttaagttgcctcttggtctaaggatctaaagtttaaccgaagcctatggagccctcaaggagtccttcctcaaaggtctagtctcaaatggggtccatgaccacggtgtgtgacagtaacctggtgtgagtctggagaaagagtccaggtaaacatttggcaaagtggtccctccgctatggacattcaggatttggcatttcagatagtagtgaaatggataactcgatggcttcctataattcccagatgccaggttttgtgctaaatcagactctccacattctgaatccttacagtgatcacatgaggaaagtccttttcttattttcatttttatgagaaaaccaaggttcagagaggttaagtaatttggccaaggtcacctggcttacatgtgtttaaaaacatgaatatgtatcatgtgaattatttatatggctaactcatttgcaaaagctattaggtataattaaacaacagggacagtgggttgacgaggataaaaatgtcttggcagccggacgcggtggctcacacctgtaatcccaacactttgggaggctgaggcaggaggatccctgaggccaggagttcatgaccagcctgggcaacatagtgagactgtgtctctacaaaaaaagcaataaattagcccggtgtggtggcacacacatgtagtcccagctactcgggaggctgaggtgggaggatctcttgagcccaggaggtccaggctgcagtgagctgtgatgacaccactgcactccagtctgggcgacagagcgagatcctgtctcagaaaaaagaaaaagaaaaaataaatgttttggaaaggaatgccaggatttagagaagtgacttaaaaattatgtttaaatcagacgtgtaggtttgctttgtattgccctgcatgacacatgtcaggaagatcgccagggaggggaggttacaagcccaggttgcaggaataacctttactctgaattttggtctgaaagacttttccttcgtctggagctgggctggccttgtgatattgtgccacagcagacacgacactgtctccaaggcggagctcattgcctggggctttcccactgcactgaatgagaatttatttggcctttaatgaaattcagattgtcccatttatgcagtcctctgtttaagtgacaggcactgaatatggttgctttcaagcaagttattttgtttaaccaggggcctagcggagttcgggatacacagatggccaccaaaaatgttaaaagaaagaaataacttaatcctcacagcatctctgagaagtggttcctaaatttatcacaatcttgcagatgtgtaagctgaggtgtggagttcaagcagcgtgctcaaagccatgtgtaggtgacagtgcctgatttcagatgcagataactctaaggccagtctgttgcatctcttaccagtttttggaaaaacctcaagggaaaaaccacagcaaatttttagagttctagtaatttcttttcccctattacaacacatattcccataaaccaaggactgtgtgattagtcaataaacaaaaagaaatgcatatagtatctgtcgctcataacgttcttgtttcttgcagtttccaacatggctagatccatcagaaactgaagccgtggagaacgctctcggggcctttgccacttcttggagtagaagccgacagagagctgtttggaaacttctccttcacacaccaggttgctactgaggtctatttcatgttgcagtcagagcagttgcttgtgttttttagtgcttgagtgattttacagataaagtcagcttctgcttcttgaccgggaggcatttgtgtgtgtgtgtgtgtgtgtgtgtgtgtgtgtgtgtgtgtgttgggggaagacagatctaagctctccctgtgaggggaagagtggattgcacaagcggggttggatggctacactgagattaccccacatttaatcagtttgccaatgaggaagccccttatcttcaaaaaaggcaagaaagaaagaaagacttcattttcccccttctctttctgttccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcactttcacttctggtagggtggttcccaggcgactgcaggtcctgtgaaagacaggggtctcaaagttctgttaatttcacaaatttgttataaatttgtctaaactgagctgttgtggcaacataatttatgaatcgtaaggtctagttaggcttattggggggatatctacatatatatgtgtatgtaagggaaaaaaggtagaatttacagccttcaaaaaagaaaaatcaaattccaagcacaggaataagaaagctatatagcaactgctcagagaacagaaagttatcaggggaaatactgaataaatagacacacacatactcgcacacaacctgctctcacacacacaactcaaacctcattctatcgaatagtttaaaagcaatggtgttgctcatctgttaaagtggagaacagaggactacataacttaaggtagaaattgcaaaggctgggttgggcagggcgtggtggctcactttgggaggctgagacgggtggatcacgaggccaggagttcaagaccagcctggccaacatggtgaaaccccgtctcttctaaatattagctaaaaattagctgggtgtggtggcacatgcctgtagttctagctactcaagaggctgaggcaaaagaattgctcgaacctgggaggcggaggttgcagtaagccgagatcgcgccactgcactccagcctgggcaacagagggagactccatctcaaaaaaaaaaaaaagaaaagaaaaaaaagaaagaaattgcaaaggctggcacctagatagatcaatcaattactgccctaatcaaaacttagaaacactctgaaccacctttatgaaggtacatcattgttatggggtaacgtgactattacacacaaaaggtaaggtggctggcataaatgactttgattagaattatgttgacatagccaaaccagtttctctgttcccttgtgtggtcaattccttacagctataatcagtatcaaaaaccaaatgtgtgctcattcacacattgctttctccttctctctctcctcctatccacagccagtaaaaggcctgggaccggggtcttgatctctggtgggaggattgcctcggttccctggggctgacacagctgccttcactcagacttctctgctctccaggcggtggcttgtactcacctctaagtcacccgcctcccttgattggagagcccgtgtctctagttctcagctcagggttggggggcttgaaagatgaccgggcaggggaggggaagggatctcatatcctctgatatccctgggattctcttcttctccctcaacccacagagtcttaaatcacggatgcgggtgttcagggccagcctttgccatgagaggtatttaacatgtcagtgggaaggaatttctattcactgcagtgggctgtcccccaggcttttctttctctcttgttgaagagagatgggggtgggtatctgaaagtgggaagggccaccatacatgatcctaagtgaaggaagaggaggtggttccacggtggcagcagagcaggaagggaaggccagagagggcacactcaaatggctttgctgtcacctgggcaaagacacacaggtgagacctccacctgttggcgggagccaagcttaacagctccgtctgggaactctcatacctgagaccaggaatctatgtgtaaaccctttccagtggcagaatctggcagaaatggagccgataagtgtctgtcttcctgctagactgctgttcttgaaggtagcactgcctcctggtctcctcagtgtccccagggctcagcacagggaaggcaatggaggtaaagttgtgttaaactgaaatggagagaaagacagtaattgggcttctgtgccacacagtggttatagaaagcaagcagaccctcaccagccttgtaggggtaagaagaaaaataggtcatatgggtagaatccgtgtgttgtgtgttctacataagcacatacttacttttgcctgcctagatgcagacacaggtttcttatacttcaaaatttgtggtacctttttgtagactattgcatatcgattcttaactattccaagtagcagcattaaatatgttcttgatgacattaaagagttaattttcatggtcgggtagttcattcttgtctctgtcagcctgggctgctatagtggaaaaccatagactaggggacttcaataacagaaatttatctctcacagttctggaggctgggaagtccaaggcaagggacagcatggttgggttctggtgagacccctctgcctggtttgcaatggctgtcttcttgctgtgttctcacatggtagagcaagagatcatctttctggtgtttcttcttctaaggataataatcccattcatgagggctcaaccctcatgatctaatacctcgcaaagtcctcacctccaaataccatcacactggggattaggcctcaacattttgagatttgtggggacacaaacattccatccatagcaattctattctgtcttactttccactgactagttaactgggcagcagaatccagtgcagtgagtgacaagaaagctagaagcatcctgattaagtttgttcagtgcttcagatgtgctgtgccggccaccgagcgaagcattcttttgccacatgtgtgtaggcccacattatactgagtcccatcttacatgaggaaactgaggctcagcatgttgatgtgacaaggccaagcccatgcagcaggtgagtggctgccccaggagtctcaagtgggtctgctcaaaaccaccctgccccacttcctcccagagcagcttgactgaatggctttgccacatccgacctcatgtagcttgcagctccacccctgccagtcaagtagcctgtattttaaaaaatatatttttatttttattttttaatttttagattttttttatttttttgagacggagtctcgctctgtcacccaggctggagtgcagtggtgtgatctccgctcactgcaagctctgcctcccgggttcacgccattctcctgcctcggtctcccgagtagctggaaaaatatatttttaaataaaatattccaagtctgacctttgtcctgcccttgtctttctggcaatgagaatgggacccacctatgtcacacaacaccatcatttgcaaaggtctccattccaatccttggtatttaaagcataactccaaaggctgattgcatataaattggcagagatgaaatacaccattatttaatgttataaaaagcttgggaaatattctctttttctttttttattaaaaaactttttttgagacagggttttgctctgacacccacagtggagtgtagtggtgtgatcatggctcactgcagcctcaacttctggagctcaagtgatcctcccacctcagcctcccaagtagctgggaccatgggtgcacaccaccaaacttggctaattttaaaaattatagagacagggtctcactacgttgcccaggctggtcttgaactcctgggctcaagcgatcttcccaccttggcctcccagagtgctaagattacaggtgtgagccactgtgcccagccaatattctctttctcttcattttttgtttgtttgtttgttttgttttttggagatggagttttgctcttgtcgcccaggctggagtgcaatggtgcactctcggctcactgcaacctctgctttctgggttcaagtgattctcctgcctcagcctcccaagtagctgagattacaggcatgttccattacgcctggctaattttgtatttttagtagaaatggagtttcaccatgttggtcaggctggtcttgaactcctgacctcaggtgctccacccgcctcggtctcccaaagtgttgagattacaggcgtgggccaccgtgcctggccaatattctctttttcttatctcacttttccacccctcaggtttcaggtatttcctttgaacaagggagtgacagggaagaggagagtttggctcttctctttcaaggatttcgtacttaggaggcgccctttacccagaatgaaatgtgatgaaaggactcactttggtgcatctgtagagttatgacatgacagaggggacagggctctgtgagtgctcggccccagtgctgagaaagaaatgcttacaagttgagtggggtcagtacaactcaatagtaggaacttacttttcgtgagactgtatctgtccagataaagcaaagaaacataatcaatggctaagatgtcaagcaggttttcacaagaaaagataagctctgaaaattatttgagctatgagttcataaaaagttcttgattaaacctgaagtctacattagctttttggtagattctaaaatgcatcccgacctggaactcaatactaatggtagataaaaagccatgatgagggagtggagagaccagacaatcgtgatgtattctggggtcagaaaatctgggttgtgtatctttcagccttagtttccctttgttaaagcagagatatgaattcctaggatactgtataaatattggtacaataatgattgtgggccgggcttgttggctcacgcctgtaatcccagcactttgggaggccaaggcaggcagatcatctgaagtcagaagttagagaccagcctggccaacatggcaaaaccctgtctctacaaaaattagccgggcgtggtggcagacacctgtaatcccagctactcaggaggctgaggcaggaattgggaggcagaggttgcagtgagccaagatcatgccattactccagcctgggtgacacagcgggactccgtctcaaaaaaaaaaaaaagattgtggaagtgttttatatttgtaaactattgttcaaatggtgttgttattatgtttttggtagatcccaatgcagagacataggctgaatattccagatcagattagaatatcctaaaacttgttaaaaagtgggtcataggatgaaaaattggcacagacataaacaccacttgtaacattgttagctagagtaagatgaataaaacgatacttagggataatgataatagcaacaaaatacattggaatgcctgctggttccagcacccctggtaggtagtttaggtacgtcatctcatttaatgctcataacaattcacaaggtagatattctcttcctgttgataagacactgaggctgggtgtggtggctcatgcttgtaatcccagcactttgggaggccaagggtggtggatcacctgaggctaggagttcaagaacagcctggataacatggtgaaaccccatctctattaaaaatacaaaaactgggcctggcacggtggctcacgcctgtaatcccagcactttgggaggccgaggcggctgtatcacgagatcaagagatcgaggccatcctggccaacatggtgaaaccctgtctctacaaaaatacaaaaattagcagggcatggtggcaggtgcctgtagtcctggctactcgggaggccaaggcaggagaatcacttgaacccaggaggcagaagttgcagtgagccgagattgtgccactgccctccagcctgggggatagagcgagactacgtctaaaaaaaaaaaaaacaaaagaacaaaaaaaccacaaaatgtcccagttttaccaagtaattttggcataattaaacttgaccagctaaaaattatatctataattatattaagtgttcattacacttgctaatttaagatggtgacaatgatccttgttacatactgcagggaaatggtgatgatgagagcttggcagtcttcctacgggagcttccttttgtcattcttcccataataaaatctcaggtaattcacgtcccactgtcctggctgctctctgcttgctgcccccactcttccatttccatctttcacctttccctgccctcctctgggcctgggagactaaccgtgtggactgaatcacccgcatctcttcctgcctggcttccacttgaattcagccagtggacactctggcaggaaatcagagggtagcaggggagaacagttggctgttttttccctatgcgtttctggctttggtgctacttatttggcaatagtcatgagtccctccgtggctccagctcctactgggaagtttctcttccatggctccagcttcggccgggcgtggtggctcacgcgtgtaatcccagcaatttgggaggccgaggcgggtggatcatgaggtcaggagatcgagcccatcctggctaacacggtgaaaccccgtctgtactaaaaatacaaaaaaaaattagccgggcgcggtggcaggcgcctgtagtcccagctactcgggaggctgaggcaggaaaatggcgtgaacctggaagccagagcttgcagtgagcggagatcgcgccagtgcactccaacctgggcgacagagccagactctgtttcaaaaaacaaaacaaaacaaaacaaaacaaaacaaaacaaaacaacatggctccagcttctactgggctctagggcagtgcttcctctcctcgccctcaaccctatggggggtaatggcttcctgctggtccttgtctttggatgcagcagcatccttaatgtggtcctttgatcctgacctaagtagtgctttcattcaagtctcttcatttgaatcacctggaataaatttcatttcctgtaggactctgagtgatacactcattagtcatctacatagtctgtcattaaatgattactcaaatccctactgaaggatatgagttgcaggtctgggcaactgccttttcctgagcctcaaaacctacgaaataccactcttaacatctatttgcttggaagagaaaggaggagtttggttaattctaatctgaatgaacaaaagaatagttctgggatagcaacattcaaaaattgtggatcttctaacaatatatttatattcaagaagctctgctattatccataatatataaagaacaactataaatcaataagaaaaatagcccagttttaaaccggatatttcccagaagaaaaaatacacatgaccaataagcactggaaaaggtgcttcttctcacttgaactcaggggaatgaaaacaaaacctatccacaaaataccattttcaaaccaccatattggcaagggaattcaaaaatatgacattggctgggcatggtggctcatgcctataatcccagcactttgggaggctgagcctgcccaacatggtgaaaccccgtctctactaaaaatacaaaattagcctggcatggtggcgcatgcctgtaatcccagctactcgagaggctgaggcaggagaatagcttgaacctgggaggtggaggttgcagtgagccgagattgagccactgcactccagcctgggttacagagcaagactctgtctcaaaaaaaaaaaactataaaaaaaaaaaactttccagatatggtggcatgtgcctgtagtcctagctactggggaggctgaggcaaaaaaatcacttgaacctgggaggcagagattgcagtgagctgagatcacatcattgcactccatcctgggcaacagagcaagactctgtctcaaaaaaaaaaaaaaaaaaaaagaaaaagaaaagaaaagcatgacactattgaccattaataaggaaatgaaacaataggaactcagatgctgcttgcaggagtgtaaattggcataaaattttggcattagtagtgttgaatatcctatactcttaacccagaaatttcatgctctagagatatgttggcatagattttctgggagacatatacgaaaatgttattagtagcattgtagataatagcaaaaactagaaatgacccaatggcatcaacagagaatggctaaaaaatggtgtattcacccatggaatattatgcagcaataaaaaagaatacattttagctatacatatcaatatgaacgagcatagacaatgttgaaagaaaaaagcaagtagtaaaataatatatggagtatgatttcacttatatgaagttcaaatgcaagcaaaacataatagtgttagggttaaaaatggttttctgccaagtgtgatggctcacgcctgtaatcccagcactttgggaggctgaggcaggcggatcacgaggtcaagagatggagaccatcctggccaacatggtgaaaccctgtctctactaaaaatacaaaaatcagctgggcgtggtggcgcatgcctgtagtcccagctactcaggaggctgaggcaggagaattgcttgaaccagggagggggaggttgcagtgagctgagatcgcgccagtgcactctagcctggagatagagcgagacttcgtctcaaaaaaaaaaaaattgttttaaacacagaaatcattaaagtaagtgattacctcttctggtcccggggtgtcacaggtattggtaatgttctatttttaagtttgggacataggcacttgagtgttcattgattttttcctattatttattcttcaaaatatccagatatattttatgtattcttttgtgtgtatgatataattaattaaaaaaatttaaagtttgggttctaaagcaaaactgtctgaacttgaatctcagctctgccactcactaggctctacagccttgtgtaagttaactaacctctctgtgtgtcagtttcctcatctgtaaaatggagaaaataacatagtgagcattaaaggagctaatgtgggtaaaggctacactatgtctagtacaataaatggcagctatgtcattctactgttatacacctcagagctggcaggattctactgtttatggatgaagacacaggtattgagaccattgcctgacctgcctaagcccacaaattggtggtagacccagaccacctcactcgtcctactctttgctgctcttttctgtaaacttcctaagaagagaggaacctggggtttttacttgttcacttttcatacacttgcttttcaacccatgtttgctgtacttgaattctttctagtattgtttcttagcacaaataggtaactttcaatatctcacagaagggatcaacagaggctcagtcccttatcgtatgtgaagacatctccattcacttgtttatttactcagaatgtactgagttctttaggttctttacggggtttattcagagaaagtggaggactcagtgactcacagagcatctctccatagctggacttgccgtgttgtttcctaattatttacttgtgtttctatcattgcaccttggccttagtgtcaagctgtgcaatagccaaagttcccgctttcatagagtttaaggatttaattagggataggggtgtgaacagtagttataaaataaacagataagatcaatgtagctgggtgcagtggctcacgcctgtaatcccagcactttgggaggccgaggcgggtggatcatgaggtcaggagatcgagaccatcctggctaacacagtgaaaccctgtctctactaaaatacaaaaaattagccaggcatggtggtgggcgcttgtagtcccagccacttgggaagctgaggcaggagaatcgcttgaatccaggaagcggaggtttcagtgagccgagatcatgcaactgcactccagcctgggcgacagaaagagactctgtctcaaaaaaaaaaaaaaagaacaatgaacaatgtagatggatgttcggtgctattaagaaaataaattaggaaaagggagagaggatatttagcattttggtaggatagggaggcctgatagagcagaggcccgaatgatgttgacagaccacatcagtgatctggttttaacacaaacaacctctttgtaaaagaaagcaggcttaggtttttccctattgccctgagagggacacacatgctttttaccatgatgagtgttcaatattgcacagcaccctccagcagtgactgccttcattggggattctaatccatctgtctgc

SEQ ID NO: 1637 - DNA, 2108 bp, Homo sapiens
agtaccttggatttctgagtgggcaaggctggaccctgagccctgggacctctgaagtgaacactgcagggccatttgttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttgggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcactttcacttctggtagggtggttcccaggcgactgcaggtcctgtgaaagacaggggtctcaaagttctgttaatttcacaaatttgttataaatttgt

SEQ ID NO: 1638 - protein, 191 aa, Homo sapiens
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 1639 - DNA, 34378 bp, Mus musculus
  misc_feature (1)...(34378): n = A,T,C or G
tcatacctacaataaagaccttcccttagacaagccttggggctgtcacttcatcgatttattcggggctcaggtcacttctgttccaggaaagaaatcagttaacctgtgtcagttaattttactttttgttctagtctttgattcgtgggttatatgagaggaaattatagcccctcccaccccccagcttttatccaaattctgaataagattctttttctttgctgatttgtctgaaccttctttggaatggagagacactgaggtggcgggtttattggctcatgtgcccagtaacacggtttagattccaaatgaattatgtcttagtgttaccattgctgggctgaaacaccataaccacaagcaagctggggaggagaggccttacttggtttccacagtgttgtccatcattggaggaagtcaaacagtaggaactcggaggcaggagctgatgcagaggtcatggagggatgctgcttactggcttgttccccatggcttgctcagcctgtttcttatagaatccaggaccaccagggatggcaacattaggctggaccttcccccatcaatcactaactaagaaaatgccctatagccaggtggtggtggtggtggtggtatgcacacaagaggcaggccaatctctgattttgaggccattctcaaactatagcgtgatttccaggacagccaggagtacatgaagaaaccctgttttgagacacacatacacacaacccagaaaagaaaagaaaagaaaagaagagaagagaagagaagagaagagaagagaaaagaaaaggaaagaagaaaggagagaaagaaaaatcctcgacagctggatggataaagaggcattttcttaatccctcctctcaaatgattttagcttgtgtcaagttgacataaaaccattcagtacaaattccatttcccaggttttgaatgcgggacttcccacctccgagaccggtgctgcaccgctgagccacatcccagcccataaatagtatttttacaggtattgcttgcttaaaatagtagccatcctaaaaataccctgccctcctctgtccttcctctgtgtgggaagggtgtaaataagacgtttggcagctgaacggttctggggcgttgggaatagggtgaaagggcaatgaggttgctttgctttcagaaacactggctcgccgaggccaggctagcccaacgctggcccgctttctatcttgcccaatcgcttcctcctccagcctgagcagagtcctcagccagccttccaaatgacctatatgtgtcattgtctggagacctctttagggagtggcctgtccctgtccttgttcagttgacttccctgagagttaagcaggaaagaggtcctgggagcatttccagatctcagagctggagctgtcagaggagagaaagatcctccaggctagctaacctctttgtgttttgatggctcccgcggctgcacagtgggtgtcagaaggcttgctgaagctgggttttattgctgtttttcttctgggttgaggtgctcttctggggttctcccagactagtttctacataaaggggagggggacagttggaggagggcaagatcactctctggcttacattgctggtgccctttctgccctagggcaaggccacacacgcctcccttgcttgtgaagccaaaatgcctcagttctgataggagcggctatttttctccagggacagctgacccttactctgacctctggctctcctttggccatgtccaaccccggaagcatcctcgatttcctgttccctccctcaccaaggaggaaaggcccttgaagcccaggccctctgcgcaagagtcttccctttgtccagggtcccctgcagagttcagccccagtaacctcccgcagcccagccccctcccaccgaccccggcttgcagacagctgtggccctctgcggaaatggcccgagacggcagcatgtggacagcaaatggcgactagtgagatctgagcaccgcaggagggaccctggctgaggcaagctgctcaggtcacctgtagctggcgggctgcgggctgttgctgccctcttgtggtcgagagcagaaccacaggactgctgccaataagagaaagcaaagtatccttattttcagatgataggattctatacatgagaccttaaagactccaccagaactgtctgagaactgatgaagataaacactcctaacaaaatagcaggacataaaattcatgtatacatgtctttaggcttcctgtatatcaataacaaacatggcgaggaagaaaccaggaaaatcaatccctcttgctcttgtaaactaagcctgaagatctgaattcattcctccaaaccaagatagtggacgaccagaaccaattcaggcaagctgttctctggcctatacacatacactgccacaggcatgtgcccttttacacccccccccccacacacacacacaaatgacggatagatagatagatgcaaaactttaaaacaggggaggggtggagaaatggctcagcggttaacatcactggctgctcttccagagatcctgaattcaattcccagcaaccacatggtggcttacaaccatctgtaacaggatccgacgccctctttgggtgtgtctgaagacagctgcagtgtactcatatatataatattattgtatattatatatatacctcttttttaaaaaaactttgaaactgtctaaaactttaatacacctttgagtaaacctaaggaactgaatgtcttctatgatggaaactttaaaatgagagaaactgagagggcttgagagatggctcaaaggttaaaagtactggctcttcttcccgaggatccaagttcaattcccagcacctacgtggcagctcacagctgtctataattccagttcctgaacttctgacaccctcgcacagacatgcatgcatgcaaaactccaatgtatgtaaaataaaaattaaagagagagagagagagaagttgaagaagtcagaggatggaaagacctgtcatacctctggattggaagaattaataccgtgagggtcttctaaaaaccaccatggattcagtgcaacccccatccatctccggagatgtatttttgtttttgttggagacagtctctctctctctctctctctctctctctctctctctaggtttttcaagacagggtttctctgtgtagccctggctgtcctggaactcactctgtagaccaggctggcctcaaactcagaaatctgcctgactctgcctcccaagtgctgggattaaagacatgtgccaccatggccggctggcttctgtttcatagctatttcagaccccacatgcattagctttcaataattctgtttgggctctgtcccatttctaagtttagggtagctctgtatagttgtctagtcttttttttggggggggagtgcggttttcaagacagggtttctctgtatagccctggctgtcctggagctcattttgtagtccatgctggcctcgaactcagaaatctgcctgcctctgcctcccaagtgctgggattaaaggcgtgcgccaccacgctcagtttatagttgtctagtcttaagtccatttttgtaatatatcattttctttaaaagtttcccatcctttccccacttctggacacaggaaatagtatattctctctctctctctctctctctctctctctctctctctctctctctctctctctgacagtgtgacactatacaatcctggcagccatgtctagccaggcaacagtgaatcctttttaaagtctttcctcgtttgtagtaattcatcttggtctaaggttcctaatccagaatctatatttacagcatggtctctgtcgactctcgattttgatgaagtcactgtgaatgctgcccaccattggagatgactttcaggggaagaggcacggggttgaaacaatgctgactgtcctggaattcactatgcagaccaggctggccttgaactcagagatctatcggcatgcaccaccaaacccagggtaaaaagagtcagcctaggagctccagaaacaactcaacaggtaagggtccttgctgctgagtcagaagaaaggagacagcctgcaagttctctgatgtcctcagacatgaactcacatccaaacacaatcccagcttcccactcctacaaacacaataaacttaagcatgataaaaaaaaaaatactactgggctggagagatggctcagcggttaagagcactgactgctcttctgaaggtcctaagttcaaatcccagcaaccacatggtggctcacaaccatccgtaatgagatctgatgccctcttctggggtgtctgaagacagctacagcgtacttacatataataactaaataaatctttaaaaaaaatactactaagtggtggcacatgcctttaatcccagcatttgggaggcagaagcaggtggatttctgagtttgaggctagcctggtctacagtgagttccaggacagacaagactatacagaaaaaccctttcttgaaacacaaaaacaaaaacaaagctactaacatattgaaagaaaggctggagagatggctcagcagttaagagcactggctgctcttctgacggtcctgagttcaattcccagcaaccacatggtggctcacaaccacctataggggaaactgatgccctcttcaggcaggctggtgtatatgcagcagaactctcatacattcaattaaaaacaaaaacaaaaaacaaaaatcaccaaaggagcattgactgctcttctgacggtcctgagttcaagtcccagaagccacatggtggctcacaaccatctacagctacaatgtactcatatacataaaataaaataaataaatcttttaaaaaccatgttaaaagagaatttaaatacatacatgatacaattcaacaagttaagactagctacctacataccgttagactacaaaagttttgtctgccataaggtttaggcaaactttattaccacttgggatttattttgtaagatttatttttgtttgttggacagtaataccccaccaggaagcttggtaagatagaacaggttgagactcagtgggcacacaccagagacttaggctattccccactaatgtcagattcctggcctggaaccttatgtcatactcctcacataaggaaacgagacctgtggtaatgtagtcctggatcagagttctccgtgctaatgagttacctagaggcctggagggcttagcttagccaataagctttacttcccagacattctccagaacgtatttcatctacagaaggtgtttaatctcaggtccaccccgagaagtgggtatggtatagggtataggtatgcatccattttctgtcattaacagtcaataaacagtttagaatcaggaactgtctctttcatcaagatccaccactgggagccatggagaagacactcacctacagagccgcagcttaattctcctgtaaacggcctctgtgtgctttctgcctgcctctgccaagctaaggacaatcactgctgggacacgccggagctccccttccccatgccccaggctagcctgtccctagcccgcaccctctctccccagctctgttcttggctcttctcccagcacctggatgtccaagaatctgaggacctcacagccctgacctctttgcagatccggggacccctagccccagaaaagggcactgggtcatctggaactggagttgcaggcagttgtaaactgatgctggtactagaactcaggtcttctggaagagtgacggggattctctgtgtatccctggctgtcctggaactcactctgtagatcaggctggccttaactcagaaatctgcctgcctctacctcccgagtgctgggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttccttctaccacgttagtcccaggagtgagactcaggtcatcagagagccaaaaatctcacatgtcaaccctatcactgaagttttggatacaaaaggtatttgcttctccctgaggaagaagaaaaagaagaggagaaggaagaggaagaagaggaggaggaaaaggaggaggaagaagaggtaatgaatggttccttttatttctggaggaacaaagaaagagaattcagtgacacagactggaccaggggcttgcttctgtgatgtccagtgatgccatgcgtcttcatagcgtgcagagtataccttaactatctaacaggcataaatacagctaaaacatgttacaagtctgcagacatttccttacctacaaatttcatgaaacgattaccaaactattcattaaagtttaaagccttgttctgacaggcacttagaaactgtgtttgttttattttatttttttattttatgttcactggtgttttgactgcatggatgtctgtgtcagatgtcaggagccctggaactagagtaacagacaggtgtgagctgacatgtgggtcctgggaattaagccaggtcttctgaaagagcagcccctacatggactttgtttaaaaagatctttttctttgagcttataagacaatctaacgcagcaagggatgtgtttttaactgaatcttgacacaagctacaggaacttagggatgctggccatagtggattaccccgcacttgacagacagaggcaggtggatctctgtgaattcctggctaaccttcattacctagtgagttccagactgagaatcacatgttgaaaacttgtcttaagagaaaaacaaaggccaggcagtggtggtgacatatgcttttaatcctagcacagagctagtttcagtacagctagtgctgtatagagaatccttgccttggaacaaagaaaagaatagcaattacacatgaaaatcgatttttaaaagaaaggatgagggttggatagggggctcactggttaaggctaagagcatttgttgccttgcagaggaaccaggtatgattcccatcatctacatgatgacttaaaactatccaaatcccaccttagagaaacatacacattgttctcaaacattcatacaggcaacccttcatatacacaaagtaaaataaatctaaaaaaagaaattaggggggctggccagatggctcagtgagtaaaggcactgactgctcttttgaaggtcctgagttcaaatcccacaaccacatggtggctcacaaccatccataatgagatctgacgctcttttctgttgtgtctgaacacagctacagtgtatgtataataataaataaatctttgagctggagcaagcagggactgaacgagcggggctgaccggagtgagcagggttgactggagcaagcaaaggtcctaaaaattcaattcccaacaaaccacatgaaggcttacaaccatctgtacagctacagtgtactcatatacataaagtaaataaaatcttttaaaaaagaaattagggcgttatgatttatctgtaagtcataagatacttttgcaaggttttggtctggttaagtaagttttgaagtgatcatttttttaggatttaaaggatcattagtattttagtcattgatttttttggcgggggagggggggcagaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctctgtgtggccctggctcttctggaactccctctggaaagcagattgacctccaactcagagattcacctgcctctgccttgagagtgctgggattaaaggcaagtgccaccactgccccaaggtccccggtttgtttttctgtctgtttatttgtttgtttgttttaaaaactttcttatgaaaagcattgggaaggggtggagagatggctcagcagttaagagcaccgactgctcttctgaaggtcctgagttcaaattccagcaaccacatggtggctcataaccatccataacaagatctgactccctcttctggagtgtctgaagacagaagtgtctgcagtgtacttacatataagaaataagtctttacaaaacaaaaaaaaaaaaaaaagcattggggaaaaaaaagtcacagagccagactacacaattcaatgaacttccattcaggacagaagctgtggtgttttacactgtctctctcagatatgtttttatgcacgtatcctgttgctttcagagggaccctccctattaccagttgtatccagacttagtgcaggatggagtgaagactgagctctgaagatctggtgaggggtaaaatatgtgttttcacaggggaggctgtcactagaacaagtgtgggtacatttaaaaccctcaggctgctaaattggtttctttatatcatcatcatcatcatcatctagataatgtcttggggtgatccttctgcaagcctctggagcgctaggataataggtatgagccaccacctcacctattcctaaattagtttcttatttgaaaagcgggaagaggttaaaacaaaacaaaacaaaacaaaacaaaacaaaaaccaaacctggacagggtatcccctgactgggcttaggtgctgtgtgctatggtgggtttgactaacggcaatacatcttccaatttttcatcaacagcagttactctgatttatgatcttagtcctcaaagctgagaagcaatggacacaacggaagtgagttagcgcggagtccttgtgcattcctgaccctccaacccattctcttcgactcactactttttttggcatgattatatccaggaacaggtcaaagactaaggaagagagcatctcacacctttcaaacaaagcgaagagagagttctttctgcagcaggctcctatgtcaggatgaccagactgacttccactgtccttgctcactgacctaagcgtattctctcctcagagtgcttagctgtacacattacatgtttgttgaatccattatctgacttctcgggacagtgctctttttttttttttaccttgtttcgtacactgatcccagcctccctaccaagtgtgaatcaaggagatctttccttcccggattttgggtcagagcccgcaggaagtaggactgccgcgcatgtttactgagtaaaagattttaaagagtaagaagcagcacgccattcaacattctttggatgaggctcagaggatttaggtctcaaaacaatggtcttcttccccaattcaaggttaggctgccttgttccacacggtcaccccagctccaaaaagtgccgaggaacacgctcccggaagtcagcaggtgcactgattggtcaggtgtctgtcctcccagcacgggtggccgcgagtcgatactcgctgaccccaagtctcctctcggggaagcgagggacccagagcctcgccattcagtgtcaggaacgcgctctccgctccgaactcgcaacccgagcccgagctccacggtcggactacaacccccgagaggccctgcgcgggcggccgctgattggttgctcggctgtgcgtgggaagggggcaccgggctcgagagtgggagagacacacagtctgcgcgtgcgcgcgacgggcgcgatggctgcgctcgccgggttaggggttctcggcgccgggcgccatctgtggaaactgcctgtgcgcctgtctgcggggctccagggctgcgggccccggaggggctacatcgcgggcagcgctgaggtgaggacgcatggggtctgcactcgcagggcctgcgggcgggagggccgtgcgggccactgagcatcctggcctggggccgccctcccggagaccgtggagccgcggaacccttcgtccttcccgaagcggtgtccgggtgcgcaccttccacccgctggaagagtccttgtccggagaaaaaccaaccccaggtcagcctcgggtgggttcgcagctccttcccgcgcgtcaggaatgtgcctcagcagttaattcgtttccacttctgctcgaagtaagggttcgcggattcttatttctaaaaaggtaactgtttgaatatggccagtaaactgtacggctcaggtgtgcagccatcaaggcaaaggaactgttatcatcatcatcatcatcatcatcatcatcatcatcatcatgtgttgtgtgtatgtgagacagagggagagggagagagaaaggagtagtaggcaggttagagaacaactttggggttctcaccttccagtgtgtgttatgtggaactcatcttcagccttgttcaacaaacttttaacagcttagccttcttgctgggctttgattttttttttttttaatgtgagtttccaaaaattatgagagagtatgaattccatatttttatttttcaaacaactaatcacttcgttttggcgcacctgcttctctctcccgctttatggctgtaatactttaaatcctggagtttttattatttaaaccctaaactgtgtgggaagctttaaaagaggcgttttacactgaaccacagtgctattaccatgcctaacacacttctctcgacttattttgaaattataagtgaatagatttgttgtgtgtttgtgtgagaagccacaatacgttccctaactgacctgtagaccaggctagccaaaagtccttgctgacccatccacctgcctctgcttcctaggtgctggttttcaggcatgtgccactaggcctgctttcagggatccagagcagtgttgcttggattcacaatgggacagaaatgaaattgaactgctatctcaagggaagtgcgtcccagctatccttggggtcacacaacagccattactgaacccctagaggggtctaagcatggtgtttatagagaaatcctaccctcttagcttttcagacctgtatgctgattctctgtgggaagagtaagatgagaaaatcagaccaaaactctgaaaaaaaaagtaagggcttctatgggccctctgaaatttacccatgagtcctaggaattttttgagtttttgagggaagggctgcaggaatcctgagagagcactgagtatgaatgagatatgccgattagaggaaatagactgattacaaggggtggacctgaactcgccagaagctgaagcaggggatgtgagcggtgtggccagatggagacctcagcccctcccagaatcctcacttaattccagaacagcccaaggagtgatgaaaagggccccagcttggctgctagctcagtttgaattggaattctggacccagcgcttgtaaaagcagcagagaaagaagcctttgactcattactctctcaggagttggttctttgatggggggaaggagctgagaaaagaacccaggcatcatacaagttaggtaaataactggtcacttctttgtagctgatttttttggtggggagggatacagttttgctagataacaggacatttggagagagatccctcctcaaagtttggtagaataaagaaagatacatttgttctgcgcttggcctggagcccagtgtactctcctgagctgaggtgcagtgggatcagccttggagacttttgactctgtatttcctgtaagcgtgagagacttgctaagtgtcgctggctgctatttcctggtggttagaagcgacaggtggttttttttttttttgtttgttttgttttgttttgttttgttttgttttcaagacagggtttctctgtatggccctggctgtcttggaactcactttgtagaccaggctggccttaaactcagaaatccgcctgcctctgcctcccaagtgctgggactaaaggtgtgcaccaccgccgcccagctagaagtgacagccatactgatttgagttggtatctccttttttccagttttcctgcccaccttcaacttggcccatgggctaagcctgggagactgtgtataaggggagtgggaagaggccactcccctgcagctcttacctgcttagtggaaggaaaatggagcctttacttagtcagtctccttcttagcttactgacacagagttataacttcatttccttggtggtttctcatcttatctggactgctgtctctctgaggttctcatgtgttccacccttcagtggtgctgttcttccgatttccctgagaacagagacttgtttctctatgtagccacagctacatagagaaacccttttcaacaacagcaaacagtcatgtgcagctgtgtgtctgcatgcagttatgtgtgtctgcatgtaggtatgtgtgtctgcatgtatgtgtgtctgcatgtgggtgtgtgtgtctacacccaagtgcacatacctttggcggccgaaggcatcgcattccctagagctgaagttgtggccagctgtgagctgcctgatgtaggtgctgggaaccaagcttgggtcctctggcagagcggcaagtgctcctaacctctgagctgagcaggacttcagaggcttcagcgtgacacttgcatctgtagtgctggcccctccacagctgccccacagctccttcccgactgcccacccgctgctcccctttgttcactgatgcacatctgcatcagtctttctttcatggtccccagtccccaaaataaaactcacggtgattcctgctgctcttttctctacccctgcacctaagtagttccaattctagtgattcttctttcctagtaataatgtgcccttttctctgtggttgggtaatgtttcatttttgtattttgtttgtgtatgtgaattatataaaacagtgagtttccgtatgtcatgtttctttttttttgtttgtttggtttttcgagacagggtttctctgtgtagtcctggctgtcctggaactcactctgtagaccaggctggcctcgaactcagaaatccacctgcctctgcctcccaagtgctgggattaaaggcatgcattacaggtaatgcagttgggatgtagattacggggtaagatacaatggaaacctctccgtattcctcctgcttgcctgtctcatctttttaaaagttgcatatatgagggaaagctgggatgctcctctccctgtgcctggtttatgtatggacaggaagatcagttcatccattttctggcttccccattcttgttgctgttacctgaaataaaatcagcactgccatcttggttgcagaaggtcccctcttctctcacctggattcccttcagtcaatctgttcttccgtctgtggaagacaaaattcctctgtagtcaggcctgaggatgccattctcctgttttagatttcaagacataggagccttgtggttagtgctccatcccgtaggtgaggcgcaccagtccaggccttcctcactgcccatgtgccttggctcttggggtagggcccagcacaggccttcctcactgcccgtgtgcctctgctctcggggtagggcccagcacaggctctcttggagctgtgtttccaagtgtcttatcctcatctgtagtcaggggctgttcctctccttctctactggctgggctcttggcagaggtgatgttttgttttgatttgcatttatttattatcagaggcagcttgaaggaacaggtcctcagctacctcaaggattctgtggatttaactggacttgtctggcttcttgggcaagtgcactacccactgggccacctgatggcctggtgtttttgaaatgctgtttccctaagtaacctaggctggctttgaatccagaatcctctaagtcttcctagcgctgggactgcaggcatgcaccatcatacttagtttaacagagttttgataggcgaatttaatatttaatgctttcattgatagctcaaaattctcttccaagaaactcagcctgtttacaatacatgcaattgtcagacttacagcagagttagggatacaactcttgcccagcatgtataaggtccaaggctcgctctctctttattttgagaagttgaaaacttgaaatggattcctatttgtgaaaatgctgctgttgagccatttgtcttctaggctagctgctccttctgtcctgtttactaagaaacgagggactggagccctgtgttggtttttgtttattaagacaggttctcattgtaaagctctggctggccccaacctccgagtgctaggactaaaggcctgtgacacaccatgccctttcttacccgtggtttggcttgctcaccacagatagagctctgtgcatagactatatgttttctaagaatggcttgacctagttggcaccaacaaaagagaaatggcagacaagttgggctagttcatttgttttgataattgagaaatagcttttatattaacaggcagtttataaactaagaaatgggatgtttagaagttgggaaatagaacctagaagtggtggtacacacctctaatcccagcacttgggaggctgaggcaggcagacctttgagtcccaggacagcaagggctacacaaagagacgctgtctcaaaaaaaaaaaaaaaaaaaaaaaaagggggggggctggaaattgagatttttgttaaggaggcagaaccttaggcctcacacatgataggtaaaaacactaccactgagctatgtcttcagccttgaatatttttttaaaaaaataattatgtatattgcaaggatgatacagtgccagtggccctgtaggctgacatgtgcttttcaaaaggacaaactgtgggagttaattctctccttctagcatgtgtggtttggggatgaagctcacggtgtcaggtgtggtggcaagtgcctgtacctgccgagcccacttcactggacaaaccaacttgttttggttgagttagggactcactgtacagccctggctggtctggagcttgctgtgtagatgaggccagccctgaagtcacagagatgctttcctcctcctcctcctcctcctcaggaatggctagtggcctgatttaaacgttagatgaaagagtgttattggtttattcgctcggaatgttatggacctagaaatgatgtttagggagtagactatgtctacagattggcaagtcaccaaatagataccaactaaaatgtgtcagatgggctgctgggcatggtgtgccatgtcttagtcccagtacttgggaggcagatgcaggtggatctctgagtttggggtcagctcagtctacagagtgagttccaggacagccagggccacacagagaaagcctgtcttgaaaaaccaaaacaagcaaaaatagtaagatggaaataaagaataacatgattgcatttgcatatgtgtgcatgtaggcaggagatagttaaagtgtatgtagtaggtgcccacatttccagaatacatacaaaagagagtaagacacctgggagagttgagaatctcttaaaatatttaatgctgttggtagcaattgaggtgcttcatttgtttaaaacttggtatatgttgttagaataaaatgaatgcttttttttttttaagacacgattatgtagcccaggctgcctgaatgtactatgcaactgaggttggcctcttaggtgctaggattatgggtacgccactgaacatgattataaaatgatttttttcttttgaaaaatgatgctagaaattgaacatatgtcctcaagcatacaagggaggtacacttcccactaaggtatagttccaccctctaaaacaagatccttcccctgcccccaaactttagttaaaaaaaattcaaagtatatactggatccatcttcagaaaagtggctcatcatacaagtggaagctgtggccaccaccttccgtctgagctgagcatgctctcttctcaaattgaagttctcccgaatatatcatggctaggaccaatgtcctgacaggaatgctgatgccagcaaaaattgggaacgattaggaatttgtgtgctgtccttgtgtgggggccgtgctaatctctgtctgtttcaattgtagtgtgtgtgctggtaaagtgaacactagaactaaaaggtgtatggctgggcatggtgacacgcaacatagtgacacacaacatagtgacacacaacatagtgacatacaattccagcaactggaagtctgcagccggtggatctcagagactccaagctagcctagtctgaatagtgagttccaggcttgccaggaccacaaaatgaggctctatctaaaaccccccgagagaggtaggaggtggtggggagcagggagggaaaggaaaaagaaaaggtggggccagataggtggctcagcagttacgagcactgggtgccattaccaacatccacgtggtggctcacaacaacgcataactccagttccaagggatccaacaccctctctgacctcttcaggtgtcagacacacacatggtgcgcagtgtgtacagccaggcaaaacactcatatgcataaaaagtttttacaagatggctatgaaagccattggttttggttaaattgtttgtcttccaaagagaaccaggcacagaattatgttttaatagtcatagctatggggtagaaaggagtaaaagagaaaatataaactggttgtattaaagtgctgggctcatgttttctttggattcctctctttccaactttaaagatttatttattttacatatgtgaatacactgttgctgatcttcagacatgctagaagatgagggcatcagatcccattacagatggttgtgagccactatgtgatttctgggaattgaactcaggacctctggaagagcaatcagtgctcttaaccaatgagccatctctccagtcctatttccaattttaaattgcttatatttcttttgcttttccaagactgggccttgctatgtagccagtgcttgcttcagattcactgtgtagcccaagctggacgtggctgcctctgcttgctgagcgctgggaatataggtgtgtgccactgtgccttgtgcagtcaatttcagtgaggtggttctgtgtttgataaacttggtaaacttattctgctacaggtgggtttggctagtcagaagtcccatgccttgatatagttcagtggtagagttcttgcctatcatgtacaaagtttggtctctagctctgccaaaagaggacaggaaagaaagcaggctgtgcttttgttctttctgatgtcatgttccaacagtgggctgaagaggaaccttcttctatgaggttgtttcttttcccgagtttcttctgtctcttgattgatgcagtgcggttctctctccttcccctcgtagcgttctcccacctttggcttactgttcgacattgatggagtgctggttcgaggccacagagtgatcccagctgctctggaagcattcagcaagctggtaaactcccaggggcagctgagggtacctgtggtttttgtcacaaatgctgggaacatcttgcagcataacaaagcccaggaactgtcagacctgctgaggtgcaaggtaagaggcaaccagaggcacagaaacccaaaaccattcctatggaagcctccactgcagccctacatccctctccgttagcttgaggtacagttggggcagtgtccttagggtctagacttgtgatgacatcaacagagtgagtcttcatacacatacatgatacttcatacatgtgtacacacatggttgagggagcacagaaatctgacttgtggggctgaggatgtcgttcagttgatagaatttgtgcctggcacgtgtgaagtcgtgagctgatctcagcatggcagtaattactagctatagtggggcacactcatcatgggccttgttcaaaactaggctgggctataggacaccctacttggggggaggtgggaaggtgacaggattctgtccttgtattttagtgtttgtttttgagacaaggactcatgtatctgtagtaggtggcaatgactctggatgtccggcctcacttcactaattctgggatcgcagctgtgcaccaccacacctgctttatgtgctggggattaaactcaggccttggtgtgtactaggcaagcactctgccagcgagctgcagaggtcacttgtgttcagcattccacagtgcagacgggcctgtgcaataatagctcattaacaatataatagaaagagtggcaggtacctgagtgagaggctgaagcagcaggattatgacttataggtggcatagtgagactttgggtcaagaaaataacaaaattcctaaaccatgcacacggcctgcagatgtgcctctccgtgggtgctgtcctctgaaagcctagcatctcccctttgaagttagctcctcactgtatccaagatgggcacctgctcggtaagggtgaactcagttttgagaaggggttctttgtaaccaagaaagtcgataaaggctgatggtggaggctgaatccagtacatcgaaaccctttccataaagggccctaaaagcattcagaggaacctggtgtttctgtttacacagaggagaccaggaaagaggataacacaagtttggggccagccagagctgtgtagtgagaccttcatctcataataacaataaagactacactcttgaagttagtgtagatgttgaaaagctaaatcttgggagctggggagatggtaaagtgcttgagtccagcacccagctgaagaaccaggctcggcggcacatctgtaatcccagggttggagacagttgtatccctgaggctcgctggccaaccaacatagcctgtcagccagtctggcaaagcagggagcgccaggttgagtgggaagcttgaaaaataaggtggagagaaactgagaaagataccagtgttgacatcaggttctccacacgtgtatcttctcacatacatgtgcacacacatgcgtacaacacaaactagatcttgggctggggcgtgagccagtccttctcgattgcaaggccatggttcagtgcccagcactgcagaggtgagggaagttcagtttttacgtagaagtgaaaacacaatgctgaggtccgagacggatggataatggcagtaagtacacgtcactgtcttcagatgccccacagagggcatcccatctcattacggatggttgtgagccaccatgtggttgctgggaattgcactcaggacctttggaagagcagtcagtgctcttaaccgctgagccatctctccagccccagccatgcttgtaaagtctgtggtttccaacagagttatgaggcaatctcagaggggtctttgagctaagcgcagcaggatcttaagtctggtaatgcttctcttattttgtatgttgagaactgaatgtggcagtcatggtgtcttacatgctgggctagttagtcactgagctacattcccagccttaggtaagttcttgttgctatgtggctaagtcttagcaagtgccagattgtttacaatgttttatttttagacccctcctgcccccccccccgtgacataccccagtggctgtcaccctatcatgttctctcacccctaccttcccctgctttcctgttccttggttgtctccgcaggtggatccagaccaagtcattctctctcacagccccatgaagctcttcctgcagtaccacagcaaacagatgctagtgtcggggcaggggcccctggtggagaacgccagagcgtatcctttcagtttgctgttccggtggagaggagggtgaaggcttggcgtgccacagttggggcgggatgttgggaaacagggataaatgaatgctttgtatggtcggtccttgagactagtggtaacagcccacatcagaaccgtgtgcccagattaatgtacagagacccctgtcttaaccttgagcaatcttgatctctatgtctccagtaaaaactctagaatctccaggccaatgacccctctggaggccgaatgaccatttcacaggggctacatatcagataacattagattttacactatgatttataacagtagcaaaattacagtcatgaaatagcaacaacaataattttatgtttgggggtcaccaggacatgtggaacctgtattaaagggtcacagcgataggaaactgagagccactgctctgagcaggtatgccctaagtgtgggagcctccctctagcctctatccttgcttgtcagcccctgcttggaatagcgcattgttggtcatgtgtacacagaaagcaaaggacatggtccctgtcctcagacagcttgttcatgtgccctcgatgcatcctggaccccatgtagactgtgctccaaggcaggctgggacccaggtaagaacatgtgacttactcaggagagtcgtacttgggagggaaacacccacaaacagcaaaggagtgtgtaagagagcaggtgttatagaggaatggaactgataggataaacatacatcatcaatgagatttagtcactttccgtacacagttggagccgggtagttgaacagtgaccgtctgctggtagagcgcctagaaactctgtagctgctcagtccacactgagcctcagcatcccagcctggccctgaaagcccacgcgttcctggagagagcttcagtacttgttggaatccctcagatttcttatatcttcagaaagtggggagagccttccccctcagttaaccctctctgattcatgtttcttaggtgaatgtgggtacagtcaagatgacagtcatcacagggcggggggaagcaagctcatctgtgagggcactgtgaccgggtctgaccacctgtgtgtgaccaggtctgaccacctgtgtgtgactgggtctgaccacctgtgtgtgaccgggtctgaccacctgtgtgtgaccgggtctgaccacctgtgtgtgaggtgaaaggagagaactgactcccacaggttgttctttgacgtccataatccccacaaataaatgtaattaaaaacaaacaaacaaacaaagatgagctgtcccagcacaggggctgggaatgagcctcaggtggagagttgtgtgtcgtgcttgaggccctggtttgcatctcaagtgccaggaagaagagaagatggcacggggccagggcaggttctgcaggtagagcactggcttctaagcttagccacctgagttagatccccaggttccacacagtggggggagagaatggattccgaagttgcgccctttcagccactgtgccccttccccagctaaataaatgcatcttagaaggtgaaaagatgggctgggggattgagattggctccaggtttgagcattggagtgtagaggggacacctggagcagcagctgctgcagcagcctttagctttagagggttgggtggtcccctgggaggtgggaagacaaggtgtcagtcagaaggagcggaattgggcattagaggacagaaaggcaggctgggcatggacagtctcgtcctaaactcagagcagtggagagctggtgcaggccttacgactgctgggcaaatctgttagatttgggggatactggttttgagtatcatctgagactggttaagatgggacggagttagggacaggaagatggaggcagctcttagaggagagcaggctggagtcgtcatggtcttctgtgtgacggccccttccttgctgagtggggtttgactgtcagtgttgtagtttcctctgagtatttgtgactgttgtgtgacttgtcctggggagatgtgaacaaccattatgtaacccagatagggaaagaaggaccgacccattggcttaatgagccaggcagttagctagggtgaaaggcacacttcagaaagtgccatggaggctgaatggtgactggggagcccccgcacagcttgcaggcagcttggccatgggagtgtctcttcccccagaaccttgtataaccatatagggggaggggactttaagcagcacaggagggaggttgtggctctggtaactttcagggtccccacctccctccaggagggaatgtttcaatccagaggaaatagctattcaccagttacttgattttgcctagctccttgcagcccagtactgaggtcatgttactcacgagcaccagtttgaacggccctgtgcatggcataagctccctgagtacacagtgggggggttggcctcttcttctctgggtcttgctggtgtagatagagttggtaccagggggtcgcactggtgttgcttgcgtctgccctgtctatgcagtcccagcctgcacttggtgcctgcctgccatggtctggactgggtttggttctgccctcttgtcacctgatatctctataaaagcatcatcccagaactgtgtagctttgcttccctgatcttgctgcagactaggcttccagaatgtggtgacaatagatgagctgcggttagccttcccagagctggacatggtggaccttcagcggcggccgaagaccatggtaatacggacagggtgggttacttcacccttcatggtactcctgggctcttgtggtcgtctttgtgtttcttctcagtgttgggtcctgtgtagatctcgccacgctcctgcaaggagctgcatattgtttttatggagctctacactgttcttcttgcagaggtgcatctggccggggactgtgttccctggatagatagggatggctgagagacgcagtgggctccacacactagccttctgctttgttggaattacctagcgactccgttcagagtcttggcatttgcttcagtccacagtgcacttcagtggcttcctcgggttttcctctgtaagtcactcagcgctgctcctttatcctgaagcagagccgggctgcctgtgaggagagaaataccgaggactctgtcctcccctgcccgctgtctggcccatagttgaagagagtgactgttgaagaaagaggcttcatgtctttttacagttctggtggccaaacccagagttgtacaggttgggaagtctctgccatctgagctccacctccgcccgtgatttcttatttcttgggaccatcagttccaggccctctggtcctttggaatataactgcctgtctcctaaggcacgtcttggcccatttggcccattctgcataagattttctatacatataatagcttatgttaacaatttaggatttgatgaaatacatttgtagacaggcgttaatttaatagaaaataggttataagttctcctaccaggactttctagctgtagagctgatcctgtcctttgagagctttctcttgagtctctaaaattctgagatgaaccagaatatggagtgggaacacatctcagaatagctccaaggctgagcctggcccaggagaggtgactcacatcagccaagactgcagtggttcagggaagagtgagcccaaggccggtaaagagaaaacctctagagctggcgtaaggacaagagtgctcgtgcacagagagagcctctcttacagactaccccctccctagctccctgactcgagagccccttgctcagccagggccttggtttttacctggctggagaagcacagctgaccaccgcccctcttggccaactttccacatggcatctctcagcctgtattgagtccagtctgggccttggctttctttcccttgcgcatcttcttcctaagttctgccttcttggcttgagctggtccttgggggtggtctctgacctgtgggggacctgcctttcctgctactcagctctggagactcgatgctccggagtggagcgtgcttagcattgataggcctcttgtttgtcttttggcagcgcctgaggagtgacttccctgccattgaaggtaaaggccctgtgcctgggtaggtgtggggtctttgtcttccctctctcctttcagactcttaagcagatggtgcctagcagtgcacatcagggcctgggtcacctgaggtatcaccctggctgtccactcggtcctctgagacgtgtggtgagggttgctccttctcaacagtgcttagcttacttgaattgtaagcacagtgactctcaagagagcataggtatggacagtctagtacagtgtcacttaggtctcccgtggacaataaagacattgtaacttcttgttgccatcctgaagtaaaataactttcctataactcatatcagaaagtagtcagtggccagttgtagtggtgcatatctgtagcttcccacttgtagggctgaggtgaaaaaatttgagttcaaggctatctgggcttcacagtgactcttatctcaaaaccaaacaaagcagtacagtattgcgccctcactggaccagggagtgaaggaaaatgtcttggcgagacattactattataattatctgagaagtaaaatgattgttctgaacaaagtgaccaggaatgtcccagcagcagacaaggctgtttatagctctaatacaggtatgtgggcagaatcgccactggtgaagggatttctaaagtggagaactattcttggtcatttttttggttttgtttgtttggttttggagacaggatttctccgtgtagccctggctatcctagaacttgctctgtaaactaggctggccttgaactcacagatctgcttgcctctgcctcccgagtgctagattaaagttgtgtgacaccactgcccagctaatttgtggtaaatttttaagaaatgttagtagtttcttggttgattgtatgatcacttaagattgttaaaactgtacaaaatactttggatggctggagagatggcttcgcagttaagaacagctgatactcttacagacctaggtttgagtcccagcatccacatggtagctcacacccatctgtaaattcaattcctgataaatcaagtgccttctttaggcatccacaagcttgcatcaggtatgcacatgcatacatgctggcaaaacaatcatacacagaaaataaataaataagcaattagagtacttggtggttagctataagatggagtgctccgacagttctgtgtaagtattggggtgggacctcaggtaccactagggtaggacagtttttgcctttgtagagttctctgctgagtgttcagtcatgacaatcaaaataggtcctccctcttttaattttaactttattttttaaatatttgtttttgatacagggcctctatatagccctggctgtcctagaactcactgtgtagaccaggctggcctatgactcacagagagccaactccttctgtctcccgagtgctgggagtaaagggctgggcccggctcacactttattttttactttttacttttatttaggtatgtatatatgtctgtgtacatgccacatgtattcagggacctgctgaggccaaaagagggcattggatcctttggagctggagttgcaggtgtttgtgactggcgtgggtgctgggcgttgaactcgagtcctttgcaggaacagcaaatgttttcaaccactgagttctctctgtacccccttactttgctttattttgaggcagaggcctcactctgtagcctggactagccttgatcttttttgggaaaaagatctcatgtagtaatcactgacttctgatttgtggctagatcagtagccgaggtgactctgagctatctagcatcccgtctcacctctcaagtggtcatgctatcacgtaggtgcatgctatcgtgccaggccttagtttttatttgtttattttgtattgctagggttgggatttaaggccttattcatgctaggctagcacttgattactgagacatacttccagggcccctgtttctttttatttcagatatagttgaggtagctgaagtttagcagtgagtgagtaactaccccagttccacaggagtcttggctgttaggatcagagctcagggctcctttgttccaagttctcatgcatggctcagaggtgtgactgagggaggccggcccctgtagagtgcagtggtgcttgtgggtgaggtatggtgggtagagcatctcatagagcatgagatctgctgcttctgtgagaaggcaggggacacaaaggacacccttagggtgttccttgctagaccctgggctccgttcacccagggtacactgggacatggcttggccacagctgctcagatgtgaccttagtaaagacctctggctctgggtaggtattgctcactggcctctgtagtctctgaaggagcttcaacctacccaccacaaagggcagggcaagcaccctgctccctcatccctgtgcctctgatttttaggggtcctccttcttggggagccagtccgctgggagacaaacctgcagctgattatggatgtccttcttagcaacggccaccccggaactggcctggcaacagctccgtatccccacctgcctgttctggctagcaacatggacctcctgtggatggctgaagccaagatgcccaggtgagaacacggtgtccctgatctttaccttgtgagccttggaggtgccaccataacctggcctctgagagtaaaagctttcaaaagtttcttcatatcaattattaaactaaaactgcagactgctgagcatggagatgtgttgagtggtttttagtatgtgcccatccctgatgacctcaacacaccaccaaatgggcgactgtaagggataccagtgggtacgtagtcagtgggtacgcagtcagtcagtgggtatgcagccagtgggtacgcagtcagtcagtgggtatgcagccagtgggtacgcggtcagccagtgggtacgcggtcagccagtgggtacgcggtcagtgggtacgcagtcaagcttcttcctcgtttgctttcatatgcatgctagagatgggaagctgggacggtaaaccaggattgtgcctgtgctgccgaggcgagagctgagctcagctgtgcgacatcagtgtcaggacctcttttgtggccctcagggatcctgactgaagccagctgatgacagcatatagtatcttctcactctgtcatggacttccagaggctgtgtatagtcagcagagggtggtttagacccaagacttggcctcaaagaggcaggacttcctccctgtgactctccctctctccctccttttctttctctttctgtgagctagggtgatactgtaccatacagcccaacttgacttcagctcattaccttcctgcctcaattcccctgtagtttgtgtcacatttaagtgtattctgtagcctgaggttagatactgtctctgagttagtgccttggtttgggttttatttctatgaagagacatcatgactaagggaattcttatataggacaacatgtcattggggctggcttacagtttcagaagtttagttatcatcatggtgggaaacatggcagtgtgcagaagacatggtgctggaggcgctgagaggtctgatcctgactggcaggcagcaggaagggactgggtggagctggaacataggacttcacagtgacagtgttcttccaacaaggccacacctcctaatagtgccagtccccgtgggccaagcattcacacactacctgctcaagccaccacagttgtgacatgcgattcagggcctgtagctgccaggtgagaagcacaaggagaacagggcatgggccagatttgaggtaacttttgtttttattcaaagaagccatatttgagatttttttcccccacacaattatttttgtatcgttttgagacagagtctcactcgttagctttgatttgtctgtgactcacagtggagtacaggctagccttaaatcataatttcctccaccagcctcctgagtgctgggattgcaggcgtgtgtcaccatgtctgcctctgtttactccatgatcccgaagttagctggttgttgtggtacacaagagaagacagaggcaggagaaccacatgtgtgacactatgtggacttcatgtgtagttctaggccagcctgggatacagcaaaatcctgcttcacaaaataaaaacaaagaaacaaaaaggaaatgaaattcttttgttgttgttgtaatgctgtgttgtttgagatggggtctccctgtttagcccacctgattggtgttgactttggccaatgaggaaatctgattctctggagacctgggatcctcatgaggacttgaaagaacagggcggactgtagtctaatgccgtggacagccttacttcagcttcagtgcactcacttttatacacaactgtgacaaagaaagcagtgacccagggaaggtcgtgtggttcagatgaacatggaaatgaacaccagtgagtgcatactaaatattaacctaacagcacagccctttctcagagcttcctcaggacagaccaacttaaacacaattgcctggtgcgtactatagatgatatctgggaaagcatgaaagcgaggcaggaggccatgtccagatgcagggcacactgaccagagtgggttctatagctgtgttctgacatccaacaagaataagcatgccgccaggcgtggtggcacatgcctttaatcccagcactcgggaggcagaggcaggagaatttctgagttcgaggccagcctggtctacaaagtgagttccaggacagccagggctacacagagaaaccctgtctcgaaaaaaactttaaaaaaaaaaaaaaaaaagaataagcatgccttataagttgaatgcaaatgtttgcatcggaggcacaaaactcacatccagcaacaaaacgtacctctttttttcctgtcgcctctctcacagttccccaagatattgttcaccatggtcagtcttttgactgagttctgacagttggcctagaatcccctatataagacggctgaacttgaacttgaagagacctgtttgcttcttgacctcccaagtgctgagttcaaaggtgtgcatcaccacccccagccaggaaatgaaatttgtatgtaaacgggggacattgaatattacatgccaagcgcagtgtctgttaggattgggtcagcgctgaggacagaacacagacacactttacacaaggtggcatactggctttcttattaaagaaggtagcaatcaggctacgggcagtctttattcaggacacttactcctttctgcagcacactccttaggctatgcctgtataattctaaatggctgcctgagtgttagccatcacattagcatttcagagggcaggaagcagtcgagtgggctgttagcttgcaacactgaccaaatacttgaataaacaacctaaaaggaggaaggttaatttctgctctattgatttggtgcttgtggtgaccctaatattgtgataggaagcaagttgtggagcaaaactgttcccttttgatagctaggaggcagtgaggtagacaggagggagcctccagggatgtgtttccagtttcagctggctgaagactctagcgccagccaagggatcctcagctgggaccacgccttgagctgtggggctgtgtaaggtcaggaagagcgtgcctccttgtgacctcttgtcacagccaggccagcacctctgcttctgcgactgttcagtggggctcacgcgtgtactaggtggccacacctagctgcaggggaggcagtgagcacactctggcagccaacagttgtggagcaccagtgttagggtttgggggccaggtacgatggcatcgtgggtaaatgcctgctatcaagctgaccacctgagtttgagccttgggacccatataaagttggaatgagagactgactccagaaagttgtcctctgaccaccatatgctcactgtggcacatgtgggtacataaaattaattttttaaaacccaaaatacaatgttttgggagtgagcctttcagggttttcaccctagttttgctaccctggggaaactgcctgctcttgcctcagtttcttcatgtgaatgactctaggggagggatacaggttggttgcctggagacagcttagagagtggcagatggcctcaaggctaagttgctgagatctcttcttgggcaggtttggtcatggcacctttctgctttgcctggaaaccatctaccggaaaataacaggcaatgagctgaaatacgagggtctgatgggcaaacccagcatccttacttaccagtatgcagaggacgtgatcaggcagcaggctgagaggcggggctgggccgcccccatcaggaagctgtatgctatagggtaagtccattgcctctccattatcatagctgcttttctttccctctgcccacaccacccaggcttccccgaagctgagtcacaccacctccaggctgttctgatagcttcgaaacactaaactaaggtttttttcttctttgccctctggtattgctgccctgccagtgataaccctatgtctgatgtctacggtgccaacctattccatcagtacctgcaaatggccaatcgtggagaggaggaacagcagaccggtgggcaacagaagcagcggccttcagcaacccagagttgtgcttccatcctggtatgcactggcatatacagttctcaggacccaggctcccaagtgcctcctcctggaaggagagagcttccattccacggacaccgagacttcagcttcagtccagggctcctagaagcctcccacattgttcatgatgtaaacgaagctgtgcagctggttttccaccaggagggttgggcttgaggggacggagatgtagcagaggcagagggggctgttggagcatgcgctcagggaatcctgtgtgcccggctgtggtctgggtcacaggcatcaagtccaagcctggcttcttgccattacttcctgggacagagaagactgtagcttcagtagctacagaaagcccttggggcagcatctcaggagaagggatggatttctgggcccttcctgtgcgtctcttgcagtctgacctcatgctggtccctttacctctgtgcctcagtgtcaggtcctctcagtgaggaccttctttttccagacagcgtctcactattgtagttcccgctgtcctggaactcactatgtagcccaggttgtcctgaaactcagatctgcctgcctctgcctccccagtgctggcatcaaaggtgggtgccatcacacctgcctcagtcaggactttaaaaaccgcacagtgcaacgttatgtggaaacttgtggagggagagcctttggtcacactgaaggaagcgctgtgccatgccagggaggggtgtggctggcactctccatagtgtttactgtattttagagtgctgcccagagacttgggggcttttttttttttttttaattaaaaactatcctaatatttgttacattgtgtcttgtgaggatttgtgtggaatgtgctagaagccctgtgaggggaggcttgggagagtggtacatagggtactcttcgtgagttgaagggtttgtggcatttcattccctaaatatggcgggcatcacctcctcctgctgtccgtcctcccattcccaggtggggctctgtcagcactatttacattgcgtccctaaagaggagtcctactccagcttccccttggctcttccccagccttggcatttgtcaaatttcctgctgctatagtttagatgttgactgcctttcagaggcccatgtgttaaacgctcgcccacccactccacccccgcccccaatgttggaggaccttttactaggtagggcccaagatttagacttggcacatggccctaatctcagcattctggaggctgagacagaaggattttgagtttgaggcctacccacgacacagcagaatactgtctcaagaaattaaattaaaaaattaaaaaaaaattaaaccctggctaacagactcagggttcctgcccttgtcttactttggcaatcacttgataggacatgaactagacaccctctgcctcccttccttcctttcccctcccctccccttcccttctcatctgtctgccttgaacacgtcatcttcctgcgttcacctcccaggtgctgagattatagagtacaccaccacgcccagctttccttttttttcttgaaatactgttggttggctacctctgactaacacctctggatgcttggttgtttagaggtgaggagcaaaggagactgagggggcagctcatgaaataggagaagcttagtgaggaaattgctccaggccctccctgaggaccacagctcagccacgcccagagccaagcacacccacttctgtctagcacctcacaaatacctcagtttctcctgtctcccaggggctcccttctcattgtcagatcccattacagatggttgtgagccaccttgtggttgccaggaattgaactcaggacctctggaccaccagtcagtggtcttaacggctgaaccatctttcgagccccataagttttttgaagtacagaagttctcctggagaaccactttcctgggcagtaggaagtccaggcttagcattttctgactacaaaaaaagtctcagggctgcccttgaggatttgggaatttgtccccaccatccttggttctgtgcattccatgaggggagaaaggggcaaagagttagttcccttccctttgaagaaccatacacataaataaaaatgtagacattaaacaaaaataaaattaggtggagagtaattgcggaagaccctagcactgacctctgacctccaaacgaacataggtatgcatgtatactcaaccccctcccacgcatgcacgcgcacacatgggtatagttgatagagccttgcctggaatgttccagaacatttccaggacttctagatcagtttgtttgactacagtgtggtctcccaggcaccactaacttcaagggacagggacagggtacagtgatacttaacaaaattcaggttctggcgccagagagaggctcagtgggtaaaggtacttgctgcaaagcctgacaagttggattctatccctgcctgggagccacatgatggaaggagagagctgactcctgcgcgctatcctgccttccccgtggacactgtgggacatgtgcccctcctcctggaagaaaatagttgcagtaatttttcaaatgtaaaatgagttaggctgtacataacaggattgatatttgggtgcgtgctggaccagaaccaaggaatgcaacctcagcctggaccaagaggcaccgaactgttgttactgttgttcatcttgccggggaatggagctcagggctctgagtgtgctaggcaaggatgtgctcctccactgaacagtgccccttgctgtgctgcttggtttgttttagttttttaatttactttttgtttgttttcgagacagggtttcactgtgtagccctggcagtcctggaactcactctgtagaccaggctagcctcgaactcagagatccacctgcttctgcctcccatgaattgggattaaagatatgcaccaccactgcctagcttttactttacttttttaaaaacatggtttcatgtaccctaggctagttccaagcttgccgggacgtctgggtgactctgaccctcctcccgccacctcctgtgctacacatgtggttcactcagttctgagcattgcacaggcctttgtgcattccaggcaaggctctatcaactatacccctgtgtgcgcgtgcatgcgcatgcgtgggagggggttgagtatacatgcatacctat

SEQ ID NO: 1640 - DNA, 620 bp, Mus musculus
gcgcgacgggcgcgatggctgcgctcgccgggttaggggttctcggcgccgggcgccatctgtggaaactgcctgtgcgcctgtctgcggggctccagggctgcgggccccggaggggctacatcgcgggcagcgctgagcgttctcccacctttggcttactgttcgacattgatggagtgctggttcgaggccacagagtgatcccagctgctctggaagcattcagcaagctggtaaactcccaggggcagctgagggtacctgtggtttttgtcacaaatgctgggaacatcttgcagcataacaaagcccaggaactgtcagacctgctgaggtgcaaggtggatccagaccaagtcattctctctcacagccccatgaagctcttcctgcagtaccacagcaaacagatgctagtgtcggggcaggggcccctggtggagaacgccagagcgtatcctttcagtttgctgttccggtggagaggaggactaggcttccagaatgtggtgacaatagatgagctgcggttagccttcccagagctggacatggtggaccttcagcggcggccgaagaccatgcgcctgaggagtgacttccctgccattgaaggt

SEQ ID NO: 1641 - protein, 206 aa, Mus musculus
ATGAMAALAGLGVLGAGRHLWKLPVRLSAGLQGCGPRRGYIAGSAERSPTFGLLFDIDGVLVRGHRVIPAALEAFSKLVNSQGQLRVPVVFVTNAGNILQHNKAQELSDLLRCKVDPDQVILSHSPMKLFLQYHSKQMLVSGQGPLVENARAYPFSLLFRWRGGLGFQNVVTIDELRLAFPELDMVDLQRRPKTMRLRSDFPAIEG

SEQ ID NO: 1642 - DNA, 41454 bp, Homo sapiens
tcaaaggctgggacccatccatggctggagccacaggggcagcagccagtggggtcacttggagtcagggcatggggagacagcatcaggcagtggctccatctgctcagcccacccgtaagcctgggctctggagggcaactgactcccccaggagccttccctctgcctatccctggagttccctcccctcctatgggagtctgggggccttcaggagctgatccccttgcctgcatgccagtctccctaggaaggatcttgcagaatgagcccaggttcagctcagagactctctggtgccagctgccccttctcagggtcggtggcaggagagtgtgagggctgagctaagtgcatcaatgccccgtttgcccctaggattcggaagaggccatggcaggagctgtatttggagggtccaggcactgccctgactgggaagtgcagtgcagcctagggatgggccagggagctcacaatgacaagagggcagagagcagggagtctatctgccctcctggggaacagccaccaggtaccaagcagggaggctagcagcccagcccagggacttgcgtggacttcgcatgcttcccacatgcttagaactctgtcaggggccaggcacgctggctccagcctgtaatcccagcagtttgggaggccaaagcaggtggatcacctgaggttaggagttcaagaccagcttggccaacttggtgaaaccccatctctacaaaaattagccaggcatgatggtgggagactgtaatcccagctactccagaggctgaagggggagaatcacttgaacccgggaggcggaggttgctctgaggcgagattgtgccattgcactccagcctgggcaacagagtgagactccgtctcaaaaaaaaaacagaacaaaacaaaacacaaaacaaacaaaaaaagaactctgtcagactgggtgcagtggttcatactcttgtaatcccagcactttgggaagccaaggcgggtggattgcttgtgctcaggagtttgagaccagcttgggcaacacgtcgaaaccccatatctgccaaaaaatacaaaatttagctgggtgtggtggggaggctgaggtaggaggattgcttgagcccaggaggtcggggctgcagtgagtcgagactgagtgactgcactccagcctgggcaacagaaggagacccagtctctaaaaaaaaaaaaaaagaaagaaagaaaaagaaaagaaaaagaactctgtctactgatgtttctgatgtttccttcctccctcctcttcatctctgttgggttttaaaatttccttgatcaagcttctcttgcctttccttttctttctttctttctagcttctcctttctcctattccctcctctcctctcctttttattgcccctttcccacaagaaaccagcctgtcttcaacgtggatacagtggactgggcagaaggagccagcctggcgcaactggccctgggggcaactcagagcctgaatctctagtgctctctcctctgcctgcacttggagccatgacccagcctgaccctccacagggaccgtgccaagggctctgtcccttgccagcatttcaggcgctttgggccagctggcctcttttgggccagagttccctggagcaagtgacgatgggcggggagaggatggtactgacacaggaagggaacagggggacatggcaaaggcagaagctgggcaggactggggatgggagcaccccatcaggagcactgggctgaggagcggtgtctgtttggccaggaagctccctgagttactttttcctttttttttttctgttgagacggagtctcactctgttgcccaggctggagtgcagtggcgcgacctcggctcactgcaagctccacctcccgggttcacaccattctcctgcctcagcctcccgagtagttgggactacaggtgcctgccaccacgcccggctaattttttgtatttttagtagagacggggtttcaccgtgttagccaggatggtctcgatctcctgaccttgtgatctgcccgcctcggcctcccaaagtgctgggattacaggcgtgagccaccgtgcccggcctccctgagttactttcttctatacatgggtcaggatgttggaaggtcacccttccacccctgccccccagctatggcaaggagcgttgaggccgagggtgagggtggatgggctcagtgacagagtgttcagcctgggaggtgcctaatcttttctataaatgtcacctgcctatgaatcagggccacacattccatctcagactgggtcaccatcccagcttactgaccaggaccccagccccagtccactgcagccctagcacacatatctctggcaagccttggaagcacctcattcatcacctctttttcccaatgcctgggcacagccataaaggggcctgagagtttgggagtcaaaatcttgttaccctcagcccagaattaacatggccatgtcctgcacctgactttttctaagcaggagagacaggtgggcttgataacatgaaagaacttgtcccaaaatccgtgcagtgtgtaagcttgccactggagccctcgggcctgtctctgcctgtcgcttcgccttgtcattctcatagtgccccttgcctttgccttccttgccacgtgcagagtttatgttcaggataggaccaagtgtcaggtattgatgccacagagggaatgagctcaccttttagcattctctgttctccctgtggttcttgccttcagaagggacctggggagtcagggaggaacggtcccgagatggcatgggcacctgaactctcattacaacagaggcgccagttattctgctcatctgcgggggatgggaaggtgcagtaggggtctctagtatggggctggtggggaaagaggctgttggagttttaggaataaatcactttcggaggccaaggcgggaggattgtttaaggccaggagttgagaccagcctgggcaacataaggagaccccatttccaaaaaatattagcctggcacagtggcgtgtgcctgtagtcccagctactcaggaaactaatgtggaaggattgcaccagtgcactccagcctgggcgacagtgagaacttgtctcttaaaaaaaaaaaaaaaaagaggccaggtgcagtggctcgtgcctgtaatcccagcactttgggaggccaaggtgggcggatcacttgaggtcaggtgttcaagaccagcctggccaacatggtaaaactggagcccatggtgaaaacttgtctctactaaaaatgcaaaaattagccaggtgtggtggcgcacgtctgtaatcccagctactctggaggctgaggcaggagaatcgcttgaacccaggaggtggaggttgcagtgagttgagatcgtgccactgcactccagcctgggtgacagagtcagactccatgtcaaaaaaaaggcaaggtatggtggctcatacctgtaatcccagcactttgggaggtggaggcagaagaattacttgaggccaggagttctagaccagcctgagtgacatagtgagaccgtgtctagaaaaaaaaaattcgctgggcatggtgatgcaagcctgtgatcccagctacttggaggctgaggtgggaggattgcttgaggtcaaggctgcagtgaactttgatcgcgccactgcactccatcctgagcgacagagaccctgtcacacacacacaaaaggaacccaggctttcctgcttaaatctaaatcattgaaaaagagacaagggacatatgagaataaaaatgtcagctttattactgctaaaagcttgttggagaacaccacttatttgggagacaacacggacttgctgatgctgccgttggtgtccttggcacaggtataaagcccagccctccgtgctgcagggacaggcagaacacagacttctggtggaccagctggctcctaaagaggagaggggactaaatcatgtatgcttggttctttcttcccagcttctctcaggtaactcacgtttcctcttccccaggtagagagaggccaggagtattattaacagaagtcccattttcagggaaacatgactagtaggaaatatgtatcccttccctacagagaactccaccttctcagaattctccctcagcaagactgagtgtgtatgtgtgtgatgagagagatggagagagatagaaagagagagagacagtgagcagtaaaccctcctgcaagcccttcctgaccccagccagggggacctgcccatctctctgtggcctgttggccatcctccacccctgttcttccagccacagcttccctgccattcctgtactgggaaccaacttctcttttctttcgtctgcctcctactggtgtgaggtaggatatgccagtttccctccttttatcctttattccttctcatgtggaaaagcaaccatgacttttagccagtcataaggctatattttctagccttctttgctgctaggcatgaccatgtggttaagttttggccaatgaggtgtaagcagaagtggtataagagactccttggaagtgcacctgtagggaaatgggatacccctttttgtctctttcctggtggctggaatgtgaacataagggctggagcctgagcagctatcttagaccatgaagtggcagctgtgcagtgaaggccgtgagggagcaaaataggagcctgggtacctaacaagtttgtggaaccacaataccaaggctgtgttgttctctcccaactacttcgtttatgtgagagaaacacatttctttcttatctaagccactgctctttggaggtttctgtgtcttacagccaaacctaatcctaactaatagaaaatgtgtgtgggtgttagcaggtttacagacatctagatgcagacacatttgtgcaagtttgtggagaaagtaggagtatgaacagtcattcacctgttgcttttttttttttttttttttctgagatggagtctcactctgtcgcctaggctggagtgcagtggcacggtctcagctcactgcaacctccatctcccggattcaagcgattccccagcctcggactaccgagtagctgggattacagatgcgtgccaccatgcccagctaattttcggatttttagtagagacgtggtttcaccttgttggccaggctggtctcgaactcctgacctcaggtgatctgcccgcctccacctcccaaagtgctgggattacaggccaccgtgcctggcctcacctgcctattaatgtaaactgagcacccatcatgtgcaaggcatcctgcatgacaggactgtgagggagacaggtgaatcagagagacactgccctcaagcagcttagagtccagggcatcgagcttgtacacgtgtgaggccggaacttcccacagtgtatcttctgttctgctacctttcctgaaaagaactggctcacctcggattcctgccaggaatggctgctgttttatggggtttgggccacaactgaggatgaccgaaagcaaggcaggcctgggagaaaaatgtggctcacttgagatgagcagggcccacagatatcagtgctggggcaccagttgaacagaactgtggtcatataggtgtggctgggggctggggatagagaacagggagcagcatctgttctgggatgggaagtgtatggtctccagaacatactggtccagcgtctgctcagagacatgctaactcctaaaggagagcttcctaaagtgggtcagcagcatgagcatcctggggagctgatcagatatgcacatccaaactccaaagggagcgccatcaatctgggtttttaggagacctccaggtgattctgatggatgctcaagttagagaatcctggacctctgaagccaggtagcaaggtggggcaagtcagcgcatagaaggctacaaattccaaatatagtgtaatccaagcaccgaagccctctctgagacaaaagctgatttaacaaaccccacgagtaacatgtgattgaagactggcgaggcccttctaattaacatccacggtccatttgtacaacagacggtacaaaacataatctggataaactcagaagacgtgctcatataaagatttgggaagtctccaaattcaatcaagtgagcagagcaaatattctgaacctgaatacgaaagaacatcttaatgtgattgtgtcgtaacatgactgggaatcaaaataaagatgcgttaagcaacagcagggcaggggttctgcttacaatgtcagccacagagcctgagtttgttagtgtttattcagcactgcccaaaggatagagctaggggtggcagaatatgtgctccgtgcatccggcaggatgggaagacacctagaatagtacagggtagacgtgagtgcccttgttcctggaagtgcaaactctttaacatggcaagccttagctgtgagatttctccttagaggatggttcttaccttttactggcttatgaacccagagaatctaataaagacttatcacatacacacacagtctttgattcaataatcatgttggaatctcccacagtgcaccttctgtcatctttccccgaaacaaacagacaaacaaaccaaaccaactaaaacaacagcaaaacccagcccatttctggttcctgctttggatgggctggaatggtcttatggcattcagtccacaatggaggaagaatgaaagcaaggcaggcccatgtggggaacactgctgacttaggctgaaactcctgaagattaataacactaagtatgacacagtcctgatcaccaagaatattagttatcttttgctgtataacgaattatcccaaagtgtaatgacttaaaacaacaaaccttcagtatctccctgtttctgagggttaggaattcaggagtgacttagctgggtggttttgcctcagggtggttcatgaggttttggtcaagggttccgccaggaatggaagctccacctccaagaagattctctctcctgactactggtaggatgcctcagatcctcaccatgtgggcctttctatagggctgcttgaatggcctcaccacatgacaactctactatgcgtctagctttcctagaatgagttatctaaatgagggcaaggtggaagtcacagtatcttttatgacctagccttggaaatcaactacactcacttctgtcccatgttatttattaaaaagtcagtgaagtccagcccacactcaatgggaggggaattagaattagactccaggttttttttttttctttttttttttttgagacagagtctcactctgttgctcaggctgtagtggcacaatcttggctcactgcaacctctgcctcctgagctcaagcgatcctcccaccttagcctcctagaatagctgggactacaggtgtgtgtcactatgcctggctaattttttttttatatatatattttgtggagacaaggttttgtcacgttgcccaggctggtctggcattcctggactcaagtgatccacctgcctcggcttcccaagtgttgggattacaggcatgaaccaccatacccacccaactccagctttttttttttttggagacatagttccgctctgtcgctcaggctggagtgcagtggctcaatctcagctcagctctctgcaacctctgcttcccaggttcaagtgattctcctgcctcagcctcccaagtagctgggattacaggcacacaccaccatgcctggctaatttttgtatttttagtagagacagagtttcaccatgttggccaggctggtcacgaactcctgacctcagatgatccacctacctcggcctcccaaagtgctgggattacaggcatgagccactgtgaccggcctttttttcttctttcttttttttttttttttgagatagagtctcactctgttgcccaggctcgagtacagtggcacgctctcagctcactgcaacctccacctcccaggttcaagcgattctcctgcctcagcttcccaagtagctgggattacaggtgcatgacgagctaatttttgtatttttagtagagacgggtttcgccatgttggccaggctggtcttgaactcctgatctcagatgatccgcctgacttggcctcccaaagtgctgggattacaggtgtgagccaccgcgcctggctatgcttttgaggagccgattgtcaaaaaaaactgtgggcatgtttaaaagccatcataccaagaaatttctaatgactaaatcagtttctaggtagtttaatagaaggaagggattaggaacattgcaatcctagagagctatgtcccctggcagggtttaagtgtcgggctattgtgagtttgactgacttgaattagtcttccaaattctgattagctgtagttgaactgaattaagatcttgcccttcaaagctgaggaccaaaggacaccgctaactacttcttcattttattattattattattattttttttttttcaagacggagtctcactccgtcacccaggctggagtgcattggcgcaatctcggctcactgcaacttctgctgcctgggttcaagcgattctcctgcctcagcctcccgagtagctgggacttgaggcgcctgccaccgcgcctggctaatttttgcagttttcagcagagacggggtttcaccatcttggctaggtggtcttgaacccctgacctcctgatccactcgcctcagtctcccaaagtgctgggattacaggtgtgagccaccgcacccggccctattttattatttttaaaatagagaaggggtctccctatgttgcccaggctggtctggaactcctggactcaagttttcctcccaccttgaccttccaaagttctgggattacaggggtgagccaccgcaccctggcctgctaatgtgtgagctagtgcagtctctgtccatatcctcgactccctctctgctagtgctaagtacattgtagggtcccgcgtttttagcatagctatacctatgaatgggccaaagaatctgagggcatcctacacatttcaaacggtgggaatggagacctctttcctccagcagaatctcccctcatgaccgggggactaccagatccagctctgctaagggcctccacggacggagtcggctacctctccactttcagtgaccgaaatccattctttgttcattcacccttgtgtctactccgggaaacgcgcagcggacacagtcgtgttccctaagtgtttgctgacttagtcatctggccctctctggagtagtcattttgtaccttgtactacattcgtgcctctacctctccgcagtgcgcgcgggggcggactcacgtgcgcagtctccctatgcgctgggagggcgtcagcaggtttacagaaacaatgaaagacttaacaattggcgcgcgacgagcgtcccttgactggcaggggcccagaggacctgaacatcactaagggtctgccccagcggcccggccctgaagtcaaggttgagacccccggcccagacagtccgcgaagctgagggaggccggcctggggcctgccgcgcaatgttaccgggatccgcaggcacagggcgatagtacggacgccgccgcccaggccgtgcccattgtgcgccgcggccagctcaccgcgatctcggtctaggaggcggcgggaccccgcacttcttccttgcaacggagcccctttggcctgcgggtcgagttccataggcgcccgacgggctccgcgcgcttacaggactacaactcccgtgatgccgcgcgcgccgaccgctgattggctgtgcagcggacggactcgcggggggggggggccgcacgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtgaggacgtccgggttctggccgagccactcgccactcagggccggaggcggggcggggagccgcggggaaggaggggcggccgggctggtatcccagcctcctgggaactgcctggaccgtcgtcgcgcccgagtgcatcgcgttcttgctggagggcggatgcgccctgccttcctctgactcgctggcggcctcggaaacgctactcccgcgggagagcgctcgtgggacggcctgggccaggctgcttgtcagcccctgcgcttcccggcagtttccgcgtccctgttttccctgcgcgtcttctgatttccaccatgaggacgtttgggtcgtgattttcatctgcatgtggaggaaactgggccgcgcgccgggagccgcgcctgcgggtgctccgcccccaagtgcctgtgggtttggtgcgggccttgggttcagttcagctcgctgtgacctcgactgagcgctggaggctccgcgggcgggagcaggagggctggagccggcgcctgctgtgtgcccggcgcggtagtgatgtgtgagcctccccgcaacttctgagaaggtgtgaccttgtgtggtcaggaagccgaagcttgacgagttttcaagtacgttttctcaggtcctgcagctgggagacggcacaggacactaaaccaggttggtcagatccacggctctcacgctcccttgggccgttttgccttttctggaaaaaggaatcactttgtcttctaaacgcacaagtaatattttacattaacatacggatttcacagtaatccttgcattttttttttttagacggcatctctgtcaccaggttggagtgcagtggcgcaatctctgctcactgcaacctccgcctcccgggttcaagcgattcttctgtctcagcctcccgagtagctgggattacaggcacccgccaccacatccggctaatttttgtatttttagtagagacagggtttcaccatgttggccaggctggtctcgaacttttgacctcagatgatcctcacatcttggcctcccagagtggtgagattacaggcatgagccagtgcacccggccaaattacttgcatgaaaaaaacacatagtgcttactttgtgccaggcactattctaagtacttcacagttattcgtataatctttataacaactccgaggaaagtactattattagtcttcccattttatagatggagcagaggcacagagaggttaagcagcttacccaagggcacacagctggtaagtggcagaatctggaactcaggtagtctggtgccagagtctaagctcttaacagctgtattatttttatgatttttaaatatggagcagctaaggttcaaagcagctgagtgacttggccagtgtcacatagctagacgtgaccaaggtggaagtttgaaattagaatatgttgataaaaggacttacaaactgtcaggatataaatataaggaaatatcgcccttatttataactgttgtattggctctagcatctctgcagagtcccgaaatgtctccaagtgactcttccggtagagcagaaaaagaagaatgcaggatgacagagtttgagcacgagctttagaattgaatcctgtgcagtctgttagcggcttcacttaaggcaatttacatagctttccaagctcagtttccccatctatgtaatggatctattacttgtaatcccagctactcgggaggctgaggcaggagaagcccttgaacctgggagggaggttgcggtgagcggagatcgggccattgcactccagcccgggcaacagatcctgactcttatcaaaaaaaaaaaaaaagaaaattaaccttagtttaactttcttgctttaccaagtttttaatttttaaaattttttactcttttgtaatagcacttagtttaaaacacaacacattgtacagctgtactaaatatatcttcatttatatcattgttccatagcttttttcttttgtgtgtgtgtgtgtgtgtgtgtgtgtgtatgtgtgtgagacggtgtctagctctgttgcccgggctggagtgcagtggcgccatctcggtccactgcaacctctgcctcccaggttcaagtgattcgcctgcctcagcctcccaagtacgtgggattacaggcgcctgccaccacgcccagctaatttttgtatttttagtagagacggggtttcactgtgttggccaggctggtctcgaactcctgacctcatgatccgcctgccttggtttcccaaagtattgggattagaagcatgagccaccgtgcccagccagctttttttttttttttgagacggagtctcgctcgctctgttgcccaggctggagtggagtggcgtggtctcggctcactgcaagctctgcctcctgggttcacatcattctcctgcctcagcctccggagtaactgggagtataggtgcctgccaccacgcctggctaattttttggatttttagtagagatggggtttcactgtgttagccaagatggtctcgatctcctaacctcgtgatctgccctccttggccttgcaacatgctgggattacaggcagcttttttctattaaaaaaaattacaggtgtgcaccaccacgcccggctaattttttgtatctttggtagagatggggtttcaccatgttggccagactggtctcgaactcctgacctcatgatacgcccgccttggcctcccagagtgctgggattacaggcgtgagccacagtgccctaccttaaaaaaaatttttttttttaacttttgttaaaaatgaagacacaaacacctactagcccaggcctacataaggtcgggtcaggtaattgatatcactgtcttctgccttcacaccatgtcccattagaaggtctttagggggcagtcatatgcatggaactgtcatctgcgataacagtgctttcttctggatatcttctgaaggacctctctgaggctcttgaggtgtcactcttatcagaaatatgtccattgtggtttgcttggtttctttttttttgtcataggtttgcttgtaaacagataatgtaccataaacattcttctctagtaatgaaaaccttttggcgttggagttcatgtttcagactttttaaggaacttgaggtctgtaaaagctgctgaacccttcactgtgaattttcttggatgttcttttctttctgtggctaccttttctcttgcctcttcttcagctatgagttcctgttccattataatcttaagggaccattgtatatgcagtgtgtcattgactgaaacatcgttatggtgcgtgactgtattaccatcttgcattagtgtggtacatttgttataattgatgtacaccttcactttttatggtactgggtgcctggttctctgtgtacatcctgaaggttggggaggggttggagtgatgggtgagggagccttatggatattgctcaattttcctgaaaactttgctgttctaagtagcaggggctatggattcttatttttaagaaagcagatcttgggccgggcgcggtgggtcatgcctgtaatcccagcactttgggaggccgagacgggcggatcacgaggtcaggagtttgagaccagcctggccaatatggtgaaaccccgtctctactaaaaatataaaaaataagccaggtgtgttggcgcgcgtctgtagtcccagctacttgggaggctgaggcaggagaatcacttgaacccaggaggcagaggttgtagtgagtcgagattgcaccactgcactccagcctgggtgacagtgagactccgtctcaaaaaaaaccaaccaaacaaaaaaaaaaaaaaaaggaaagcaaatcttgtgactgtttaggcaatgaccgttaaaactatgtatggtaaattttgcaaccattgtacaaatgagctgttttttaactatgtaagttttcaaaaattcaaaaatggggaataatatgaacccctgtgcccatctcccagattgagcaatgattaacatttttcaacacctgctttgcttatctccctcctcctttttttgtggctctaagattttaaagtaaatctctgatttcttgtcatttcaaacctaaattcttctgtgtgtacctctaagaaaaataaggacattctggctgggtgccatggctcacacctgtaatctgagcactttgggagttggaaggattacttgagcccaggagttccagaccagcctgggcaacatagggagaccctgtctctacaaaagaaaaaaaaaaaaaaattagccaggcatgtggtggcacatacttgtagtcccagctacttgggaagctgaagcaggaggatcctttgagctcaggaggttgaggttgcagtgagctgagatgacactagtgcacccagccttggtgacagagtgcgaccctgtcttgtctcaaccaaaaaaaaaaaaaaaagaaaataaggacattctgaacataaccacgatgccagtatcatacctaacaacattagtaattccttaatatcacttaaaatctaggccttttaaaaatttatttatttattttttgtttttatttatttattttttgagatggagtttccctcttgttgcccaggctggagtgcaacgatgtgatcttggcttactgcaaacaccatctcccgagttcaagcaattctgcctcagccttccgagtagctgggattacaggcatgtgccaccacgcccagctaattttgtatttttaatagagacagggtttctccgtgttggtcaggctggtctcgaactcccaacctcaggcgatctgcccacctcggcctgccaaagtgctgggattacaggcgtgagctactgtgcccagccaagtttcttaaagaaacactgtttcttaaaaaaattgttggctgggcgcggtggctcacgcctgtaatcccagcactttgggaggccgaggtgggcagattgcctgaggttgggagttggagaccagctttgagacaagactaacctggggaaaccgcatctctgccaaatacaaaaattaggtgggtttggtggtgcgcacctatagtcccagctacttgggaggctgaggtgggaggatcgcttgagcccaggtgatggaggttgcggtgagccaagatcacgccacaaaaaagtgttggaatcacccagtccttaagggacttactttctaagagccactcttttccttcagaaagggatagggtggtcgggaagtatctatttctccctaaccatttatcctttgggtcattcagcatccagtcagcctttgtcaatcacctgtgagtctaagcactgtgtcaggtatgggggtaaagggcaaatcacatcccctcctccctttaagcccaggtagtgattctccttgagaagaataagaaaatgaaatccgaaaagtgctatggttacttttcccaggaaaaatgcttgtagtgtttaaaggggatttatggccatcctgaaatctatctgtgggcctaggttaggacccccattctagtgagatttcttggggaatagggaggggctccagggatccttgagggtacatgagtgtattgaggagagagaagaaatggaactcacagctgggagctggcaggaggtgggggaagcagtcctggggtcccctgttttctctgaggtgctgccgagttgccagctgaatttgagactgaatcctgaatccagcacttgtgaactgggtgacccttgctgagttctttttgaggttgatgccttatttgtccagtcaggtaatttagtgcctgtatattgaacaccttgtataaaccggcacattttgccaggcaaggccatttggagatgctgacacttcctcaaagggctgccaaaaagaatacataaaaatgcctttgttacatgtctggctgagtgcttgggacagtgacaggtctgggtgcaacagcataagcctgtgaagccaagggttagaggcaccatttgtccaggcatttcctgtgtggcgtgtggggcttggtcagttttctcttggcagctgttttttggtgttcaggtgtgatatcttgttggctcgagttgcttcctcctgtttttccagggtccctgccctcctcctgcttggctctgtagctgtcattgtccaagcttggagggctcatgtacaagctaacatggaggaggagctggaagattgcctctcccgggggtcttgcctgttcagtggaaagaagatgggatcattacagccactccagtccctgttttactggacccgagacatacctcagcttcctggaccccacacgctcttggttttcctccttgcactgtcttttgctggcaggtcttgtgtggtccattattaagtagtattgttcttcctggttctctgagaggcgagaccttccaaaattttcatctccaggacctgtccagtgctgatgtctccacttgcctgtctcccaggtccaaagtgggacttaaccttgtatcctccaatgacctctcgctgcccgctcctactgtgccctttggttcagtgactcatacccgcatccaccctcccgggttcccagaccaaaataaaaaagcatgggagtccgtgtggctccctcttccctccacccctgtatctggatggttaccaagtcatgactgttctgtctctgataatgccccctgatctccattcttaccaccactctcccaggtaaatgctccatcttctctgtcttgggttgcatttggtcccacctggtctttcagttaactcccttcagtccacccaatgcagtcttttctctgcagccaaatttttttctatagttcaggtctgatgataccactttccattttcaaactccttaaattggcctcggagacctgtgatggccaatcttccccacccctgtgggtcaggttcctctggtgtgggcctatctcttagtgcaaggctccctgtagactgtcctggggctgcctgtctaattgtcttctcattgaaccaggtaggcaggcaggaaccactcatctagtctgggggtgactggggggtgcaaagagttttgttacaggatgtatttaacactttcattgtctggctcaaaattctctttgaagaaactgcctttgtttaattctgtttatttatttagaacttacctagaattgatttgcacttgcaaaaatgctgctgttttagagtttgctttctaggctggttgcttgctctgtcaccttagctaaaaagtaggtactggagcgccttttctcttctcttctcttctttctttcttcttctttttttttttttttttttttttttagtagagtctagctttgtcgcccaggcttaagtgcagtggcacgatcccggctcactgcatcctctgcctcccaggttcaagtgattctcctgcctcagcctcccgagtagctgggatgacaggcgcccaccaccacacccagctaatttttgtatttttagtagaggcgaggtttcaccatgttggccaggctggtcttgaactcctgacctcaagtgatccaccctcttgagcctcccaaagtgctgggattacaggcgtgagccaccacacctggcctgtagcgccatttctgtttctggttgctctataaagggagctctgtgcgtagagtaggtgtgtcagtaagaatgacttgacctagttggcaccaacaaagaaaaatagcaaacaagttaggttaggtttttttgatgattgaagaacatcttgtatgttaacaggcagtttataaaatgagaaatggaatgatttttaaaaacagcattcagctttataaatccaggaaatgcagatagaaaagagataatttttttacctttaaattataaaaaagtttgataattaacagttgtgaaaatcaatattgtaagggtaaagtacgttgccagtggacatgtttttgaacagcagtttgtcagttggtgtttatgtaattacatttgctctctctgatttattactcctatttttaagaatctagctcaaggaaatacccataatatgggaaaaaaatcagtattcctgaagaggttccttgtagcattatttttcatagcaaaattgtggaaaaacctaactgtccaaaatatagagaacaatattagtgaattattcactcagaatagtatgtagccagaaatgatgtttaggaaatagagctatgcataattaatatggaatgatagggcagggtgcagtggctcaagcctgtaatcctagcactttgagaggccaaggtgggtgaatcacctaaggtcaggagttcaagaccagcctggtcaacatggcataacctcgtctccactaaaaatacaaatattaggtgggcatggtggggtgcacctgtaatcccagctattcgggagagtgaggcagaagaatcacttgaacgtgggaggcagaggttgcggtgagctgagataacgctgctgcactccagtctcggcgacagagcaagactctgtctcaaaaaaaaaaaaaagacagccaagagataccaactaaaaaagtaagatggaaaacaaagtcaacatgattctatgtgtgtgttaacattagaaaggtgtgtatactatagatttataaaagccttctggaaattatgcaggacaggaataggactaagtaagttggagacaagaaacttttgaaacatttttatattgtctgtagtgattgaggttattttgtttttaactttttgctataataaaatcttaaaagatggttataaagactattgtaatccataaaaatatttatgatatgtcaagcaaaaaagaacgagatgatgtaaaatggcatatagttcatttgtagctacaagacaaatatgagaatagagaaaaaaggggaactattaattggttgttttaaagtgttgggattaggctggactcggtggctcacgcctaataatcctagcattaaatttaggaagctgaggcgagaggatcccttgagcccagtgggtcaaggctgcagtgagccgtgatcatgccactgtactccagtctgggcaacgggaagactctgtaaaagcgaatgattaaaaataagtgttgggattatattttctttggatttctctattttctatttaaagattgccctatcagaatcccatcttcatttttttgttctttctgacataggttttcaagggacatgagtgacccgaggatggtgttgagcctctctttgtaagggttgtttctttgttactcacgtactggtaattatcttaccatctctgcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtgagaaggcagccagaggcatggaagcccaaggacctggttcctaatggagccgctgccccagctccaagtccctttcccctgggttgggatatggaatcacctagtcctaggtcatggccacagctgaacacagaaatcctgcctgtgtatttggcagttgtagattatgtccttgtatctgtttcttttcttctgggcattgggggtgtgagtccctggaaagcaaaggtcacacacatgtctagaacttgcatagcaggaatagcaggtgtggctctggcgtcacaccttggctttcctgggtatgatgtgtgcacctgaaggagtgctgtcctcctcagccacctgcagccctgcaccatatcccaactttgatgcattcttgtttgttgagggtgaattcagcttttggaaagagtcctttggaaccaggagagtaaataaaatagctgattgattagatgatgctgctcaaagttgcatgtaaaatgtgacggaatcaaattggttccttgctgtgatttccagagagaattccaaaaaccttccaagtaaaggctgcattgttagggttagtataaatgttaagcagctaactcttagcaggaatgaaaatagaaagtaaaagaccagtttctgcgacagtgacagggagcacacatgaaccctatggcttccaagtgggggcttgggaaatccaaactgaacctgacggggtagcggtggcaagtggtcagaacccacatctgtggcatttctggtctcttgtgtggcaagaactaaatgagacaggttcttctcagatctgtttgggtgcctttcagaagtgctgctgggtgctagaaagggctttcctccccgttctttttctgagcgggttttttccttccctaggctaaaggacctgccacctgtctcattatttccctcaacagttctgtcttcctctgccctcccctgtcttggctgtccctacaggtggatgcagaccaagttatcctctctcacagccccatgaagctcttctccgagtaccatgagaagcggatgctggtgtctggacaggggcccgtgatggaaaatgcccaggggtatccttttggtcttaactctggctgaagggaaggggcagggctgaggtgtttcctcccttagctgagtggggactgtagtgaggagtgctgggtgctggggtacacaggcgatgttgtgggctcaggggagggaggacagctcccgactgtggtcagtcctcatgtctggtggtttccaaaagccagttctcatacccctgcatcagaatcctctggggagcttaaaatacagatcccagggtatctgcgctggagccttaattcactaggtctcgggtaaaactcaggaatctgtattttttaaaaaacaaaacacctctcttagtggttctgtaactgggtttgggaacccctgctctagcctcttccttggggtgcccagtcagtttattagccagtggtagtgaagcagctaccgggagcctgtctctgggagcctgcggaataatacctggcccgttttaagcaactgttgtgctgagcacgtcctgtgtaccagcggtctgccgcacactctgaatgggacgaggaccaggatgagggcgtaggacttatgaatcaatcaagggcttgtgctggaggcaagaataacaccatgagcagtaaaggagcgtgtgcgatggcgtgtgatcgaaggccggtaagctcacaggagggcgtcacaggtgtggggcgtgtgtgatggcgtgtgatcgaaggccggtaagctcacaggagggcgccacaggtgtggagcgtgtgcgatggcatgtgatcgaaggcctgtgagctcacaggagtgtgccacaggtgtggggcgtgtgcgatggcgtgtgattgaaggccggtaagctcacaggagggcgccacaggtgtggggcgtgtgcgatggcgtgtgatcgaaggccggtaagctcacaggagtgtgccacaggtgtggggcgtgtgcgatggcgtgtgatcgaaggccggtaagctcacaggagtgtgccacaggtgtggagcgtgtgcgatggcatgtgaaggccggtaagctcacaggagggcgtcgcaggtgtggggcgtgtgcgatggcatgtgatcgaaggccggtaagctcacaggagtgcgccacaggtgtggggcgtgtgcgatggcgtgtgatcgaaggcctgtaagctcacaggagtgcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatgacgtgtgattgaaggccggtaagctcacaggagggcgccacaggtgtggagcgtgtgcgatggcgtgtgatcgaaggcctgtaagctcacaggagtgtgccacaggtgtggagcgtgtgcgatggcgtgtgatcgaaggccggtaagctcacaggagggcgtcacaggtgtggagcgtgtgcgatggcgtgtgattgaaggccggtaagctcacaggagggcgccacaggtgtggaggggagggcttggagtatccctggggcaggagttgcctgtggcttcttggaggggtacagcggagccccaggagatggctaagctcctaagcaggggaagtaggaggttgggaatgggatagggagaggaaggaaagaacaggaagggtggtgccaggttgtcgggaaccttggaagtaaacttgaggagtctgaccgacttctcagggcagtggaaagcagggcacgctttattgctgatggggcaatctgatagaatcaggattttggggaaattcattttgagagtaatcaaaccatgtccagttaagattgcaagttggaattgaggataggaaaatggaggcagatcttagaggagataggctgaagctggcttgcccctccccaaggccgcctcttccttgatgatttgggttcatcctttaagattttagctccagccctacttctccatgactcctctggactccccagcccactgaggagtctcttctgaactcagcactgactggcagcactgttctcagagaacactggttttgatgggctctgaatgtgctagctccttggggacagagttttttgtttttttttgagacagggtcacactctgttgcccaagttggagtgcagtggtgcaatcatagctcactgtagccttgacctcctgggctcaaatgatcctcctgccccagcctcctgagtagacgacaggtgtgcaccaccatgcctagctgactttatttgtagagacaaggtctcactatgttgcccatgctggctggaactcctgggctcaagccatcctcctgcctcagcctcccaaagtgctgggatttcaggcatgagccactgcacccagctggggacagagattcttatgtgcctttgccccctaggctgtgcccagcataggacctggtagctggcatgtgcctgatgactgctggtgggttacccaggagctgccctctctactctacctgtgcagttacagcctgcctgccagcacctgcaggatttgtgccatccttgctgggctctgcttggtgccctcctgcctggcttgatcaggagtgggttgtgttcccttcacttgtgatttgatgcattcagaaaggcatcttccccaagaactgtccagcattacttcctgagcttgctccagactgggcttccgaaatgtcgtcaccgtggatgagctgcggatggcctttcctctgcttgacatggtggacctggagcggcggctaaagaccacggtaataaggagcatgggttgggctgtgtcttcatccttcactcctccagtgccctgcattggctgtgtcgctgaccttgcaagccctcctgcagagctgtgatttgtccatgcttctttggaggcacatctggctaagggttttgttccctgaatttatgagaatggcccagaggctggctgcggtggcttacacctgtaatcccaacgctttgggaggctgaaacaggaggactgtttgagcccaggagttcaagaccagcctgggcaacatagtgagaccccgtctctacaaaaaaatttaaaaaattgtccaggcatggtgggtcacacctgtaattccagcactttgggaggccaaggcgggtggatcacctgaggtcaggagttccagaccagcctggccaacatggtgaaaccccgtctctactaaaaatacaaaaattagctgggcacagtgatggatgcctataatcccagctactcgggaggcagaggcaggagaataacttgaacctgggaggcagaggttgcagtgagctgacatcacaccattgcactccagcctgggcaacagagcgagactccgtctcaaaaaaaaaaaaaaaaaagccacatatggtggcgcatgcctatagtcccagctactcaggaggctgaggcaggagggttgcttgagcccaggcgttggaggctgcagtgagctgtgatcactgcactccagtcttggcggctgagtgagaccctgtctcaaaaaaaaaaaaggaaaaagcccagagaagcgaacggctttatgccctgtcctctctgtattgcttataattagctgggaacccgtttcagagccacagcatcccgtccaacaaggagttccagacttactggctggccttcccagtgctgcccaggagagctggccattgtgaagttagcaatcctgaggcccggcactgagctgccctcgggagaggtagcttgcttgcagaggaagcactggtcagtctgcacatctgcccaggtgccctgtgcgctgggctcatttttgagcactgactttgtcccctaactcatctgatcccttggtgatcctctgcagcatgactgccatctcttgaggtgcccgttggctcactttctcctcatcgcaccgtctgtgtatcacatagcccaggtcttgagtcagaccattctcacagtttgacgacatgcagttataaacagataacttactttttatttgctgatatagcttaagtccttcctcctccagcgctttctgatggaacagagcacttcctcccctgtgagggctttctccctgacctgtgcaagttctgtggagaaccagaatgtcagagttggaacagatctcggaatagctcagagacagccccacacaggggagtgacctgtcccgggtcacatagttgtttagtggcagagccaagactaccatggcctggggatggagtggaccctcgaggctggtcgagtgaagctgcctgctcaagaaccgacatgaggagaaatggcccatcaggcgtgatgccgccttcgtctccacggcctcaccttagctgcctgattttagactcttgcttggctatatcttgtgtcctctcccaccagagaaagacagctgaccacccttcctcctggtgacttcacccatggtgtcctgcctgttctgtggccccacctggccattgtcttttcgcctttcttgcatctttctcagtcctctccagctttcccttggcttgggcttgaccacgggtgtggggtctgtggagtgtgtctcccctcccctcccagcaccctggaggtggggttgtggttctcctggagtggaaggcgacttgtgttgatagcctctcctttgtctctctgcagcccctcccgaggaatgacttcccccgcattgaaggtaagagaggtcctctttgatgagttgtgaggtcttttctccgtctcctctctggccctcaggctgtctcagtgtgactgcctgcagcctggttcagcagcaagggggccttggagtcaggacacctgggctctggtctggatctgccacttaccacctctgagactgttgttagtctttccttccccatgccactcactattccaggaaaaccgtaagcttagagaattttagtggtggaaagacacctagaggtgatctagtctagtgtttctcaacttttaaacccagttctcccctttttataccaagaacattggaatatcccctttattatcctgaagtgaaattcttaggtaatataacttctgtacacacatattaaaaattagttcagtataaagccctaactgtaatagggggatataaaaggaaacatttttagtaagaagataatgtatttcagtatgtagtagttatccaagaagtaaaatggttgcactaaacagaatcaccatgaatgttaacagctacaaatgcaggctgatgtgtgtttataggtgtgacaggcgtgttttactggtgactcagaaattaggggcagcattgccgttggtcaagtgattttccaaaataggtaacagttcttggtagagttttgaaaaggcaaagtacagtcttctcttgacttacacgatagttgtatttttggaaaaattgatgtttattgaagctgtacaaaaatgctttgtgattgtatgtaaaatagaatcgttcaagtaattctgaaaaggttgttcacctgtgtggataccaggatatcaggtgggacattcaaatgttatgaggacatgggaaagttttttctttttcttcttgttgttttgtagagacgggctctcactatgttgcccaggctggtctcaaactcctgagctcaagcaatcctaccaccttggcctcccaaagtgctggaattacagacacaagccaccgcacgcagccatgggatggtttttttaaaaattaattttagtgtgggatagtttttgattgcacaggattgtcctgagtatgtagcgtccctggccccctcccacaaccttcacttgctaggttctagtcattgtgacaactaaaattgcctctgatttgtaaagcacctcagcaggggcggtgctgccccatggagaatcactggtctggtgcagttcaccggccctgtaccttagtgtcagcagtgttctttgcctagtgcttactgtgtgtctagtcctgggctgtttaccgatgatgtagctcatttttatcctcacaatagctaagtgctgttgctgttatgtagttgcagttgaggaaactgaggcttagagaagagaagttacttggccacagtcatacaggagaatcggtggagtccaggttgggtttcaagtctctatcactccacaccccctgtcctggctgttaggttctgccagtccctggggctcagagagaagcgactgagggaacaggagcccttgctaagtcatgtgagggagaatgtggtggcagagtcccagccagcaaggagaagtagccctgagacatgctgcttttgttttgtaacctcttctgtgaagcactggtggactgaagtcagaatgggagccctcaggaatctccttcctgggccctgggccttgtgcacccagggtggatgggtaaggggctctactgggcttgttggggagctgtgcccctgcccagctgggtgcaccatgggtggagggcttgtggatgggtagccctagctggcatcctgagggcctgccgcctgccatctgccctgcagccctcacctgcgcctctgttctttaaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtgaggacacaaagctcccagccttggcctggtggtctattcctggctgctgcctgggcagtcctgcaggcagttcccatccgtcctgacaccccaggtgccgggacctcacttaggtaggccctgttgttgctgcagtaacctggcctttggaagggctttcaaggaccactccacatattagttactaaacctaaactacagattatggagtctgaggatgtattgagaggatgtttcacacgtgacccctgccccctgtaatctttacagaacatgctcttggtgtctggtggatcccaaaccgtgggcactttttgtaccgtatctgtgcacattattcagttgctcttccttccttggctccatcctgtagcattggttctttgactttctggtttccttttacccttcagacataaggcaggaggaagcaaggatttgtcgttttttgtttgttttgttttttttgcggggacagtgtctcactctctcatccaggctggagtgcagtggtgcagtcatagctcactgcagccttgaactcctggcctcaagtgacccccgtgcctcagcctccaaaagtgccgggattacaggcgtgctccatcatgccggccaaggattgttctgatagtcgtatagaccagagaactgagacccagcagataagtggctttctcaggggcatgcaggtgcctatactccctgctcagctgtgttggtgtcatgtgtcctgtcttattctggggctagcacagatagaggcagcccttttttggcctcagggtgcttacttgaaggccagctgacagctgctgtgtactgttcggttgctgttatctgcatggccagtctcttgagtctcagcctgctgttgacccccagtcgacagtgctcgtcagcagagggtgggcacggcccagtactgcctcagggcccgtctcagtagtcccagagagacggggtatggtatgctcttgtcacttttaaagtgtatgtctgtggctcgaggcttggcattgtctctgaagtattattcctagaggcgggtatgctgacactagatcagtgggcttggttggttatgtctctgtgaactgaaaagcaaggggcagatttcaatttacaaaccagattttagatgaacttttctaattaaaagtagaattatttacataaatgacactgaaagatgtggtggctcatgcttgtaatcccaacacttcgggaggccgaggtgggtggatcacctgaggtcagttcaagatcagcctggccaacatggcaaaaccccgtctctactaaaaatataaaaattagccgggcatggtggcaggtgcctgtaatcccagctactcggaggctgaggcaggagaatcacttgaacccagggggtggaggttgcagtgagctgagattgtacccaagcgccagccatcatatcagcattccaggtgtcaagaaggagttggggagggcagagagggcagagaagaataccgtccccagtttgtttgttttttttttttagatggagtcttgctcttttgcccaggctggaatgcagtggtgcaatcttggcccgctgcaacctccgcctcccgggttcaagtgattctcctgcctcagccccccaagtagctgggactacaggcatgtgccaccacacccagctaatttttgcatttttggtagagacaggctttcaccatgttggccagactggtcttgaactcctgacctcaggtgatccacctgccttggcctcccaaagtgctaagattacaggcatgagccactgcgcctggccgcctgtccccaattttaaggatgcttattgaaaatttagcccagcatttctgctttccttgactgtagcttagtcacatggccacgcctcgctggcagggaggcaagcgaaggtctttttcacacctagtggcaatatggtcagctgaaaatggacaccagcaaagaaggggagaagcgcaaccgtagtctgcctcagctctacagcaggatttaagctctggagtcagactgagttgtaatcctagctctgccctcttgaacaagttacttaatcttgctgtgccttggtttcctcgttttacaaatagcgtcatctcatagagtttttctgagagggaaatgtgaaatgctgcctccagtgcctgcacagtgtctgctacatgtcagctcttaccctggggaaaaggctggtctgtgtgtttgctgcttagacagtggcagtcgtgttctctagaagagcctggagatcaggaagactgaactgctgcgtgctcgtttctggcaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtggggtaggctctgctctccctcctttgtcccttttatgacatccccttctctccctcctcctctactctcacccccatttccctatatctaattcactcttctgccccgaaactcttctctgctccctttgctttgcaacattgatttagggttttttctcctttttccttttccggtgtggctgcccctgccagtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactcttgtgaagctctgtctggagtgcactaaaagtcctgtggggaaaggaggagtgagtggtgtgggcggcccagggtctgggagatgggtggcatttcagctccacgaggtgcccacatctcctttcctacctcccgcccccaagtccacacccattctgggctgtgaagcctgaggctgtctatgaatgagtatgcctggctttggcatatacttagcaacttccctggtgtggaaaagaagagggatcttgttactggtttgttctaaaggaagcagctcttcctgcagtgattctagaaaacatgccgcttcttgcatcccttcctctaggagtaaccaacttcatttcttcatttgtctgtgtcacccatggcctcagcatctgcaaatcccccagtcagttctcgtcctcattttactccagtagctgtttgtgtttgacatagctgatgcctccctcccttgttctttttttattttttagagacggagtcttgctctgtcacccaggttggagtgcagtggcacgatcatggctcacttgaacctcccgggttcaagcaattccacctcagcctcctgagtacctggcactagaggcacatgccaccacgcctggctaatgttttttttttttttggtagagacagggtttcaccatgttggccgggcttgtctaaaactcttggcctcaaatgatctgcctgccttggtgtcccaaagtgctggcattacaggtgtgagcctccacgcccggcctccttccctcattcttaaagccctcttggctctctccacctgactactctttttttttttttttttttttttttgagatggagtctcactctgtcacccaggctggagtgcagtggcatgatctcggctcactgcagcctccacctccaggttcaagcaatttttgtgcctcagcctcccgagtagctgggattacaggcgcccgccaccacgcctggctagctaatttttgtatttttggtagagacggggtttcgccatgttggccaggctggtctcaaactcctgacctcaagtgatccaccctccttggcccctcaaagcgctgggattacaggcgtgagccactgctcccggcctaactgatttctttctttctttttttttttttgagacgggagttttgctcttgtttaccaagctggagtgcaatggcgtgatctcggctcactgcaacctccacctcccgggttcaagcgattctcctgcctcagcctcctgagtagctggcattacaggcacgtgccaccacacccagctaatttgttgtatttttagtagaaatggggtttcactgttagccaggctggtctcaaactcctggcctcaggtgatccgcctgcctgacctcctgaagtgctgggattacaggcatgagctaccgcgcccggccctcagctgatttcttgacacctttgcttggatgcctcagaggtgtttagaggttagggagcaaaggaggttgagagagtggctatgaaacaggagagccggtgtcttggaggctgagtggctgagtgctgaggagctgtgctcattccctcggtgtaagtgttgctgtgtccacgaccagacactgagcgcagtccacacctcctgcttaactgtcttccccagcttaggtggctgcagcagctccttcctctccttgtctaggccgagggcctggcgtcctgctgagctcctcttaatttcccaagtgagctctgctacccaccacgccccgccccaactaggcccctggcctcacctgagctgttacagccacacttcatggcctccctgcctccgcccttttctttcccacttgctctgctcactcattggcagatcacgtggtctgttctctgatgaaagccctccagtgacgtctcagtcagagcaaaagcagtgatttcttaccatggcacaaatgcctcttcatcctgtcccaccgctacccccgggacctcacctgctgctttccccatcatcattcacacacgccacccttctccacgttcactcctgcctagggcctctcgcagcccctctgccgggccacggtgtccatgtggcacatgccatcccttccttttccttttttttttttttttttgagatgaagtctcgatctgtgccccagactggagtgcaatggcgaggttttggctcagtgcaacctctgcctcctgggttcaagtgattctcctgcctcagccccccaagtagctgggactacaggtgcataccaccacacctggctaattttttggtttttagcagagacggagtttcactatgttggccaggctggtctcgaactcctgacctcgtgatctgcccgcctcggcctcccaaagtactgggattacaggtgtgaaccactgtgcctggccaagcatctttctttttttcccagacccacttatgggtctgatggatggatgtgccattccaatttccttgactttctgtaaacatagcaccatcatccttaccctacttaatgttttcatggtacctaccgccccatgacccacatatacttgctgattctatgtcttctactactccatggactctgtccatattggttcataaccctgtccccacacctgcatgcctggcacttggcaggcttcaaaagatgatagtagatggcccctgagaccctcctatggtgagtcctccacagggcccttggacatgaaaacgcctccctctgccttcactccccagggagcgtggcagaagtgaaaggactgcaggcctggcgatggagtcccagcccggccatccactagctatagggccttgggcaacttccttcactcctccaagcttccattttctcacctgtgaaattggcattggcaatgtttgtttcataggactatctgagaaataaatgagctgttataagtacagttctgtatcatttcagattatgttctgttcctaacagaaatctttttggtctttttcttctagagtctggggtcttgctgtgtcacccaggctgaagtgcagtggcacaatcactgctcactgcagcctctacctcccaggctcaagtgattctcccacctcagccttctgagtagctaggagtagaggtgtgtgccccactgcacccagctaattaattttttttttttttttttttttttttagagatggggtctcaccatgttgctcagactggtcttgaactggcatcaagtgatccttccaccttggcttcccaaagtgctgggattgcaagcatgagccactgcacctggcctctaacagaagtttgattggtggcttgacccaacaggaggttatttttctaagtgatgggaaggtcagaagtggcatgtcagggctgggagcagtgccaggctatcctggaggactcagtgcccaccccaccatcctcagcacgcatgctttgtccagtggcaaggtggcccccttacacgtgcaagcccctcagccccactgagaagggggagggagggaagggcccagagcagagctcatggagcttcatccccaggagtgcccccttctgacctccagttctgcaggtgatgacgagggggtcacacagacacccccagtgacaggcagggactggcacattgtcgctcaaacaaaattcgggttgtgtgtgaaaggctcatggggtgcgtgttgggcaggtgcctcgtggcgccaacagcaccaaggcactgagctgggttattctgtcaatctgggtggtgaggttgacctgttgacctatctgacctgagctcatctgggctgcacccagagcagctgctccaggacatgacgcaagtctctgagtctctgaagaccagccctggcctccgaagcacctttgtgttggccatctgagctgctggccaggacccagtcttgctggctcacatttgcatggtggttagcattttccaaagcattttgaaacaggtgtcatccgttcctactttgttagagcctcacaaagcccctcatggagagagaattcttatctatgccattttcagaaatgaaggcacaaagtcagaaaccattcattctttctcatttaatttcacttatttatttattatattttgagatggggtcccgctatgttgacccagctggtcttgaactcctgggctcaagcaattctcccgcctcagcctcctgaagtgctgggattacaggtgtgtaccaccacacaccacacactctggctggagtgcagtggcgtgatcatggctcactgcagccttgacttccttgggctctagtgatgctcccacctcaccctcccaaatagctgggactacaggtgtgcactaccacacccagctaatgtaatttttttttttttttttttgagacggagtctcgctctatcgcacaggctggagtgcagtggtgcaatctcggctcactgcaacctctgcctcccgagttcaagtgattctctcaccttggcctcccgagtagctgggattacaggcgcccgccaccacacccagctaattttctgtatttttaatagagatggggtctcacaatgttggccaggctggtctcaaactcctgacctcaggtgatccacctgcctcagcctcccaaagtgctgggattacaggcgtgagccaccgtgcccagcctgtaatttttttattgaaacaggaacttgctatgttacccaggctggtctggaactcctgggctcaagtgatacccctgcctcagccttccaaagtgttgggataacaggtgtgagccacagtgcccagccccctatttattactcgtttgggtttcctaaagatatcataagctattttaggctgggtgcaaaagagcaagtgtcctgccacatgacttatgcaaatccagagagcagggccagccactcagctctgattccaattttgtcccttaggggctttgtctaaaccctggaaccaaaactcatccagctgctttcatttgctcaatcccaaatgaatgacaatgttatctttttgtgttttgatggagccgagtgaataaaaaaaaaagactgagtgcatcgaataggatgtaaggccatatttttaatgaaattattaacatgggacaaaacttcatcaggttgcacattgaacagataaaatccccttgggtctgagccattaccttggaatcagaacatgggcatttccttggtgttccccttggcggcagccgcctgctctcagcctgaggcaggtgcagggagcctgctggtaatcgggacaccctgcagagctggggttgctgtagcaaccagatgctgcctggagggcggaattttaaaatatctcagctataatagtttttttcacattctgtcacttccccagtgctgcatcatactgctgaggtgggccatgcggggacacaggggcccttgggtggcagcttctgtgggtgttggaagtgggaagatggtctcagggtgttaactgctgggcagccgacagcctcagctttcgcttccaggttcctccagctcttggttccaaagcctcgtgtcattttctctctttttggggtgagaggggatggagagagagaataggagtctagcttgaaactccttccctacctcctccccctctgatttgagctttctggctctgcatccctaggcgagcagccttggcgttcctggagctgtctctttggagaggggaggggtgttccttcttcctttcttgtctgcttcttcctttggtctttcttttttttttttttcttgagacggagtctcgctctgttgctcaggctggagtgcagtggcacgatctcgactcactgcaagctccgccccccgggttcacgccattctcctgcctcagcctccccagtagctgggactacaggcacccgccaccacccccggctaattttatttttttaatttttagtagagacggggtttcactgtgttagccaggatggtttccatctcctgacctcgtgatccgcctgcctcgggctcccaaagtgctgggattacaggcgggagccaccgcgcccggcccctttggtctttctaacttcctctttcggcttcatttattcacatataaatgactgttgctctcctaccaaatgcagtgttaagaaatgagggccgggctcggtggctcacgcctgtaatcccagcactttgggaggccgaggcaggcgaatcacttgaggttaggagtttgaaaccagcctggccaacatagtgaaaccctatctctactaaaaacaaaacaaaacaaaacaaaaattagccaggcaggtggcacgtgcctgtagtcccagccactcgggaggctgaggcaggagaatcacttgaaaccgagaggcggaggttgcagtgagccgagattgcaccattgcactccagcctggatgacagagtgagactccatctcaaaaaaaaaaaaaaaaaaaaagaaagaaagaaagaaagaaaagaaacgagaaattcccttgttctagaggaattcatcctgtcttgaccctggacttgcctatcagatatcaagcatttttatgaagttacagtaattaagacactgtactactggcagagggagagacacaaaccaatggcacaaaggagagtacccagaaacagacctacacatgtatgaaaatgtggcctcacaaaatctttctttcttactcatttcatagcctgatatgggtcaggtggctactcttgacctttttgcttcaagtggtgactcagggatccaggcaccctccagttggtgatgctgtcatcttccacacatgggtccaaggtctgtgggagagagtgtgaatggataactgtgaagggatttatggccgaaccaggctgtggtgggtgccacatgtgtgcatgtttattggctagccacatggttctaatgtgactgcaaagaggatgggaaatgtggtctttctctgtctaggaagaggaaatgggattgaacagcatctagtctgtctctgttgccatattactatttactaggaataaagaaattctggccaggcttggtggcttacacctataatcccagcactctgggaggcagaagcaggaggatctcttgagtccaggagtttgagactagcctgggcaacatggggagaccctctctctacaaacaaacaaaaaaatagctgggcgtggtggcacatgcttgtagtcacagctacttggaaggctgaggcaggagggttgcttgagcccaggattcaaacctgcagtgaactatgattgtgccactgcactctggtctggacaacagagcaagaccaatagagcaaaaaattttgttttgctcaatttttgttgaaattcatgaatagatattaaatgtttgtttctctgtatttgttgagttgatcttaagtgttcttctcctttaatctgttaatatggtaaaccatattaatatattttgtttttatctttttttttttttttttttttggagacagggtctctctctgtcacccaggttgcagtacagttgtgcagtcctggctcacggcagcctcgacctcccgggcttaaacaattctcccgcctcagcctcccaagtagctgggactacaggtatgtgccaccacaccccagctaattttattgtttaattttttgtagaggtgaggtcttgccatgttgcctaggcggctctcaaactcctgggcttcaagcgctcctcccaccttggcctctagaatgttgggataacaggcgtgagtcactatgcccagcctgttgtcatctttaactctttctttcatccctgggataaaaccaagttggttatgttacatgttgctggccgctactgctggtaatttgttcaggagttctttgtctatgttcataagtgcaattggtctatgtcttagtccattcaggctattagaagaccatagactgggtgtcctgtgaaaacagaaatttatttctcatacttttggagactggacagtccaagatcaaggcatcagcagatttggtgtctggtgagggcctaattcctgctccttggttggcctggaccagagaggtggccagcctttgaatctgctctgcactgtgggtccttgcactctgggctggtgatgggagtgccaactctcatgatctctgaattgccttcagggtccttcttccattatcttggagaacagctcctagcttctgttgcaatggctgatccatactactcttactaaaggagcttggcaacagagcaacaccgttagtgttctctccaaactgggttctcgttcttttctatatggatgggctgatcatttttcagaatttcaagttcttattactttttgcttaacagttctgtctttaagtcatttatgtctctcttgaattttattggaagcagtcagaaggagctaggtaactccttcaatactttgtttagagatttcctaagccaaacatccaattgcaagtttcattgcttgcaattgttacctccacaaaatgatagaacatgaacacaatttagctaagctctttgcttcttcctaacaaggatggccttttgtccagcttccagtaaatgttcttcatttccatctgtggccccatcagaatggccttactgcctgtaatcccagcactttgggagctcaaggcgggtggatcacttgaggtcaggagttctagaccagcctggtcaacatggtgaaaccccgtctttactaaaaatacaaaaattagccgggtgtggtggcatgcagctgtagtcccaactactcgggaggctgaggcaggagaatcacttgaacccagaaagtggaggttgcagcaagatcacaccactacacttcagcctgggcgacacagtgagactttgttaaaaaaaaaaaaattaaaaaaaaataaagaatggccttactatatattcccaccagcattctgttcaggattacttaggtattctctaagaagattgaggtttcgctacagctctcctcttttctttctgagtcctcatcaggatcacccttaatgtccacatttctagcatacacctcaaaactctttcagcctctacctgttacccaatttgaaagttgatgccttggcttctcaaagtgctaggattgccaggtgcggtggctcacgcctgtaatcccagcactttgggaggctgaggctggcagatcacgaggttaggagatcaagaccatcctggttaacatggtgaaaccccgtctctactacaaatacaaaaattagccgggcatgatggcgtgtgcctgtagtcccagctactcaggaggctgaggcaggagaattgcttgaacccaggaggcagaggttgtagtgagctgagatcgcactactgcactccagcctgggcgacagagtaagactccatctcaaaacaaaacaaacaaataaacaaacaaaaaacaaagtgttaggattacaagaatgagccaccatgcccaaccatatttccttctttgtgttttcattgtacttgcttttctttctccaacttttatttatttattttgagacaggatctcactctgttgcctaggctggaagtggtgtgatcatggatcactgtagcctcaaactgctgggctcaagaggtcttcacctcagcctcccaagtagctgggtctacaggcatgtaccatcatgcctggctaatattttaattttttatagagacaacgtcttgctatgttacccaggctgatctcaaactactagcctcaagtgaccctcctgccttagcctcccaaagtgctggaatgacaagccactgtgctcagccaatttattaagttggatgtttaccttattaaatgttcaattttctcctttgtaacacaaacatttaaagctataaatgttcttcttctgctttggctatgtcccatccattttgacaggtggtattttc

SEQ ID NO: 1643 - DNA, 1804 bp, Homo sapiens
gtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactctt

SEQ ID NO: 1644 - protein, 431 aa, Homo sapiens
ARAHGDGRMAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 1645 - DNA, 26750 bp, Mus musculus
  misc_feature (1)...(26750): n = A,T,C or G
ggcaggaaaaccaccggctcaatgaggtctacgtcatgggcaatcaccaccagctgagccttcttgttctccaccaaggtggtgactgtgttgactcctgctcagaggacagggggtctcttagttgggacgtcccctttgcctgcagctttcttctcagcacaggccagtagcctttgcttcttctcttgctttgtctctgacctgtacttgtgggcaagcttaagcagctgagtaactgtttgcctgttcaaggcctgggtgaactggttaatggcaggaggtactttgagccacttattgaagatggcttttggccgctgcagcctgatgtagtagggccatttgataaagcatgttagatctcttttgggctggatgtcctgactaatgccaaacttcttgggccttttctcaaacaaagggttgaccacctttttagcctcctgtttcttgatgactttaagggctggggacaccttcttccccttgtccttctttgatcaattgattttatttgtttgtttactttttttttttttttttgagacagggtttttctgtgtaacagttctggccatcctgaaactccctttgtagaccaggctgacctcgaactcacagagttccgcctacctctgcatttgagtgctgggattaaagggatgggttaccacacccagccctttgagttttattattttttaatgatatcaggtaaggacttaactccatttgcatgtgtccatccagctttcccttcaacgctggtataacatcttaaatgtatgacaccctaatttaaatgatatcagctattcattgagaagactgggttttgccccgttgaatgctcacggtacgcctgcaaggaagccatctgctcatacaggtgaagactggtttgccttccctatccagctgctctggtcagacccctgtctgtgctttcaccacgctgtggactgcagcagctctgcctctttcagagccaggaagagtgaccccagctcgcccttcttttaaagattattctcaggtcctagtaattccatttgaatttttaggatagggtttcctatttatgttttttaacaagtcattaggattctgttctaaattctgattggtaggttgctttgggccatattgacttcttaagtcttctagtctatgaacacagggtatcttttggctttttttttaggtaatttctttccacaatattctatataatttttggcatacacttctttcacctcattggctaactttactaagtattttatttctttattttatgccaccataagttaaattgttccttagttttcttaaggactgctctttgtgagcttatgagaattcaatggcgtctggttgctaatatttttaccatgtaactattcattccagtatgtatgtatgtatgtatgtatgtatgtatgtatcatctatctgtgtatctatgtgtctatcaccatgataactaccattgtcattttgcctaagtgccaggtttgggccaggcctttacttaaatttcatgtgtatgcagcaaccgtgttcacaggttcatgttcacagggtgctgatacatagtttctagagaattggatgaggcatacttgacccagaagtaaataccacaggatctgggacttggagtaatcagccagaagttttgtgttggtttgttttaccatgaaaaggtgttggattttctcaaaggcttttctgtacccatttggccgactgtgtcgttccctcttaattctttcattgttgtacacggaagcgatggctctttgcaaagccgaatccttggagcagcctaagcacaacccccttttgatcacagcgaataacatgctgtggggtgcatgtgctgacattttttgaggcgcttgtcccagtattcataagacatattggtctgtggttttatttcttttaatgtctctttggggctttgacatacgatgtattttgtctgacaatagttgtaaatttgcatctgttctttgggcatgatttgcattttttccctttatttttgcttttcaaggcagggtttctctgtgtagccctggggtttgctctgtagtccaggctatccttgaatgcacaaagatttgcagtctcttcctcccaaatactgggattaaaggcctgagccaccacaacctggcaatgcaggaaatatcttgctccataattttatttttaaatcttctgtgtcctttgatttgtgttggggttggggcgtggctaagaggtggaaactgtctagcagtctgtagtccctgggctccacctgtaacaccacaaacaaaaacaaatcttctataaatagcacagagattaatcttgtggtttttgcatatctctctgcccatttcttcctttaaacagagagttcagattatttatgtttaatattttttctgataaagatttgtttctgctgtttatatattgcttctattttatttattttgtgcatgaatgcgtgtatgtgttgggctcgggtaccatggtgagtagaggtcagaagacaattcgattttctccttttactgtgtgggttcaggtgactgaactcaggtcctcaggatgggtagtaggctcctggacccactgagccggaccactgcctctcctcttttctgcagatttttaatttattgtcttagtgactatcttaaaatttacaagtaacaacttgatcttgtaatattttaatttgaatatctacttagtttcattaatttgcaaaacacagttcctaaaaatctctgcccttttgcttttatgctgtttatgaatacattgctgcatgtttcctctttgaacatgaatgattgacacaggttttttagtgattgttttatgtagtgtttattaaattaggtagtgaaataggagcttcaactcataacaagtatacaataattgaagtttatcttggctgacctggtggtggaggctcatgaactcaggtacctgagaagctgaggcaggaagatcacaagttgtgatctaccttggctagagaaggggttcaaggtcaaccttggccaatttaacaaggccttgtctcaaaatacaataaagaaaagagctggggatagcacttgctggaagagtgcttgtctgacatcttcaaagctctaggttcagtacccagtaccacatgaactctagtgcacacacaagggcgtatacacacacatacatacacacatacacacacatatacacatgcacatgcacacacacatatgcatacacacagacatgcacacacatacacacatatacacaacacttatacacacacacacatacacacatatatacatatatatacatacacacattgattgattgattgattgattgactgactgattaattaaatacccagacatggtggctggtacatgcctttaatcccatcactcaggaggtagagaccttgagtttgagttcaatctggcctacagagagagttccaggccagctagatttacctaaagagaccttgtctcaaaaagtaaaataaaacagaggctggagatatggctcagcagttaagaacactagctgctctttcagaagacctgggtttggttcccagaactcacatgacaactcagagcttttggtaactacagccccaggggctctgcagacaccgagtgtcatggcatatagacatacatgcaggcaaaatgccatatacataaaaggaaaacaaagtcaaaaataatgttttcccaagcaggaactattagtgtttcttctcctttctaggctctgtctagtgacgtccatttccacacaaaggactcttggcggcctttgataccagcaatctgctcccttacttttttctttctggaaatgtcttaatttctccttcattactgacaggcagttttgcccaggacataacttgtggctgaccactttcttccaggcctttagacccatctttctctctccattaattttccagaagatccttggtacatagcaagttgtcgtctcctcctcttcctccttctctttataatgacaatgtgtgtgtgtgtgtgtgtgtgtgtgtatgaaagagaggcaggggtgtgtgtgttggggaggggggaaccatgtgccatagcaggcaagtgaagttcagaaaacaatttggcagactcagttctcttcattaacctctatggggatcccaggagtcaaactgagaccgtcagggccttacctgctggcccacctccccagcccacaggctgcttttgtcttgccactttaacaattttctttacccttgcggtctttttttttttttttaaagatttatttattttatgtatatgagtacactgtagctgtcttcagacacaccagaagagtgtattggatcccattacagatagttgtgagccaccatgtggttgctgggaattgaactcaggacctttggaagagcagtcagtgctcttaacctctgagctatctctccagaccctacccttgggttctataattttactgtaatgtatcatggcacacgtttgaggggttttttttctttgttttggtttttcgagacagggtttctctgtatagccctggctgtcctggaactcactttgtagaccaggctagcctcaaactcagaaatccgcttgcctctgcctcccgagtgctgggattaaaggtgtgcaccaccacgcccggttcggtttttctttctttctttctttctttctttctttctttctttctttctttctttctttcggttttttgagacagggtttctctgtgtagccttggctgtcctggaactcactttgtagaccaggctggcctcgaactcagaaatcggcctgcctctgcctcccgagtgctgggattaaaagcatgtaccaccacacccggctagttttttttttttttttttggtttttctttttttaatcccttccttcctctctccctctttcgctctgtctctctcctctcactcccctcctcttcctgcctccccttgctcgctttctctctctttacactaaagattgaccctgggatctcagagatattaagcaaacgctctagcactgagagctagctattcctgccttttaaaatgcttatttattttatttactactttcaattttgatatagtcttgctaagttgggcggcctgccccagccctcccagtggctggagtcacaggcctgcggcgccaggcctggtatattggcattttccttggaccttgttgagcttctcatgtgtgtatccctgtctttcttcagatttaggaagcttcgggtctttgtttctttttaaaaatgtaggccagtgcctagcagctgcacatatttatgggtgcagcgacttttcagcatgtgtctacatcctgtaacgatgaaaccagggtggtcagcctaaccaccacccgatgtttgttgtgtgtgtggtgagagctaaggttctcttccagcgattttacgatagatgttatcgttcactgtagattccttgccgagcaacagaacatacgcacattctcccatcctcttacaacatcgctctgtccacctgttctctcccagctgtggcagccactgctctctctgccgttgtaagttgctattactggttgcatagaatgagctcacgtaactcttgcttttctgtggcttattttgattaaagtaatgtcttctgagtctacttatggtgttcaaacaaaacagaacttcgccctttatatggctgagtaatattccaccatatagatatcacatcctccttatatgttcattcattgttggccaattaagttaattccaaatcttggcgatgataagctataataatcatggcagcaaagttatgtcttcatcttctaatttcattacttttggacaaatacctgtcctagttacacctgaccaagacagattataaaagtgtgtaattcggggactcctggttccaaagggtttgagttcatggtcatcatggtggggagcatggcagcaggcaggcaggcatggtgctggagcagtacctttctatccacatgcactaggctgagagaggcagagagaaacactaggaatggtgtgggctgacagtgacacacctcctccaacaggaccacacctcctccaacaaggtcaaacttcttaatccttcccaaacagttccacaaactgggggccaagtattcaaacacacgagcctataggggccgttctcatccaaaccaccacagcacccactgatggagctgctgggccatgcactgattctacttttactttttaaagacattttcataactgttgcaccagcattgtacaaacattcctttttctctacagcccagctattaatgacagccattctaaccagggttggggagccagttgtggctttcctgatgagccatgatgtcgagcgtcttctccaatgcctgtgagcaatctctgtgtcttcttttgagaactgtctacttgaatcttttgtatacttttagtaagactggggggttttgttgttgtgctcttttgctttttgtttatcttgtcttattttaatggtgagacactgtagtaaagagcagtctggatattaactctcgttggccctcactgggctctaggtgagccagcatcccctctgctctggttttataattaggggttggggtggttgcctggctgattgtgtgcagattcttggtatttcattcaacagcagaacaaaagctcgtatcgactacaaagtagcaagaaaatgttaccaaatgcaatagaaatgatcaggggacactgcaaaggagccccgggccaccagagtgaagaaggcactcaagccctgttatgacttgggtcttttctttatggggctgaagagaaggagaatttaggagcttagggtgtaggtcccttttctgattgataaggctaagtcagaaagccattttttctattgctcatgtcttttcccataatgcatctgattttagtcatatgcatgcctgatcatgcacatgcatactctggataatagtggattctccctaaaagctcctggcctgaggacacagctttatcttaccctataggcaccgcgaaccagttccagttggactggcctccctattcttcccattggtacattaggaatatgtttgaataaaaacaaatttgctggctgttaggagcagaacaacttaccttgttcagagagaagtgtagctccacaaagacggggatctgaggtcggtaggtgcattgtgtgaagaggggtgagggtatggtatgtgcaggggaaggagctggtagccaggagccgggcttgcagaactaaaacaaggtatagtctatgttgctaaactatccctgtttgcctgcctcggtgacaccagccctgtgacttgggtcatcctgctccagtgagacagtgtgagctgtcatggctaagctccactctggctgggcatccctctgcctcactgtgaccccagggttgctttgttcctgtgtgattgatcatgatcctggccactgttggagagaatttcccacagagggtgcctttcagcatctccctccccaaagtccatttccccatggaaatgtgtttgtaacttttagccagacacaccgtggagggaatggattttacagacctgacgtgttctgcttaggtgcaggctggaggaagggtgtcagggcagacagattctcctcactcccaatgccaggaaggaccctagagctgttcctgggcctgccagcttccagagtgctgctactgcctgcccctgcagtcactaccttctgcttccagtacgtctgcaggggggcgggctgtgtgctaccgatacctgtcagagagagagagagagagagagagagagagagagagagagagaatgaggctcagctcagaggtttggctcaactcagcttgcttgcattgaagagtaaacaaacaccttgaaaagtgcttcaggagaagctgtggccacaacagacgagagtcagagtgaaggcattctagcatcaaagtggactgctgccatgtagctctgaggagatgaggatcatgtctgtaatgtgccagacagggtctgtcaacccatagtgacaagtcagaatattcactctcctgatgggagctagccacacggagtcactaggtacaggaagtgagctcagtcttggtatgggctgtaatggtgtctttaacactggcaaaagacatggactttatacaaagcattgctgtaatgtttcttgtatcagtgaacaagaaaggggaaaaccactgagtgcctgctgtaggcttggcactggccagggctgttttgaaaatattggttttttagtgggcacctaagtcctgaggacccagcgctggacagaaagttatgaccagaccttgccaaatgatgcttgtgctgtgtcttagttagggttttactgctgtgaagatacaccatgaccaaggcaactcttataaggacaacatttaattggggctggcttacaggttcagaggttcagtccatcatcatcaatgtgggaacatggcagtatccaggcaggcatggcacaggaggagctgagagttctacatcttcatttgaaggctgctagaggaagactagcttccaggcagctaggttgagggccttaaagcccacacccacagtgacacacctactccaacagggtcatacctcctactagtgccactccctgggccaagcatatacaaaccatcacatagtgaatttaaacaatggcaggaagcagtttccctcatgaatgccaaggccatagtgaggagcaatgattctgtgtacagaaggggcgcctgggcatggaggacagtagggtctcttccaggcccctgttctgatgccatgaaaagaggagggtcacgtggggcaaggagattgaagagatgagggagccttggacagatgaggatgatactggactggggctggaggagtggcttggcggttagagcaattgctgcttttgcacaggactcgagtttcaagcataaagcaggacacaattacctataaccccagttctagcggacccgacaccctctcctggcctccacagataccaggcatatatgtggtatatataaatacatatacacacatacacataaaattaaaacaaataaatctttttaaagatactttattcactctggttaaaggcttccacacagactgttagacagacaatggtaggtgcctaggcacaagcctacacacatgcagacgggcacacaggcctcaaaggcatctaggtctacaggcagacatacccagactagctgtcaaaggtgaaggctaaagcccttgcctgtgacctcaaggccatatttatacagagtcacacaaaaatgtcattctgtcggggatagctagagaagagatgacatcactgtttgctttcgggttccccaaacatctagtgtcggccattttgtgctggctcataaccttctgctgtccaacatcagcacctcagtcggtgctgggtatctatatcagtgccagcttgtctcaacccaaatcgttcctcacagccctctggttccaacagtcctccggggtaatgaggtttagacagatgtcaaagatgagggagacgtaagcggggaccctggggaggagacctggtacacatggaggacaatgtggggacagtcagggtacaacagtataagggagagaccatagacaaaacattttacaaatgagaaacagaggtttaaagagtgaagaagtcacccctgacctcagctgcggctggacgctggctctgcctgctgaaacagagaacatctcagaatgggtcaggagagcatttgcccacctgctgtcctaattctccatctctccttccacaggattggtgaccaggcatggctatggcattctgccccaaagatcagtactgggactcctcaaggaaatcctgtgtctcctgtgcactgacctgcagccagaggagccagcgcacctgtacagacttctgcagtaagttctggagtctggggccatgggatggctgagtgattctcacacacacacacacacacacacacagaacccccctggcctttctgaatatatagatatacagatatatagatacaaatatatagataatgatatagatatcagaatgtgatgtgccagagggcccaaccattctggaattgctgtcttcacactgaaatatagcgttggtttgtttttgtttcttcgctctgacgtagtctagggtcagacacccaaactcctgtgagcccagaacacctggcagcatttttttttctgtcccacagaattcatcaattgccgaaaagagcaaggcaggtactacgaccatctcctgggggcctgcgtcagctgtgactccacctgcacacagcaccctcagcagtgtgcccacttctgtgagaaaaggcccagaagccaggcgaacctccagcccgagctcgggagaccacaggccggggaggtggaagtcaggtcagacaactcaggaaggcaccagggatctgagcatggtccaggtgagtgaccccaggccagagcctaaggcatctgaagatgaggatgggtaggagccggggcagcgtgctggaataacaagtgtctttagttcaagaggctcagactctaggcaaatatccagaagccagggaggtcacaccaggggaaaaaattgtttagatcaaaatttcagaagcctgtgggaaattttgtcgcatccatatggtatacactgctcaagtctgttacctcaaacgcttaatcatttctttgtagtgaaaatattcaaatctgtttaaaatttccccttgatattctgcagtgctgggactggacccagatccccctggtgttagtcaagacgtcagcacatgagccatgcacacactcccttagattttgagatatgcaatacatggtcatgacctagccagtccctttctacacagcctctctgagcttcttagtctatgggataaaacagggcccagcccagaacagagctgaagagaatgattctacagggcttgatgtgggtggcaaactttgtggtacatgtgagaatcaaacaattagaggaaaattaaaaaaaaaagaaagatacatagaaagaaaggaagaaagaaaaggagagagaaagaatgaaaaaagagagagagaaaggaagaaaggaagagaggaagagaggaagaaaagaaggagagagagaggaggaagaaagaaagaaagaaagaaagaaagaaagaaagaaagaaagaaagaaagaaaggaagaaaggaaggaaggaagaaagaaggtaagagagagagagagagagagagagaagaaattcagatcaacctacatggtaaaaggtgacatctgtcggtctgagagacagggccccaagacccagaggcacagcatttgaacttgcagagcaatgcaaattacatgttttgggggttggtctagctaagaatagagaggaagaggggagggtcttgttagaggcagaatgaggaagtgagctgcctttctctgtgatccgattcttggaacggcaagatggaagataggtcagttgatttactctgaccttccaggggaagctgctttctgggaagtccatgggtggcagatttccctgggaccttgttttagggcattggtcttgtgttgggatggatttcctttaattcaagaccctttacatataaggtctggggttgccatttcctatctggcgacgactttctgctgggagcgagggagacattgttttgtgggttctcaagtctggagtgactctagaagaagtactgtctttacttcatcttggtgtggctgaccagggtaagacagtgatacagtccaggaggaacctctgtaaagagtttaaaagacagggtaaactgtccgtatgaggatgataaggaggaaaggggtaaggagccaggaggggcagcaaccgggagcccatccagaagaggcttgttgctggattctctgtgtctggtcttgagccagttttgatctgttagtgctcttgggaggtgggcttgaaaggtgtgcagctgttctgaaactgaggctctctgcttatatggagagattgactgatataaataagtccattcctgctattctcctttgtagtcctggaagaacgcccagagcgggcaggacgtgggataggtccatagctctgttttgctcttgttgatgtgggtgtagagatagggattggagctttgtggggggtaaggagaatggtggagacaaaaaccataagagcataggtccagtgcagctactgggccagcatatggagctgattgtcctgcaacgcccaaagggtcctgtctgacgacaggcaatgatggttaaaacgcttatctggtgtggtttcccctttgaagggcaatttgagctttagcagacattgccacagtgaggagtgtaccaggcagagggacacatgtcaatgaaaggctgcaggctgactgggagacataggcttattttaattaattagttcattttgagctattcaaaaaggtattggagttgaaggaacactggtgagctgtggcggggccgggagtcgggggaaggttggttctaggagcccacaggcatggttaggtttgaatgaggaggggtgacgaggatttgaaaggatttccctagactagggaaggcagttccttctccttgtccccagcaatactgagaaccggaagaggattcagatagctgagaggagaggccagtgaggtgggtagtatcaggagggccgtcgtaaggaannnnnnnnnnnnnnnnnnnngggggtgggggtggggaatgcttgactggttagtagtttgagactggtggagacacacccagaagagggacagagagaaaaaccttctaccaagtagagaggggttttgggagcctcagcaacactctgtctctcttcaaggcttggattttgatttttttaagtctttgaagggtctttccctccaaatttcgggtgggttggttggttttgttttgagacagggtacttgtgtgtagatctggttgtcctacaacttgctacatagacaggcacacctcaaacttgaatagaatcacctgcttccgcttttcaagtacagggattgaaggtgtgggtcagcctgaccagcaagggttggttagaacaaagttgaacaaggccaggatagctttggctcacaactgtgggattctgatctggccttgaactcatagcatagtccatcagcagggggctccactgagaaaaccccactagacctttgttttaaactgccagacttttgtctcaagaggaagaagctagccatcttggaagttcaccatctttattacctagtcacagtccctctccctgtctccctactgggaaatctgtctaactcctagtctctcgttcccctttctcagaggtcaccctacttgcttagtggcttggagacacaggctgcttatgagctggcgaaagaggtgatgtagaataggcagcatttagagcccctgcagaggaaggtccgtctaaggcaccatgatgacacctggcaaagatccagaacattaggcagctgagtgacagcagtgtgtattctttgaacacgtttgtgacagagcagctgtgacacacagcaagggagactgtggtgtagtatacttcttatcgagggtgtagttaaaatagttggatagttttgaccttattagaggacatgcataggtgaaagaacacgttagcatcagcgagactcctggtcctccttattaccattgcccactgtgtgatgtacacacatgcaggagaccatgttcaaggtcagaagttggtcattgggtctcctctgttacaacctcctcaaggaacgttaagaggcaaagttaatgaggagaatgtctcagcatcatgattaacgtaagttttgcttagcaaccgtgcagctagctagaccatgctcctgagccctgcagaaggatgaggaatctgtgcagtgagctgtttgttacatcagactccagtttgtataaagggtgaatgccaggaagtctgttaaagtcagcatctaactgacaacttacaagagaaacagaatcccatcaggtctcctttctctctctctctctctctctctctctctctctctctctctctctctctctctctctctctttctttttaaatacaattgtccagcaatatctcatggacactgtcctgaatagttcccccaaacctatcagtgtgagatacaaagtgtccagaacaggccagtcagtccatagagacataggacaggtgaatgtaattgggggccaggcgagagaagatggggagggcccattaatgggatgggaagtttttctctggagataaaaaatagcctcaaattggggagcgcaaatacttatgtaacttcatgagtatgcctaaaaaaaaaaaaaaaccactcaacattcactaaagtggtgaacgtggtggtttgcaggttacatcccagtttttaaaacaaagatattgacagccctccctgcccccaccatcctccatcccatcagcaaacaggggaattacggaacgtcttgtacaaaaggcacctggcgcccagaacaggctgagcttttgtaggattgttgtgcttttccagtgagaaaaccacacgtgataaaggaagagctcccgaataatagcctgtgacaaggtctggcgcatgcgcacaagggaactgaccctgaacagaaattcccctcagtttatacaggctcaggccctaagttacactttgaacaagtataccttgttctgcagagacagaagttccaaggcttggttgtttggacaaatggggagatttacggggtaaagcattgccatcattttccagagaaagagcagggctgcttttccaaggcagctgtaactggggtcaccctgctggcagatttttgctcttcctgagggatgagttaacgctgccagccagggttggcctctctagctagctgctttacttttgtgtaacagtgttttcgagagcatttattgataaatcctttaaaactttgttacttccatctttctccttcaagggagtggtccctcacttcactagcacaaagtatgccttagcacctgcattgcaagacccacaagataagtctgggaggagaaatgtcaggagcagagaactttgaactgagagacaaggtcttagtccttaattaaagcccgaggttcaagtcgcaagctgtaaagtgaactatggccccacttcccaggaccattccacatcatgcctgggtccagacttctctcagtcatctccctggttcctatttcaaagtctaagctcacccaggggacctgatgcttggtggagtcaccctcccgggacacaagcatgcatacatgcatgcatgcatccatccatccctgggtttgtctgcctccaaagcatgtggagaaacagaatgggccagcgccagaggtgtccagctttaaggtcttggggaaaggtgtcatcagtctggggccaatacctcagaaagcatagcagtgtcttggggctagaaaaggaatcccacgtcatcagtgaggcggacctggggatggctgtgtggattacttgggcctaatgaggtgaaaagaaagcctatggtaaggaggccacttagtcctggaatggaggagggtacatgtagctacaggcctaaataaggcaccgttccagaagggggcgctggggagtaggtgccctccttgaacttgcttatcctgaaacacccacaggattgaggctaagtagcgaccagctgactctctactgcacactgggggtctgcctctgcgccatcttctgctgtttcttggtggccttggcctccttcctcaggcgtagaggagagccactacccagccagcctgccgggccacgtgggtcacaagcaaactctccccacgcccaccgtaagtatggaaagccaggcttccttccctgacaatcaccagcagtactctcccctccgctatccaccactacccctgcatccagggtggacacactctgagcccaccggcgtggcctggggcacatcccatagcaccttaatgaaatcaggttcaaacagtggggccagaagaaagggtgggtgtcaggttcttgcttcagctttgagaggagatcgggaagcgggttaccccggggcgagggctggatggtttcggggtgcggggagaagtgagcccggccgtgaaaacctgttcaggggcgctcagaagggcaagtcctggggtggctgtagaagcgctgggctcctggaccaggcagtcctcggtgtccacagcgccctcctttgtcactgcaggccccgtgacagaggcttgcgacgaggtgaccgcgtcaccccagcctgtggaaacgtgtagcttctgcttcccggagcgcagttctcccactcaggagagcgcgccgcgttcgctcgggatacacggcttcgcgggcactgccgccccgcagccctgtatgcgtgcaacagtaggcggcctgggtgtcctgcgcgcatccactggggacgctcgtccggcaacttgacagcccgaaaaataaaaaagacaatttagaggatggagtgacagagggggaaagggatggagaagagacagatgaagacacgataaaggaagcccggctgcacccacgcagagcaacaaagcaaccacctgcagcgcccacgttcccagcaccgcctgtgcctgccgctgtgtcctatactttccagagcagtcaacctgtgccttttttctttagtcgagaaagatggagaatgaccggcacctagcattacccttacaattcttacaaacaagtggtctttcctatggccttaggcagatagctgagtgcagtgtggatgtatttgtgatttaagtaacttgtatgtgtatgtgcagattcggggttatgtcatatgtgcatgtatacgtgagttgtgtgtctgtatgagttgtgtgtatatgtgcgcctataaatatgtgtgtgaattctgtgcatgcagatgtgtgtgtacatatgtgtctggctgatgtggtatagccagaaagatgagggcccttctaggtgaaggccaaacatctaaaaaccatctaggtgatgggtgttaccttgacctcagcaagagtctgttcaattgcatcactttttatgggcacctgtgcttatctcttaaaacttccaggtgcatgaaaatactctcagaagcatttcccagcaagctgaagggtgagacggtacacttcacccttgttacccaggcaggcttctgaaccccaaaggccacacaacaggtgcccctgttctcaccattcatcgctatcaggctgcatagggaggagactgtctgcacagaataactctgacaacagatctaataacacaaagtggctgtccacagagtttggaagtctgcagtcaaggtgtctgcagaattggctcttcctgaggccacacatgcaagatctgtccttggcttctccttaacccactggtagtccctctccatttttctgtctcgggatcattcttatatttcatgttatgatctgcctaatagcttcattttgattttcctgtaaagagtccatctccaaagaaggccacatttgaagcagtaaggcttagggattttactataagttttggaggacaagttcaacccacaatggaggccttgtgagaccatcactgtttttatccttgttgaaaagttgccacctagcaagttcttgtccaagatgtgttgagctagcctatgttgttcccacgatctacttcctacaacaggactgatagaaaggccctagctcctgctacagacatgcgctggttgtgggctgaggaataacaccagtgcatgcgcagacaggctcctgtgctcagcctgtctgggagacgaacctatttctagtctttaagatctgtggctttaaaagtctgctcactagaacccaaggggctgaaaatgcaagacgattctggaaccagggtagaagagaacagaggcatcaagaacatagggtgcagagaccagcctcggcttcaaagaatcgtgagaatttttggtcagcttttcagcaggtcatttgtgtaaattttgtcctttactttctgtttgtaaagaatgagctcttttgccaatttcatctgttgtgttgggtcagcctggagaatatagcctggctccatttgcaatgttcccttaaattgtttttattagtatatattagttgaataaaactgttttgctgcagcttttacaaacttgcatacagtatgctttggtggtccttcctccctgactccataactctcttccacattcttccactggtctcccctacacaattccttacccttataagttcatgtctttaaaaaaaaaaaaaccaaaatctagattttgtaaatgtgagaaaagccggtattcgtctttcttaattttattttcctaaacgcccttacgtattgcaactatttccccaacgataaagatctattcatgtactactgtctgtttcctgaatttctcacctctatttctggaccaccctccctcagtctctttgatgattcctttctcctcaccacacatcaacattcctgcaaaggaccaggggaagccggtgtgatgtgttcaccttgtgatattcctatggctgctcagaaacttctcctctataatgcgtaacctggatcatacctgccaccaagcatatgctgcccagctaatgccttcccttgataccagaacaagtggcccttcccagcagggcctgtaggatccctctgcctttctactgaaatatgagtcttcaaacacaataaccacactgaatcatgtaacatcactccagaccttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtttggttcccagcacctacatggtggctcacaatcaaccatagcaccaatcccaagggctctttcattcctgagaacatcaagcacacaacatgggcaaacatccatacttgtttttgttggtttgctttaaaggaaatagcaacttttaaagacacttttaaaccccctgagcagggagaatcacagcacagaacttgagattcccaagcaaagcaaacagacatcacaaagcaagcagacactctcttatcagaaacagcttcttactacctgggactcagtgggactggaggcatgccagatgccagctgagacaagccaatcatcccacagtcaaacaagtattctgagcactgagctctaaggtgccacctaaagcagccaccctccatctcagacccaggcctagacattagctctggtccgtccagaagacagaagaggctgcccaagcaggtggcgtcctttccttattaacactgctctcctgaagtgaccagatgcccacagagggaaaagctgtctgtttccagatgggtctccatgaccggggatgctgctgggaatgactggctgcagacccacctctcccactgtgctgctggtagaatctgtgactggagttctcaagattgggtatattgagattccaaagataatcaaagcaagcagcattatgtagcacctgcctggcagaggatggcagccagacttacacagaactgctaaaaggaaggggtggggatgtctatggcagacgttatactgttagccagaagccattacataatgcataatacctcacaaaccagtagagcatatgggtctgaggtgattatgaaacttgctcagcattgggcttacaaactaagtcacaggcttgttattccccgtcctagaaaattaatttagtgggctttaaaaatatctatttttatgtttattggtgttttgcctgcgtgtatgtcagtagagggtaccaagattccctgcaactggagctgttgtgagctgtcatgtgggtgctgggaacggaactgccggtcctctgaaagagtagccagtgctttttaaccaaggagccatctctccagccacacctcctttggggggttgggggacaaggctatgttaatgcacttgctgtccctctgagctacacccacaacactgagtggttcttactccgaaggtcttagatctcaagggtggagggagtcctaatctgaggacagtgccacggtgggcaagcggtgggttccatgggggcatagttctctggactgtttccatataaaagtatccaaaacaggcaggccagaatttcagatttcagtggagctgggacagaggcgtcccagcatctgccgcacacctccgcttgggtgtgcagccgtgtacttccccagaggacctggctacttagtgttgctacctggcttatgctcctgcccacagaagaggattctttttacttttgtcttttgagccaaggtcttgctgagtaaccctggctgactggaacttgctatgcagaccagagagatctgcctgcgtctgcagagcagggattaatgtgtggcctccatacccacccgcaggaaggaggcaaagttgatagaccgcagaacaggtgttgtgaatgcatctctacccacgggaacccatagctagcccaccctaccaccttgcctgccactccccacattttggctgtctgtgttagtaatgaggcagagagtcaggtttcagaataaaatgcagctttattatgatataggaaagactaaaagccattagggaggagtcaaatagcccctcaaaatgacaagggaaagaaaagtgacataaatgtcttggtaataaaactcctaaccacagtacaatcattggattttttttccctcacgattttttatttcaaagctataataaatgaaacaaaccacttgtcaaaaagaacaatgattttacacaaggaaaagcatacacactgagccgaatacaacagcactcaggttcacatggtgtaggacactcaggtagtgcccagcttgaggggacttctggggtaaagagaggaactgcagaatccatcccaatgccctactctctcactgaggccatttgaagaggactttagtctcctgtcaagctggcgccagcagtgtatggaagagaggggtaggcaatgcagccctgtggtgagatgcacttctgtgaccatctgagcacatatactaggtggttctaggatgaggaacccttttcctgccttgctatccagaggggcaactgaaagaaccaagcccattgctcaaataaactgttccttagccatccacacatgcctgtccagtggagacagcacgctgaggaccccaggacagagagggagggccagatgcatgtgcggcagccatagagttggcagaccttgctacaggtacagagtgaagtgtttagaatgttaaaaccatggtgaaggagaatgctttcggatataaaaggttaaagtcacattgacagaaaacagctgctgtcctccttagtgccccaaatataggaagaaatgggtcgtgttctgtggggacagaggaggcaggcctggccagcacacctgctcatctcccctgttctggatgccccattcactggagtgtcaaggaggcagaccttcaggaagcttggagctctggttcccgtggcaactgcagtgaagtttttcatgtggacttgttcacaaatacaacatgctgaccctggggcatctccacagtagagtcccacaaacatggtccatgtctgagaatctaggctcagctgtactcaaaagaggatttttctaaaacatgcttcaagtctgttctttacttaaatgcagaaatagaaacacactagagaagaacagggcaactgttaccacgtgacaaagtttctgctgcccctgacctcgagtgattttcacaccgattgagcagcggccgcttagttttgccacagctatgtcattccatcgcaattcgctagctaaggagctgggctgggccctgtactgctcttttatagcctgtaagtgaaaaaacaaaatcttattttcaaatagtaaaaaaaaaaaaaaaaaaagtatctgtacacataattatatgtaatttaaatcacagccgtacttgttatgcaaacacgatgcacgtgttacctgctatgggtctacggctcagagcctggctcttaggaaatagttgcctgttctgatgggcaactcctgggtgggtgccaacaggctcctgggtaagcaccactggaaaggcagtggtatgaggagaaacaccaagaccctagattccagttgctcagaagtggacagcctaggcttgtccagagatacatgcaaaatatcttacaataaacttcatgaatgaccctgccaggagaactggtaatggagccttcctattctggctgtaactgaaactatagtgaacacagaatggaggcaagcgggtgacactatgcaatgcagtctccaactggacctcagcttcaaatctcacacagtcactaaacctccctgggcaggcaaaaagaccaagaagaaacatgggaggattgggtcaatggagccaccaaggaatctactgcaaagatcaagataccagggactctgatatctgcctggccaccagccgtttgagaaggaaggcagggcacagggcaaggaaacaacactgatcaaaagagcaagacacgctctcagaggggagagaatcatctagaattccgtataacttgataatcattcacttcactactatcacgtttaggaaactcaccaccgtggaaaaagagcaaatggggtagaggtaagacgacacctatttctagaaaacaaagggaacgtctgagccgatgtttccacatgcagttgatgctaagttatctgtaggacagatgtatttgtagcctgtgggtggcctcaacctgggcctggggctatcttacaattttagaaagaagagacataccctctgcccttcatgccagagggctgctgctgcaagcactctgccctctggcatcatctctgcccactctacagctttgacgggctcattttcaaggaggcaggtgggatggcagggtgaagcagcaggcagagtggttggtctgctctgaagacatccatcccctgcctacaaggctcaaaggacaggtgctggggaggcagctcctttccaccaagggcgcactccactctgctcatcccacctgacacatctcctagtgcaggccatgagggaggcttgcctgcataggaggaatgccatggtgttctgatttggggggagcagggatcatgtcgggaagtttgccaacttgctctctctctctttctctctctctctctttctctggccagcaaggcaggaggctactcgtattccaggaactgtttgtgatagaagagtaggtacctgtggaagcaaagggaaagtgggtttcgttaagaatggctcacattctgaaatactgtagtacctcaagaaagatactacgtgactcccatcacccaacctgaccaccatgcttactagggagtgactgactgtggccctggtgacttcctatagtcattatcactactgttcacagtggcactaccctcatgtagggtccacgtctcctcaaccccaacccctgcccagtagtgtactcttctctctgactcctctcctgggtaccccagagcctcgcgtgcaccgtccacatctgtggcaggtggtctacatggtccctggggctgggaatcctaaggaagccccgggcaaaaaatggagcacaagtaacaaaagcagcagaggcgctgatccagaagcactgcacagcaagctcaggacaaatgctgaccacggcagcctctgatttagaggcgtaactgttcagcaacactcccaccctgtaatcatgacctacaggcaacttctgacccaaagaaccaccgtcccttcagcaacaaatcaaactacacgaaggtgaatatgcacactatggcagatgcagccaagccactggctttggtcagacaggagggacagacaaactccagcacggggctcctccagccctgcccccagacgtacccttcactgtccagtacatctttgatgctggccttggtgataatggcgtcatcacacttgaaccactggtctttgtgctgccggatgaagctggtgtagtggccactctccaaggtcccttgatggttaacgacagcaaacagggagtatctggtatgcaaggagaggacagctgaattatggtctgttgaactggcagaacacctccaaattaaagcagaatacgtaggctgcagagctgggagagccaagtctgcactattcagctctgggccagtaaagacatctcctagaaccacaccaagtgcaaatggtggcagcagtggcaaccaccgtggaagtaactactttagtcagtgccatctgcctgttctaccaacagcaagaggaacggggccagaaggagcaggtttgttaggctaagctcctatgtagaccctcatcaggcctctacagtggggttgccaccaggagggagactattcagagcggaaggactgagtgtgcctttccctacaagctatgggcagagacctgcatgaccacaatgccagctcaccctgccccaggccctgcaaccccacgtacttgttgtcattgttgagactgtccaggggctgctggtattgcccattcatcctgctctctttgctgcaagaacagaaacaaactgtaattaccacctccccacagacacaggctctgatgacagcattaactgatatgaaccagtttcctttggcagactgcccccatgtggtgatgagattctagcttgggctggagcttcctggcctcctagtgttggtgctggtacacctccccacacccccatccccatggaccccgaagtcactggcttgtgaagagttttgcttgtaacacaccaaatgcaaggcagtgtagggttagccccacactatacccttaaaagagcataagggacatcatgaagtaactcacgagcagtacttactaacagaacttactagcagtaggttgggtggaatgggaggagggactgaacaggaaataccaagttttaaactagtttggtgtgtttacctacagccaaaataagcagaagacaacaagtcccatgagaccttgctatcagcaacaatgtcactccatctctagatatgtgactaccccatctttcaaagagattaactctgatgatctatatgatatatttcagccagtgacctatgaacccagtaccacagctacaaggaagggcatcaatggctaataatatgaagcctgctcaggtcagtatggtgggctgaggtgtggcttctgaagtggactgcctgcatcttgacccccaaaacagcaaatgtgacccatttagaaaatctgtgcagacaggatagagggggttggttgacacgaggccgtctagacggccctatccttaaccactaatacctaggaaacagatcaatgactgagacacagatgcaggaagggtcttggcccagagcctcaaggagctagatgagtctcagagggagccctgtcaggatccttctcaccaagttccttatttctggcttctattattgtgagaaaataaatttctattgttttaagccactacacttctagctgccagccacagacagcaaaccaaagacattagcaagcactgtagtttttagagggttaaatttgatgtagtctatgagatataggatttgatctcaaggaagataatcaaccctgtttatctgtatttcaaaatcggtcaccatcaaccaaaaatgtcacatgtggtatgccttgagtggccaagtctgaaagttgataaatgatgagggatgttaagagtacaaatgggtagcccacagtaagcttaggtaagttctggggtggcggtgaggcctggatagctgtcattaccatgtctaaaggctggcactgggtaagcacccactagacaacttgccttcccactcagacacaggagcaccaaccctttctacctggaggccatgaagggcgtcatgtccagttccaggggaaaagacacatatgtggtgatcttccgccgaagtttggctgagtgttcaaatcgctgcagagataagggagtgggggacagtgagcagactgagcaatagccaggcgaccaagcctggaggcccagcaaacagcttctactttcctgactggttttcctgactcacaagcctactcaggctggcgcacactgcaggaccctcctgggccccccaatgctgtgattacagctacataccacccagcagaaactaatctttcacagttttaaagaacaggaaacagaccatatgtacctttaaagactcaaacactagccctggctactctaccagaggaccttgctttgattcccagcacacatcctggttcatgatatgccagtcctcaaggatctga

SEQ ID NO: 1646 - DNA, 750 bp, Mus musculus
atggctatggcattctgccccaaagatcagtactgggactcctcaaggaaatcctgtgtctcctgtgcactgacctgcagccagaggagccagcgcacctgtacagacttctgcaaattcatcaattgccgaaaagagcaaggcaggtactacgaccatctcctgggggcctgcgtcagctgtgactccacctgcacacagcaccctcagcagtgtgcccacttctgtgagaaaaggcccagaagccaggcgaacctccagcccgagctcgggagaccacaggccggggaggtggaagtcaggtcagacaactcaggaaggcaccagggatctgagcatggtccaggattgaggctaagtagcgaccagctgactctctactgcacactgggggtctgcctctgcgccatcttctgctgtttcttggtggccttggcctccttcctcaggcgtagaggagagccactacccagccagcctgccgggccacgtgggtcacaagcaaactctccccacgcccaccgccccgtgacagaggcttgcgacgaggtgaccgcgtcaccccagcctgtggaaacgtgtagcttctgcttcccggagcgcagttctcccactcaggagagcgcgccgcgttcgctcgggatacacggcttcgcgggcactgccgccccgcagccctgtatgcgtgcaacagtaggcggcctgggtgtcctgcgcgcatccactggggacgctcgtccggcaacttga

SEQ ID NO: 1647 - protein, 249 aa, Mus musculus
MAMAFCPKDQYWDSSRKSCVSCALTCSQRSQRTCTDFCKFINCRKEQGRYYDHLLGACVSCDSTCTQHPQQCAHFCEKRPRSQANLQPELGRPQAGEVEVRSDNSGRHQGSEHGPGLRLSSDQLTLYCTLGVCLCAIFCCFLVALASFLRRRGEPLPSQPAGPRGSQANSPHAHRPVTEACDEVTASPQPVETCSFCFPERSSPTQESAPRSLGIHGFAGTAAPQPCMRATVGGLGVLRASTGDARPAT

SEQ ID NO: 1648 - DNA, 53021 bp, Homo sapiens
cactcctttgcctacttctttgttatgccctcagcagctccacctgtgagctccaccagtgcttgagctttgacttaagccctgctgcatccccgcacccctgcacgttgtaggtgcttaataaatgtttatggactgagtgagtggacattctgtttctgggcctgtcttctgctctgagagggtagggagtccctgggcagaaagaagaacaacagggtcagcgggaagttgggctgccattcagggcctgaagaaagttggtaacagcctcagctgttcattgcccactagaaagagcctgggctttggggtcaggtatttgtgggagcacatctcagctccccacatcccagactggatgcaaaaagctcagtctctctgggctttgactctctcgtctgtgagaagggggtcgtggcagcatttgccttattctgaggatggagtgatttaaaaatcaagttcatatctggcacatagtagatgttcagctaactgtggccacttattgtcagcctaacacctgccgtgcacacacatgcatcatcgtcgtcaccttcaccatgagccgtgcggccttttccagctggggctccccactgctcagagataaaggtttccagaggcgtcagcatgacgctcagccccggcctctttttctctcgttcttgcaccatctgtctgttgagtgcctgccacatgccaggtgcagcctcagatgccggaggcatagtcactttcggatgagggaagcagatagcccaccagcgagcacagggacgtgccaggtcagtccaagcaggagcaagtgctcaggaaataaaccagatgggagtggtagggagtggccagggtggggactctggccagggtatctaggaagtcctctttgaggaggtgctgttggaaccaggactcagtccttcagagagccacaggctgagcactcctggcagggcagcagcaggggcaaggcggccgagcggagaatgggcctggcttgtctgaagaccaagacggctgtggctgcagcggagttaagcgggagaggtgggagaggagagcaggaaggcaggggccaggcagcctggggcctcgtccagactctcagcttctgtacttctccctggggacatctgtgagtcgctgagctgtggacagggagtgctcactgagtcacccagggcctcacggcaggacctggccacatcttctcacgaaggacccggttcattgattctccttcctcaaataggtcccctccacccagcagaacccaaaggaatcaaaagcttgggggttttgtgcatttgttttaagattccaactttcttgtccatttacctttttattttttatttttttgagacagatttcgctcttgtcgcccaggctggagtgcaacggtatgatctcatgtcacggcaacctccgcctcccaggttcaagcaattctcccgcctcagcctcccgagtagctgggactacaggtgcctgccaccaagctcagctaatttttgtatctttagtagagacggggtttcactatgctggccaggctcgtctcgaactcctgacctcaagtgatccgcgcgcctcggcctcccaaagtgctgggattacaggcgtgagccaccacgtctggccttcttgtccgtttatttattcattcaacaaatattcatgaaatgtatgttgtaagctgaatactttgccaggctctgaggaccagtcaggcactttgatgccttcaagcagcctaggacctagaggtttcaatgcctctgctttcctatttataaatgggcagactggacctgaagtcctgaaggctcacccgcctggaagccacctctcctctggagttctgatgacgctgcagaagcctgtacgtatctctgcccaataccacatgtacaacagaggactttaactaaaacgagtgagagagagagattcctttttcccaacttaggatctaaaagtttcttgaacgttcagttctgtggctccattgcccacccagatcacccaccctggctacaaccaatccaaaaacttgaacagattaagagtttaccaacccacccttcctttctgacctggagtgagaaagaagcacagttgtccctcagtatccacaggcgatctggtccaggtccttaagaataccgaaatatgcagatgctcaagtctctgatataaaatgtgtagtatttgcatataagctatgcacatcctcccatagagtttaaataatctctagattacttataacacctaatacaatgtaaatgctatataaatggttatactatattgttttcatttgcattattttctattttttatctattttttttttttttgagatggagtcttgctctgtcacccaggctggggtgcaatgacgtaatctctgctcactgcaacctctgcctcctgggttcaagcagttctcgtgactcagcctcccaagtagctgagattataggcgtctgccaccacatctggctaatttttgtatttttagtagagaaagggtttcaccatgttgaccaggctggtcttgaactcctgacctcaagcagtccacccgcctcagcctcccaaagtgctgagtttacaggcatgagccactgtgcctggccattatttctattttctacttgtggttagtggttagttgaatctgtggaggcagaaactgcagctatgaagggccggctgtactataactgcctgctctgcttgtcttctacccagaaacctgggcaaatgggctaggagctatttgcaaggctgtaatttttggttaacgaacaacttctctgctcatagccatgggaaccagggaaggagacaagaaaaccagaaccaatcttcttctttcagtgtgaaaccatcttttattcttgctgggaactatctgggcatctgggaggagtgtgaaggagcaatactatacagagggaagggtttgggctctggaagcagatcgcttaccagctctatgaccttaggcaagtcactgttccactctgaccctctgtctccttttcagcaaaatggaaataataaatctattcctaggcctggcatggtggctcacgaatgtaatcccagcactttgggaggccgagctgggaggatcacttgagcacaggagttcgaaattagcctcagcaacaattgagactgtgtctttactaaaaaataatttaaaagttaggcaggcatggtggttcgcacctgtcatcccagctactcagaaggctgaggtgggaggattgtttgagcccaggaggttgaggctgcagtgagctgtgattgtgccagtgctctccagcctgggtggcagagtgagaccctatctcaaaataaacacataagtaaatataaataaatttctgagaggatcaagtaaagtggttaaagtaataaagcctggctcatagaaagccgggtgataagtactaggcgacaagcaatattattcatacaaatataaggacaatgacaattgagaataatttcattccctttgtgatagccacctgattgttagtgcctaggaggcactctctctagaggagagaccgagcattcactagcagctcagatccacagagcagagcataccccatgtgtctcatggaaacaccccttcacagtggccgagaaacatctgtgcactgccttgctagaaatcgggaaatacaaattaaagcaacaaataccatttctcacctattagtttggcaaaaatgtaatagtctgatactatcccatgtggatgaagatatgagggaggagccagccacatgtggctgctggtgggagagaatattaattagtgtggtcatttgggcaatatctagtgaagctggccacaactcagagagatgctcatacatctgcacaaaggcacgcacaggtctgcccactgtagcgtggctcctaacagcgaggaatcaaaaacagtccacgtgttcttcagtagaggaggaacggaaaagaatgtgtggaatcccatagagcagctaaacgggaatgagctcattatatgagcatccatatgagctgatctcaaaggtgttgggtgagaaaagaaaggggcataatgatagatttagaatgctatttatataaaatgtttaaaaataacacgcaaaataatgctatatactgtatttttcatagctaaaacattctgtactgtactcataaaagtataaaaaggggcctggaagatagagccacatttatgatggtgagtgtagggtaggaagtagaataggggggagttgggggatttcggagatttcactgtcatgttttccttcttataagaaaaacttgaaggtgaatatgccaaaattttaacacaaattctcagtggtgaaaatatggatgttggttatatttttcatggttattttctgtatttttttttcaaaggggaaaataacaagaaagctctatttacagaaaaacaccagctaaaaaatgtagaaggaatctaaaaggtatcgaaagttaccaccttgcaagtggaatattggttttggccaaagatgctaaaatgatcaacagaagggtcgtcctttctgttgggaaccaggatgctcacaaggcattgcccacaagggacactaattgcaaaagggacagtgtgcctccacaggggaacagctggtgtcaccatcttaacaagggatctgacagcatcaccgtggggggagaaagccaacatcatgcacctccaggagctctcagaggatggaggaacacgtgaaccaacaccaggaggatacagcccgagagatcagccatgggacatttcacaagaccacggccaagtctcttcacaaagtcaacgtcaaacacaccaaacaaaggaaaaaaagataaaagagaagaaaaagagcaaaagggaagggactgctctagccaaaaaaggactacacagatacaatgaccggatgtaatatgtgacccccagagggataccgattcaaaagatgcagccatggaaaatgtcttataagcaccagggccatttaaatgtggactagatgtcagatggtcttattgaactatgattgactttcttagatgtgatcatgacagtctatgtgagagaatgtccattttcttaggaggtgcctgtggacacacttaggactgcagtgtcgggatgtctgcaaattgccttcagggtctcagccagaaggcaggcaggaagagacagagatggatggagccatgcagacaccaaggtgaagagctactgaatcttggtggagggtccctgagtcttcattataattttaactttcttgaagttttgaagttttcataataaaaagttaggagggaaacattttaaagtagagaaactagatcttcccacagaacactggggacccttattattattattttaaaccctgctctttgctttttcaaagtgagttttgctaaaataatggtatctagcatttctgagaaattagcacaaatgtacagctacattagcaacaggaaattcagcacatctgagtcatctatgtaaatggcaataatgaaaatgagggctttcgctgcatgtctaagaaatgtcctcttttggagactcttccttttgttttacacccagaactgtctcagaggaggttcaacagcagggcctcaagggaccaggagtaggtggcagacatgagggagctcaaagagaccacagcacctgcagggatgtgggtctttagggccaaaataccacggacatgctagtgcagagtggaaccatctccctgggaaatattgatcaacaggccagtgttgcctttcttcaaacaatttaacttaaggagctcatgcccctcaaggtgacaaagacggtaaaatgtgaattaaatgagcagatgttacgtgtttagaacagtgccctaagttttccctgttgttactcccaatgagcactgtaggagttcatttcaaaagctaagaactgtccggcaggctatactaaatggaaaaggtggcatgctaaacagcaaccttgatctgtataagccagcagttgtgttaaaaaaaaaaaaaaaggtatggagggggagggagaggtgaaatatatcctctagcgacacgcacatgctcagaaatgcctaggctttgctgggaggctgtatgaacaaggtccactaagggttgccgcctttgagtagggacatcatgggcctaggataaccagacaggagagaaatttacttccgccatattcttttactgcttgaatttttttctttactatgtgtgcattttaactcgttaattatacatatataaatgaaccaggtccaaaaccttaaggtatatgagttatctctactctgggttctaaatctcttctgtcaccttggctgtggagcttaaaattagaatcccgcatcctcttgggagacagctcaaaaaaaggctggtctcagaatgagctttagaaacctccagcacctgttcaatcttctgggggagccagtgcagagggggaatctatttttgtgtttcatgaaacgatcccatttgtatgtttccatttatacaaagtttggggaacaagcaaaatgaatctgtggtggcaggagtcagaattgtgactctcttggggatggagtggggtgtgctggctggaaggggcagtgagggaccttctgggggctgtgcatgctctgagttgtgatctgggttgtggttgcctgggtgtgcatgtatgagaacacttactgaacttcccattttaaaagggtgcatttcactgtctgtaaattacaccatctaattaaagaaaatagaaagcaaattaaatccattctctgtaaactgcatttgagcaaaagcattaacaagctgtgattggcagtaagacattagggaaccctgccattcaattctcagccactccccaaatcaggctggattctgtttgtttttcatttcaggcataacaggtattggctttaaaactccaggacaatgtgtgtggctgcagagagcagcattcagtcccatggaagcacagtctggaagcacagtctgctcactggacaaagctgaacttgctgtctttccttcttctccttccttctcctctttctccttctccttcttcttcctcctcctcctttttttgcgacaggttctcattctgtagcccaggctggagtgcagtggtgtgatcatagctcactgtagccttgaactcctgagctccagcccagtgttgcaatcctccagcctcccaagttgctaggactacgggtgcacaccaccacacccagctaattaaaaaaaaaattaggctgggtgcagtggctaacgcctgtaatcccagcactttgggaggccaagacgggtagatcacttgaggtcaggagttcgagaccagcctggacaacatggtgaaaccctgtctccaataaaaatacaaaaattagccgggagtggtggctcactcctctagtcccagctactcaggaggctgaggcacgagaatcgcttgaacccaggaggtggaggttgtagtgagctgagatcacgccaccacactccagcctgggcaacagagtgagactcggtctcaaaaaaaaaaaaaattatagagacagggtcgctatgttgcccaggctagagctgagctttctaaccatcagagctaccccccagggagccagctgctccgtgaggtggtgagagccctgaccctgggggtatgcaaacaggaggtgaggggggactcagtgagggcatcctgtagtgactttgggcttgcccatttcaacaggcagaaagttcctggcaatgggatctctttcttacctctctcttagaaatccactgccagagcccagctatggttttgtcactgttcattgacacaagtaattaaatgtaaacaagtaattaaatgtaaaacccctacaaatgtaaaagccctaaacgtaaaatgtttagccctacaaatagggctaaagtcccctttgacggtcacccccagtcctggttccctcttgccccacccggcgagagccagtttcgtcatgcatgtctttgcagacttcttatgcttcacagtcatgtgtgcgtgatcacagacaacacagcgctgtactgtgtgtgtgtgtgtgcatgttgtttgcttttggttttgttttactaaaaggcatcatgctgtaaggctcatgctataagctacttttatttactcagcgtctgtcctgaaagcttcgagatttctcattcttttaactgtgcaatagactcctggctctggcctgtgcaccctgcttattcaggcatcctctgctgcatggacatttacattgtttcccgtttctcgctgtcatgaggaggctcatggaggaggagaatttctggggggtgggttaggtgtgtgttgtgcatttaactgaccctggctggttactctccagaacgctgctgccagctccctccctccagtgggccctgagttcatgtttctgtagatcaaccccctgcccttgatgttaccaactttaaaactttgcaacctgagggctgaaagttagtttttcattgttcagttgtttttctgatttttgggagactggacattttcctgtgtttgctgaccgtctgcatctcctctcctgctctgtgcaccatcaccctgctccagctgcttcctgcagcctccctccttcctctccacctctccatgtcctcctcgtccttcagtttcttcctaagggcccatgggctttctttggcttttacgttcctctcactccgcctttggctgttgctgggcctcccatcccctgggaggtttcagacgatggggaagacacaggagtgcagtcgccatgcagtgcaatacgggctgtaatgttcctcctccacggcctttattgaggacttactgtgtgccaagaacctgctctaagaatgtaactgtgctccctccctcatttcatgctcataaccgcctgtgaggcgggcaatgttctcatcctttttttttttttttttgagatggcatctctgttgcccaggctggagtgcaatggcacgatctcggctcactacaacctctgactcccaggttcattctcctgccacagcctcccaaatagatgggactacaggcacgcgccaccacacccggctaattttttgtatttttttttagtagagatggggtttcaccgtgttgcccaggatggtctcgaactcctgagctcagacaatccacctgccttggcctcccaaagtgctaggattacaggcgtgagccaccatgcccgacctcatccttgttttacacagagaacatggaggcacagaagagttccataaattgccaccaaggccttctgctagtatgcagcagagtcaagattcaaacgcaggctgtccggtcctggggttcagcctctccagtgctctgctaggtgttggagagggtcaaggagatacagagaatgagtaccacctgacaggctgggacagtcagggatggcttcctggaggaggtgacacctcaatggagccttgaaggaagagcaggaggagccgaccaggcaatgaatagaataagtatacccaggaagagggaaaggcctgagtgatgctgggagggtggagagctggcctggcttggggtgtgtgccggcgggcaggagatgaggaccaagggatggccaaggccagatctagaagagcctgggccatcccatagtcaatacctcatcgcaaggcccggcaggccttccactgctctgtgtgtaccccatgggacgccaggagcctgggccgcagccacccacctgggctcctgagacccaatgcacaggcatgggggcgggagtgggtgtggctgatttacatccaacaggttgaggggaaaacccaggaagtgcagcccaagcactaatcaaatctaagactagtaataagcatcctgagtaatgagtggcctgggccggagcaggcgaggtggccggagccgtgtggaccaggaggagcgctgtgagtagccgggcaggagggcaggagggcaggtgggaggtgtgaggagggttgggcctgagtgccgtgggggttgcaaggtccagcaggtgcaaagcccacagcagatccacacactggggcagtcccagcctccccaagctcctgcacatggagagccccgagtctggatgcctctgggatgtggggcttgccttccgtgacagaagccactgaggttgcagggttggccacaccggcaggaattccctttgtcaccatggcccccgcacagcccccattttcccccttacatgcccgctggaccattttaatgctaatctcaaataccagattgtttgagttgtggagaccacaggatttattccttaagaacacaaaccctaaaaacaaaacaaaaaactaagcatcataccttcacccctgctgaaacaacaattcctgaacatcatcacatagcccgccagggttcaaactgtaccaactgtctcaccaatgtctttctcagttgacttgttcaaatcagcctgtcccacattagacttttggctatgttttaatctataacagtttccacccattttttctgttatatatttatatttatatttatcctatagctttctttttttttgttttgttgttttgtttttttgtttttgtttttgttttttgagacagagtcttgctctgtcacccaggttggagtgcaatggcatgatctcggctttctgcaacctccgcctcccgggttcaagccattctcctgcctcagcctcccgagtggctgagattataggtgcccaccaccacgcccggctaattttttgtatttttagtagagataggctttcgccacgttggccaggctgatctcaaactcctgacctcaggtgatccacctgcctcagcctcccaaagtattgggattacaggcatgagccacggcacgcggcccgtatagcattttcatcagggtgggtttctaaggttttatgaaagggccccaggtcctttagtgcagacagaacccatggccagatggacccggggcacagcctagattcacagcctctgcctgctgctctgtcccacacctcaggcagggagcaaatttgttcttcagtccttttttgtgtccagccaccaagtccccagaatctacacagccaggggctcaaatatgtaaagtttctgagagacttggacaaggcagtgaccagaggctgccttaacacaggatgaaattgcccagtgctctgggaccacgagtcaggacccagctagaactgtgacctggcagtggcagaagctgtctggtgctgccgaatcagccctggcccggttgtccactggcccactctgggaccttggctgagccgcttcccctcagtgtaaaatgaagaagactgtctttcctaccagacatccctcaaacacacaaaagtgctttgatgaaactaccagaccccctcttggggagtcatgaggaaaggctctgagaagccctgcggttaaaaaactgccttgactttctttaacccagtgtttttcaaactaatccgaccacagagctctttcttggtgcagcacctgttaaccggccaagcccgtgaggaggcacaagcagagggctctgagaatcaccctccttggctgctctctggtctcggggtgcaggagagagtctccatcctgcatccaaatttgtggcggcccagagtctgagcccagcccacacagctagtgtcagagaggtgttccctttcttccctttccatcaacgaagcttctctctcaagcttctattctgcctggctggtgtcagtcatggggttttcctgccctcctttggcacttgatgatggttctgggattttatgtaggtccacatggtggtagaggagggggcggggacaggccctctggtcagcttggcatctgctgtctggtcagtcaggcactgtctctctgtcaggtccagtggcttttggtggctttggtccaggcaatgaatgggtcttggaacctctccaaggctgcccttgtcacatagaacctcctgcccaccttccactcaaccaacccttcacggtgatatgcggcgggtggtggctttctccctctttgctccccaacccaaaagtggggagaatcgggtctgcctttaattttgtttgatcctttgattttagatttgcctttgaatagatagtatagtcagatggtttgaaacccagaaagtattgaaagatatataatagaaagtcttttcttcctccttgtcctccatctgcccagttcccacctcccctagaataagcagctttatttacatataacttacatgccatgaaattcacctgtgtaaagcatacaagtctgtgtttttagtatatttacagagttgtgcaaccatcaccataagctaattttggaagattttgatgaccccaaaaagaaactttgtcagtcttcattcctccctagccccaggctaatctactctctgtctctatagatttgcctgttttggacattttccataaatggaatcatatgtgatgtattgtgactagctgcttccacttggcataatgttttcaagggccgtccatgttgtagcaggtatcagtacttgcttcagttttgtggccaagtaacattccactttatggatatgtcatgtggcttttccagtcatcggtggatggacatttgggttgtttctactttttttgtcactgtgattattaagaaagcttctatgaacttttggattcaagttttgggtgaacatgtcttcatttctcttaagtagatagatacctacaagtggaattgctgggtcatatgataaattctatgtttaacattttaaggaactgcaaaatgctttccaaagcagctgcactattttataattcacttcatgcatgagggttccaatttctccacatcttcaccgacatttgtcattgactgtctttctcattctagccatcccaaggggtgtgagttggtatctcactgtggtttggatttgcatttccctagtgacaaatgatgttaagcatcttttcatgtgcttctttagccatttatatggtttttttggggaaaatgcctattgaaatatttagcccatataaaaattgggttgccttttcattattctgttataagcattctttatatattttggatacaagctccttttcaggtataatatttgaacctattttctccaagttagtgaattgtctttttactttcttcatgatttgctttggaacacaaaagtttttcatttgattaagtccaattttgatcaatcttctcttctatcacacgcacatttggtgtcactgcctagcctcaaatcatgaagatttacttctatgttttcttctatgagttctgtggttttagctcttacatgtaagtctatgatctactttgagttaatgtttgtgtgtggtgtgagataatggtccaaattcattcttttgtatgtgaatacccagttgacccagcatcatttttgaaaacactattctttctcccattgaatagtctgggtatccttgttgaaaatccattgatcataactgttaggctttatttttgggctctcaattatattctgttgatttatgcctgtctgatgccagtaccaccctatcttaattagcattgccttgcaataagttttgaagtagggaaacatgagtcttccaactatgctttgttttctttcaatccatgagcatgggatggctttccatttatttaaatccttaatttccttcagcaatgttttttagttttcatgtatgtcttgcatttcttttcctttcttttttttttttttttttttttgagacagggtttcgctcttgtcgcccaggctggagtgcagtggtgcgatctcggctcactgcgagctccgcctcccgggttcatgccattttcctgcctcagcatcccgagtagctggaactacaggcatccgccaccacacccggctaattttttgtatttttttttagtagagatgcggtttcaccgtgttagccaggatggtctcaatctcctgatctcgtgatccacccacctcggcatcccaaagtgctgggattacaggcgtgagccaccatgcctggccttcttgcatttcttttattaaattttttcttaaatattttccttaaaatagtgtgtttggtttcttttttttttctttccttccttttttttttttttttttttgagacggagtctcactctgtcgcccaggctggagtgcagtggcgtgatccccactcactgcaagccccgcctcctgggttcacgccattctcctgcctcagcctcctgaatagctgggactacaggcacccaccaccatgcccggctaattttttttttatatatttttagtagagacggggtttcactatgttaggtcaggttagcctgacctcgtgatccgccagcctcggcctcccaaagtgctgggattacaggtgtgagccactgcgcccggcctggtttcttatttttaacacaattttttaatgtatacatgaccatttacaaatatgattagaatttcccccttttttcaaaaataacctccaaaacaaaaacagggcctatgagccatgccgttatataccttgttttgtttttatttttgttttttagttaatatgccttgctgttctttccacagcaacatacagagagcttcctcattacttttgttgatagctacagaacaatctagtgtataaatgtactgtaatttactcagtcaattccctgctgatggatgttgggttacttttaatcttctgctattacaaatgttgctgcaattggccaggcgtggtggctcacacctgtaatcccagcactttgaaagtctgaggtgggcagataacctgaagtcaggagttccagatcagcctggccaacatggtgaaaccccatctctactaaaaatacaaaaattagccaggcatgctggcgagtgcctgtaatcccagctactcggaaggctgaggcaagagaatcgcttgaacccaggaggcagaagtttcagcgagccgagatcgcaccactgcactccagcctggtgagacagagtgagactccatctccaaaaaaaaaaaaaaaagaaaaaagaaaaagaaaaaacaaaaaaaaccaaatgttgtgctcacttcggcagcacatatactaaaaaaaaaatgttgctgtaataaatttatcatttcacacttcgggataaatttcaaagtttaatcactgggtcagtgggtaaatccatcagtaattttgacaaatgttgccaaattaccctccatgggggttatttctatttactctccttccacaatgaataagaatgccactctccccacaggctctgccaatagaaggttttactaaacttttggagttttaacaatctcagcatgaatatggtatcagtgtagtttgaatttgcctgtctcttttgaatgagaccaagcatccttatgttgtatttccctgactgtgaactgtctattcatgacctttgcccatttttctcatgggtagctctttatttttctgcttattctttagatctgagttgcaaaggttttgtgcctgtttttcatatgtctttggaattgggtgtttgttgtcatagagaagttttggggtttttgttgttgtcgttttttgtttttgtttttttggtgtttttttttttgagatggagtctcactctgttgcgtaggctggagtgcagtggtgcaatctcggctcactgcaacttcccccaactgggttcgagagattctcctgcctcagcctcctgagtagctgggattacaggcacacaccaccatgcccagctaatttttgtatttctagtaaagacaaggtttcctcatattggtcaaactgatctcgaactcctgacctcaggtgatccacccacctcgggctccaaagtgctgggattacaagcatgagccgccgcatccagccataaaaaagtttttttgtttgcctgttgttttgtggattctatgttatgcgtcttttcttttagagattttgggtcatagttagaaagacctttcacactttgatgatgtaaaaaaattatgaaatggtttcttctctattaaatttacatgtttttattcttttcacatttaaatattttagcgggttgcttttcgatctgagggaaattatttcctgtgctcgtttctggcccagtcactttgtgccaagaatcctctctcccaagtgttgaaagcaacacccaggactttcacctttccccaccaggccacctctccctgcatcctccctggatggaggagatgcaggcagggagggagctgctgctgaaactcagtatgatccctgcccagctgtctatcagcacagtgcaagaatgcggcttgcttttccttccgcaagtctttactgagtacaactatatccagctactgattagcatttatccagcacctgctgtgtgcctgctatcttggaaggcactggattcagagacaaatgagacagtacggggaggcagaatggctataccctgaaatgtcacattaccaacaagaaatgtcacccagcagtgggttctgggagttcaggttctgggggtagttcccccagcccagagcactaatttgatgctactatcattattaatgattatcattggctgggcacaggggctcacagctgttgtcttagctaattgggaagctgaggggaaagaatcacttgaacccaggagttcaaggctgcagtgagctatgattgcaccactgtaattttgtagagacagagcaagaccctgtctctacaaaagaaaatgttaattatcactaatattaaaattattttacattattataaattattataaaatgataactattaacccattatatttcatactatttatatcactactggtagttattataccagtagcagcagccatgtcttgggccagttacatgcttgtcatgtacacacccttgagaagatctacaaaagaaagtctagagtgtccattttacaggtcaggaaaactgaggttgtgcacagccagagtccttcccaagatgactcagccgtgctttccccaccacgggcacttcactccggcacactctgggtcactgaaccatggcgaatccgttttcaacatgagctggcaggaggtgaaaattatgatgggtagaagtggctgtccccatttcacaaacagaaaactgagaaggtgacttgaccagttttcccaggacctaactaagttcttcttcctttagaaccagcatgggaggccgggcgtggtggctcacgcctgtaatcccagcactttgggaggctgaggcaggcagatcacctgaggtcaggggttcgagatcagcctgaccaacatggagaaacctcatctactaaaaatacaaaaattagccgggtgtaggggcacacacctgtaatcccagctacttgggaggctgaggcagaagaattgcttgaactcggaaggcagaggttgcagtgagccgagatctcaccactgcactccagcctggggaacaagagtgaaactccatctcaaaaaaaaaaaaaaaaaaaaaaggcatggagatggtggactctcaaccttgaacatctctgaaggttcattctgagtggaggtgggagcaggcaggggggtcttagagccattttcagtatttcaaaatagcccggggaaaaagcatatacagctcacagaaaccaaaagccatcttttcctcctcctccttccttctctccttctcttccctgtcttcctcatctctcttctttttcccttcttctcctcttctgcctcctcttcctcatccttcttttcctcctccatttcttcctccttctccttcccagttagcagaagccaggttgtaaggtcaccatccattcccatgcacatccctcaggtctcaggctgcagccttatcggggcacacaccctatctctgcacgctggaatcctctcctgcccctaccccactggtgagctcaactcatagcccccagcccaagtttgcagtcagtgtttgcttgaaagactggatgagaaaggccgggctctgtggctcacgcctgtaatcccagcactttgggaggccgaggcgggtggatcaggaggtcaggagatcgagaccatcctggctaacacggtgaaaccctgtctctactaaaaatacaaaaaaattagccaggcgtggtggtgggcacctgtagtgccagctactctggaggctgaggcaggagaatgacgtgaacccaggaggtggagcttgcagtgagccgagatggtgccactgcactccagcctgggtggcagtgccagactccgtctcgaaaaaaccaaaaaaacaaaaacaaaaacaaaaacaaaaacaaaacttgataagaaattcctcctatctgccaagcttttactgttccttctctttcagtcacatctacaggttttcttggtgaaattgtaaagggcaagaatgaggagcccacccatcgccccaaccctgctccttcactcctgcacagacacctccccaccaaggaggaaaagagggagttggctcacgccaacaggaattggcccctaaaatttttgttgtctcgatccaggtgtaggccttgtccagcacagcactccttatcataagaaatggcaatattaataagggcagcagctcagggggttgtctttactaacgtgctcaataccatactaggcacctgccatgcatatgctgctcacagtgattctgtgagtaagcaacagcatcctcatcttacaggggaggacgctgggtgtccaagagcagaagtcgtgcccaaggtcacacagcaaggagtaccagccccatgactcacagcccagggttccaagcagggctgccctgtggctttccccaggctcatccccaaagtggctcagaatctggtccactccccctgctggtccttgacttgtccattttagacgctctggattgattccccactttctaaggtgagaacttaacttggacgtcactatctgcatgcatgcagcttcccctcccccggcccccagtgaaggaggggtgcgttttcagttggagtcaagatagacctgctggctgccggctctgctccagaatgtcaactcctctgcagttttgttcttccccttctccttgctctctcctagaaagcctgtttttgcctttgctcactgacaatggtctaatggctctcacagtgagtaaactcttttacagaaggaataattccacatctccaccttatttgttgactcagatggctcatttatttatgacaatataaatattgcccacagctgagctgctgtacatgtcctatgattacctttcttttcctttcttttttttttctttctttttttttggggggggagaccgagtctcactctgtggcccaggctggagtgcagtggcacaatcttagctcgctgcaacctctgtctcctggtttcaagtgattctcctgcctcagcttctcaagtagctgagattacaggcatgcaccaccacacccagctaatttttgtattttcagtgaagacagggtttcaccatattggccaggctggtctcgaactcctgacctcaaatgatccacctgccttggtctcccaaagtgattggagaacaggcatgagccaccacacctggcctacctttcttttctcagtaatgtcttttgtttccctggagttggtaactcctctgttttccatgcaggtaattcatctccagctctgggacaaatccaccctgtcagttggtcagacatcctcacttatcacttctgtattttcactggtgacatttacccttcttccattttagctgggatagagtaccctctagaccttcaagcagctgtcactggggaagtccttcaccatcatgctgagaatgtccatcttcctctctgctgacaggggtcctgttctacccgtggtttttttggccactccccagattcagtggagcaagccctccagtagcttccaagatcttgcatgtctgagaacgtctttattctacctcgcacttgatagataacaatgttctagactgaaaataactttctatcctaaactttaaggcattgctccattttctgcttactttctgctttctacttccactttttgctggtaaaatatatataatgaaacttttatcattttaatcattatgacatattcaatgaagtggcattacgtacatgcacaagcaccactatctatatccaaaacttttttatggccccagaaagaaattctgtaccccattaatcaataacggctgcctgtgctaacctctattttactctctaactctgtgaatttgcctcttctacttccctcaggtaagggaaattgtacaatatttgtctctctatgactgtcttatttcacttagcataatatcttcaaagtttatccacattgtagcatgtataagtattccattcattttaataacatcatagtatcctgtgtacctgtaacatattttctttgtccattcatgtgctgataaacgattgggctgtttccacctttggctgttgtgaatatgctgttctgaatgttggggcacaagtatctgttcacatccctgtttcagttcttttggatgtttacttaggagtggaattactgggtcttgtggtagttttatgtttgtctttttgaggatctgccagacttttccacagctgttgctctgttatacattcccatgagcagtgccttcacatccacttgcttcagatctctaacgctgcttattttccatttttaataatagccatcctaatgggtgtgaaatgatatctcattgtggttttaatttgcatttccctaatgactaatgatgttgagcatcttttcttgtgcttgttgaccacttgaatgttttatttggagaaatgctgattcaagccttttgctcagttttgacttgagttgtttggttttttgttgttgagttttaggagttctttatatattctggatattaaccccatattaggtatatgatttgaagatattttctcccattctgtgagttgtcttttcactctctcaatagtgtcctttggtgcacaaaagttttaaattttgatgaagtccaatttatctaattttttcctttcattgcctatgcctttggtgctgtatccaagatatcattgtcaaatttagtgcatggagattttcccctatgttttcttccaaaagttttatagttttagcacttagtccattttgagttaatttttgtatgtggcattaggtaagcattcaatttcattctcttgcatgtgaatatccaattttttcagcatcatttatggaagagactgtccttttccccattgaatggaattgttagggttttctacatataagatcgggttatctgtgaacagagataatcttatgctctcctttccactgtggatacttctatttctttttcttgtctaagtgctctggctagttctcctggtgctatgttgaagagaagtggcaaatgtgtgtatcctggccttgttctgatcttagggcaaagctttcactttcaccattgagaatgtgggatctcaaatatggcctttatcatgataggaaagttactttctattcctagcttctcaagtgtttttatcattaaaaaaagttggatttagtcaagtgctttttctgcatcaattgagatgaccactaagttttattattcattcctttagtgtggaactaccattgcactccaaaaataaatcccacttggttatggtgaataaacttttcatgtgccattgggttcaatttgtatacataagacatattcgtgtgtaattttctctccttgtgacatctttattgtaattttgtattagtgtaatgctgacttcatgaatgagttaggaagtgttcttttctctttggtttttgggaagagtttcagaagaattggtgttcattcttttttaaatgttttggtagaattcactagtaaagcagtcttgtcctgagcttgtcactggtaggtttctgattactgattcaatctcgttataggagtattcaaattttctgttcattcatcagttttggtagattgtgtatttctaagaatatgtccatttttatctaggttatccaatttgttggtgtaccattgtttatagtattcttttataatcctttttatttctgtaaaataagtaataaagttcttaatgtcatttctgattttaataatatgagtcatctctctttttcatagtcagtctacctaaaggtttgtcaattttgttgatcttttcaaagaggagcttttggttttgttgattttctctattgttttttcattctctgtgttattgatctctgctctagtattcattatttctttccttctgctatttttggatttggtttgttctatttttatttcctcaaggtatataattaggttatgatttagttatgatcaggttatgattcttctttttcagtgtatgtatttacatgaatttccctctttgcattgcttttgttgtatttcataacttttggtatgttgtattttcattttcatttgtctcaagatattttataatttcccctgtcatttcttcttcgaccaatttgttgttgaagagcgtgttgtttaatttacacatatttgtgaattttccaattttccttctgttattgatctgtagttttataccactatgatcagaaaagaaactttgaataattttaattttaaaaaattaaaaaattttaaagtttagccttgttttgtggctgaacataaggtctatcctggagaatgttccatgtgcacttgaaaagaatgtgtattctgctgttgttgcattgagcgttgtctatatgtctgtgatgtctaattggtttatagtgttcttgatgtcctctattttcttatttatctgtctggtagttctgtcttattattgaaagtgaggtactgaaatatcccaatattagtgtaggactatctattactcccttcaactctgtcaatttttgtttcatatattttggaaccctgtcattaggtgtgtatacatttataattgttacatctttatgctgtatcccctttattaatatatattgtccttctttgtcttttgtaatttttttgtgatttaaagtctgctttgtctgacaacagtatagctgccccagctctcttttgctttctatttgcataaaataccttttccattcttttactttcaacttctattttaccactattttactcattgcctattaaatcatataggaaaaaattggagttacaaaccacgcaaaaagtaaaataattctggctttgtatttttttttaatctaaagtaagtctcttatacactgaatatacatgaagcctgtgggtttttaaatccaatctgccaatttttttttttactagcagagtttagttcatttacatttaatatgatcactgataaagatttacttcagccatttatatatttgttttatgtatgtcttacatgtttttgtttcttcaattacttcatttttgtattttgttcattttttttgtagtgggccactttgagtccctttttctttctttttctatacatattttagttattttcttggggattacaattaatatcttaaacttatgacgtcctagtttgaataatatcaacttagtttcggtaggtcataagagctttgctcctgtatgtccctgcctttccctttatattgtgattatcacatactgcatctttgtacactctatgaccactaacataggtttgcaatcactgtttaactcattgcctattaaatcatatagaaaaaaaataggagttacaaaccatgcaaaatgtaaaataattctggcttttatagttacttatttagttacctttatatttacttcactttttcttatgtcttcaaggtaccgtctagagtacttttatttcagcatgaaagactcactttaggatttcttgtagggcaagtttactgataatgcactgctcagattttgtttatctggaaaagtcataatttctccttcattattgaaaggtgatttaaaattatatacaattcctggttgacagcttactgttttctttgaggactttaaatatatcatttcactaccttctggctgccatggtttcttaggagaaatcagctgttaccgtattgatgatcctttgtacacaagaagttgcttctctcttgctgctttcacaattctctctggccttgggtttccttgattttattgtaatatgtcctggtgtgggcttctttgaggttttcctgcatcaaatttattgagactcctgaatgagtatattcacgtcttctcagatttgggaaatttggggccattattccttcaaatactttttctgccattttgtcccttctccttctgtaacttctatgagcatacattagtacatttggctctgttcaattttcctcaatcttttttcatttttgctacacagactattatttcaattgttttaagtttgccaattgcctcttctgcttgcttaaatttgcgatagttcccttccattaaggttcgtatttcactttttgaactttttcattccagaacttctgtatggttctttaaaaaaaaaaaaaaagactacttttagagcatttttaggctcacagaaaaattcagcaaaagtacagagagttcccacatccctgtccacatccccccgcacagcctcctcaactagcaacatcctaaaccagatggtgcatttgttacaatcagtgaacctacactgacacgtcgttatcatttaaagtccgacgtttacattagggttcactctcagtgttgtacatggctttgaacaaatgtatgcggacatgtgtccaccatcggagtatcttgcagagtagcttcactgccctaaaaatcctctgtgctccacctactcatccctcccatcctccaacccctgggaatcactgatttttgtattgtctccatagtttttgacttttccagaatgtcatggagttgaaatcatacagtagactttttagctttgtttctctcacttagtaatatgcatttgaggttactgcatgtctgttaatgccttgatggctcatttttcagtattgaataacagtccattgtttgaatataccacactttatttatacatttacctactgaaggacattttggttgcttccaagttttggttcctttttttaccacttctttctctttaccatgtgctcattgtgttcacacaacattttcctgacttcctttagttctctgtcggtttccttaagctcattgaacatgcctaacacaaatcttgatttcacacctttgactagtaatcccaatatatagacgtccctggaaatggtttctgtcatagtctgtatttcctgtaaatgtggcaaaactgctgctttgtatgctttgtaatatttttttgagacctggacattttgagtgttacgttgtggtgactggaaatctaaccttaccactcctcaaggattgctgaaacttgcctgttaagggctgaagccatctgtttgtgacttttccaagcttttagttttaagctatgtatttttccaaatttaatttgtatttttgcacagtatgtattccttgttgtgtgtagtcactgaagtttctgttcttttatctctgcagtcaaccagtgacccaacaaagatttccttaagtgcttggctcccagaccagagaaggatactgtctctttaaatcccgtggaagccacttcagcccttgagggttgaaacaatgtcctttgtgccggcccctcagtggtcacaggtagccatcagcaatcagaacccacaacctcaatatttggcggacaagggtccttcttgcttatcctggctctagccaagtggcactgccatggaatagtaagtagccactaccatgtgataggctgaaattcctaaaatttaccatcaagctctcccctggacaactccacagttcccaaatagtgacttcagacagtggctggcagctccgtagtcatttagcaggaggcacagattcccagagcttgccactttactgctttcctccatgtcactcctcacatcccaggattgcttttgagatgtcttgacttcgtaaatatgatgatgtaccctagtttgtgagactgtattgcactgatacttgattgactccttcagtctggagccaatgtccttccaatcattagtcaaccttcggagctcctgaaatgattccataatctcctatcttttgtctcttattttctagacaatttattcgattacatcttccagcccttctactgatgtttttattctggctataaattataattctaacaattctcatttgttctacgaacgtcctttacaatagtctgctgttttgtttcttagatacacaatcctctcttatatttctggggatctcaactgttgctcctcttgttttaaaatgctcttctgtttcccgcgtgtcttcgttggcaccaggtgtctgccttctgtttggtttgagtttgctttcctgctagaggcagtgctcccatatcaggtgacccttggccattggttcacaagtcagactgaggcactgacagctgcctggaagttctgggtaagcagttgggctcactgacgtagaagctttgccccagtgggatcaggcagggacttggacattttctggagagaatctcccgctgtcagtgcctctgggtcttttcctttgggtctgttttcccagagcagagacttctgatttcctgccagttgcagggtagggagggaggcatctttaaaaacctggttgccacactccttagatagaaactggggtgggtaaggagaggggagactggctgtccaggaggaagattatcacaattcccctgttgccaggaaggaccacgttgctaccctcagctgtgtccaaggagaccccactcttatgcctgggtgggtgagggactggcacctgccttggaatggggatgtgctggggtcacaccctctttatgtaagtttccaaccaatcctcttacagagcttcaccccttctgcccagccctgccgtcagagatacgtggtgcctccaaatctggagacttccttgagttctgtgactcagaacaacttccttcccatgtaggcatcaatgatgagagattctcaaaggcagtcaggcactctggttcctccatctcccagaatgttagagacatgtgttctttgctgtagaaacctctgccattcccttgatctctgaagatagatggacttgactgtcagctttgcgtggtttcaggagggaaggaagataaacccctgtgtttaagctgccgtgttaaatgagaggcccctggtcttttttcttttccttttttagagactgggtctcactctgttatccaggctggagtgcagtgatgtggtcatagctcacctcagccttgaactctcaggctcaagcgatcctcctgtctcagcctcctgaatagctgggactacagcacgtggctaattttaaaaatccttttgtagagacaggatctcactatgtttctcaggctgatcttgaactcctggcctcaagaaatcctcccacctctacctcccaaaatgctcggattacaggcatgagccatggtgcccagccacctctggtcttccctcagcttgctttcgttaaagaacaaacacatgccactgggcgtggtggctcatgcctataatcccagcactttgggaggccgactcgggcggatcacgaggtcaggagtttgagaccagactggccaacatagtgaaacccgctctctactaaaaatacaaaaattagccagacatggtagcatgcacttgtaatcccagctacttgggaggctgcaggagaactgcttgaacccgggaggtggaggttgctgtgagccaagatcacacccactgcactccagcctgggcaacagagaaagactccatctaagaaaaaaaaaaagaacaaacatatgccttgcaaaatgcttttaagcatttttaaggagaagttattgggggaagcaaatgtcatgaaatcagaagaggatggagaaggtgatgcatgcacacagtggaagactcacagtaacacaaaaccagacatgcagagagcgcccacatggatgagtctcaggcaccaagtggaggaacaaaaccagacacggaagtaccagaaggggcaatattagcctatgagggtaacaacagaacagtagctccctctaggcatgggcattgggtgtcgggggaccccagggaggcttcaggggtgaggaaatgtcctacatctccatgtgggctgtaatgacacaggtgcatacatacatcaaatttcaccaagctgtattcttcagctttttgtgcactttacacacatcattgtggttgtttcatactttagtaaaaaagaaaacaagaaggaaattgacattcttggttcttgctgtgtgctaggcactgagttggtccgtacttaaagaaaccattcacttaatgagcaggtgctgtgtcctaagtactatctaggttctgaggactcagcaattaataagaaaaattaggcacagtccctgccagatggtgctcacagttagtgtaggagccagcatcaaataaccacatgcatagaaggaaagtgaccacagcaacaggtaaagggcagtgcgagtgtgtagaagaaggaccgtgtcctagtctagggggtgagtcagaaaggcttcccttggagatcaggtttagacagaggtctcagtctgagaaggaataaacagctgaggggcaggggctggggagaagggcacgtcatgtgagggaacagcaggtgcaaagaccctgtggcagggagaggcgtggcacgttaaggagggcagggaacagggcccagtagggcactgctgatgtgagagagcagggggcctgaaaacaaccatgtgcagatggggaaactgaggctggagaggggaggtggctgccccaggcccctagcaagtgcagtgggggctagaagccaactttgtctgccctctctgctcctcagacagaaaggttgtctgtgcgaatgtgggcaggagaggccgtcttggttcccatcagggacaagaggccgggctgtggccgcctgccagctgccctcactctcctggtctctcagttccacagggcctgtggacaggggtggctatgagatcctgccccgaagagcagtactgggatcctctgctgggtacctgcatgtcctgcaaaaccatttgcaaccatcagagccagcgcacctgtgcagccttctgcagtgagttctggggcctgagccgaggggacagtgtgatcaccctcctcctttctccctagagcaccctctggccccacagtcaggtggctgaggaaagggtggcaggaggagatgtacagtgtggcacctcttacccctccacctttctgctttggtcacacaacctcctttcggtgtctcaaacacagtccattctttcctgcctcagttcctttgcacatgctattcccgctgcctggaatgcattccctctatcatcttccctcagctccctcctactcaaccttcaggtctcagcccaaacgtcaggggtctcctctgaccacccagtagaactaggccctcccttgtcactgtgtgttgttacattcttttgaaactttttattacagaacttatcacacatgtacatagagaggacagcacaatgacgccctctgcacccatcaccagcttcacaaattgtttaaattctgccttgtactttcccaaccaatttttttgacttgtgtattttattttatttattttatttttaattttatttttattttttgagatgaagtttcgctcttgttgctcaggctggagtgcaatggtgcgatcttggctcaccgcaacctccaccacccgggttcaagtgattctccctcctcagcctcccgagtagctgggattacaggcatgtgccaccacacccggctaattttgtatttttagtagagatggggtttctccatgttggtcaggctggtcttgaactcctgaccttaggtgatccacccacctcggcctcccaaagtgctgggattacaggcgtgagccactgcacccagcctgccttgtgtattttaaagcacagccaagatctcatataattttacctgcagatactggaccacgaaaacctgtgaaacataatccaaatatcctatcactgccagcaataatttattaacatcatctaatactcaggcaatatccagttttccctgattgtcttgaaaattattcgttgcttgctgttctttttcataacctgttcttttccttgatagaacttaccacaatttgctgttttgttctttcatgtgtatgtgttttatgtctgactcaaccactagactgggagctccctggcaggggaaccatgtctgacttgagcctagcacagtgcctgacacatagtaagtccttcatgaatacttattgcggggaactcagagaggctgagtgactcacccaagatcacccagtttaaaagtggagatgtcacagcgacatcctggtttgaacccaggactccgactcctaaatcatgacctgaaccactacccattaatgaattagaacattcattggttcatcccacaaacatagatggagtgctccagccccatggaaataggaatctgccgtggcccttcaaagacagtgtcatctaatgggagaaatgactatgtgtcaaggtagaaagccacagttgggagagacccccttcagctaaagggctggggagcagggaggtgtccctagaggaagcaccatcagaggcagattgttaagaggtcacagaatgcggaaatcagatgggcacctggaagaaagggcactatgagcagaggctcagaggagggaaacacagtggggaggactgagtcccaggcgggggaggggaggggtgtgaggtcaggcagggaggggtgtgaggtcaggcagggagggtcagtgggctggggcactcaggcaccacctgcaacagcaccacctgcaacaggggaggaggtcacagaaagccccaaggacaccaatgctgggctaaccctgtgtgatgcagagtggaggtgtcagtttctgtgcggttcaggggcgccctggggatagggcagggccagagcaggggaggtcactggccctatgtgggccatctgagttttccctaaggtcccaattccgtgatcttttagttccttcctttactctgtcaaagacacaagaacggatctgtttgctttgtgaagaggctcaaatgaatattctacttaagctttccattacgtgagcatttagtatgtgccaggcactgtgctgggccctacaactctgccaacaaccctacgaagaagtcagtactgttattttccctatgttggaaatgaggaaactgaggcacggagaggctaagaccacactgcctgcaagtggtacagccagggatggccccaactgaaatttggttctgaaatttgggttcttatccactatcctgcactgtctccaaaatgtgtccttaaaatatatgtgtgagccacatatattttatttatacatatttatttatttatttattcatatttacgaagtcaggacatctcaaaagccataccttactctaaatacaaaggaaacttgcctttttcacgtaaaaacttccatgtagaaatattcggaggctagaccagatgcggtggttcatgccacctgtaatcccagcactttgggaggccgaggcaggcagatcacctgaggtcaggagttcacgaccagcctggccaacacggcgaaagtccatctctactaaaaatacaaaaattagccgggtgttgtggtggtcgcctgtaatcccagctactcgggaggctgaggcaggagaattgcttgaacctgggaggcagaggttgcagtgagccgagatcgtgccattgcactccagcctgggtgacaggagcgaaactccttctcaaaaaaaaaaaaaaaattagaaatattctgagactttagataagataattgattgttccaaataggtttctttatgcattcaaagttgggtccactgtgctctcttaaggcaagtgtgatttggctttagtttccttggcttctgtgccttggcactgatacttgtgtaagctgctgtaattctcatctagtattaagacagaagaaacactattcatgtgaacttttccaccttccttccagccccctcccccagcttgtcaaagaggattctggcttttccccttctttccttatgctgatttgaaatatatttctccttgatgaggcttgaaaaatgcaagtaaaagtcttatgtaacaatgtaatccagatctaaattttaaatgataactgaaaatcttcatacgtttggaaactaagaaatgcacttgtaaataacccataggtcaaagaaaagataataatgaaaaataagtgcattttgatctaggtagaggaaaaatactacacatcaaaatgcaatgcagctaaaatagtacttagaggacaatgcatagtcttcaatgtgtatattgtaaaagtacttggcttactctggaattgccttctggaattttactgtatttttttttttaactttgatgtcctttgtggtcaaacccagagttcctgctagtctgtgtcacccagcagtatcatgaatttctctctcccagggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccaggtaagccacccaaggcaaacctgcatggtgtcacgcagggtgagaaagcgtgggaggcctgatgccaggcctagaacaggagagtccacaatgcatgaagcccagagtccaagcaaatggccagaagccagggagatcatcccaggataaaaaaaacaatgtaggcaacatttccagaagtctgtggacaagaagaaagcaggagaaaggacctgccgtgtgaggaagagccttgcactagaggctgccgaggctgtgccagtcattgaagcacaggcacaagtaagcagcagacccacctgtgtgagcacctgagcagcagccaccacctgccctccaccagtgctgcagactccatttatttctattattattttatttataatttcaacttttttttttagatccgggggtacatgtgtagggtttgttacatgggtatgttgcttgatgctaaggtttgaggtacaaatggtcttgtcacccaggtggtgagcatagcacccaataggtagtttttcagcccttgccctctctctctgcctcccccttctagtaggccccagtgtctgttgttcctgtctttatgtccatctgtattcgacacttagcatttcacttataagtgagaacatgtggtattttctgtttctgcattaattcacttaggataatggcctccagttgcatccatgttgctgcaaaaaacatatttttctttttatggctgtgtagtatttcattgtgtatatttaccacattttctttatccaaccatcgatgggcacccagattgattccatgtctttgctattgtgaattgtgctgtgatgaacatacgtgtgtatgtatctttttggtagaacggtttattttcctttggatatatacccagtaatgggattgctgtgctgaacggtaactctgttttaagtcctctgaggaatctccaaactgctttctacagtggctgaactaatttacattccaccaacagtgtataagcgttcccttttctctgtagcctcaccagcatctgttgtttttttactttctaacaatagccattcttactggtgtgaaatggtccctcattgtggttttgatttgcatttctctgatgatcagtgatgttgagcattttgtcatgtttgttggctgcttgcatgtcttcttttgaaaagtgtctgttcatgtcttttgcctactttttagtggggttatttgttgtttgctttttgaattgtttaacttcctcatagattatggatattagacctttgttgggtgcatagtttgcaaacattttctcccattctgtaggttgcctgtttacactgatagtttattttgcagtgcagaagctctttcatttaattagatcccacttgtcaatttttgtttttgttgcaattgcttttgaggacttagtcataaattctttcccagggccaatgtccaggatggtattttccaggatttctctaggattcttatagtttagggtcttacatttaaatctgtaatccatcttgcatctatgttcctcagggatatcggcctgtggttttcttttttttgttgttgtgtctttgccaggttttggtaccagagtgaagctggctttccagaatgagttaaaggagaccctccttgattttttggaatagttgcagtagaattggtaccagctcttctttgtgcatctgctagaatctggctgtgaattcatcagattccatttagaggcaaaagaggcttcctaagaaagagaagggaaaggtatcacttaaaatgtttaagtagttcattaacaactgccagagggaaaaaaaattgtaaaaagagaaggctcagcatggtgactcatgcctgtaatcctagcactttgggaggcagaggcaggcggatcacttgtggttcggagttcaagatcagccggatcaacaaggggaaaccccatctctaccaaaaatacaaaaattagctggatctggtggtgcacacctgtagtcccagctacttgggaggctgaggcaggagaattgtttgaacccaagaggtgaaggttgcagtgagccaagatcgtgcctttgtactccagcctgagggacacagtgagactgtgtctcaaaaaaaaaaaaataaataaataaataaaaataaaaataaaaataataaaaaataagtaaagaaaatgaaaaaacttatggctggagatggccactttggacatggcaagaagggtcctgttgagctgggcatctggtaagtgccaggcatcagaaatgatctaattaaccctatcccagcaaacacctctttttgcacctgccctgctctgtggcatcagaaaggacagaagagggatgccgtgtggatccataaatactagcgatggcatctgccctgctctcggcctgtcctgctcttcttggggctgattggttcctttcctttgcagtgactttcctgtgataacatcatttccatgaggccaggtcccagggctaaggtcccatgggcagggcctgtgtgcctgatgatggaggttgcccagcaccctgttgtccctgcttagcctggcatctcctgctctcctgtcagttagctgctgctgcctaacaagccatccccaaatgcggaggtgtgtgctttctcccgagtcaggggtttggctgggctcagctgtgccaggctggctctgctccatgtgcctctcatcctcctcctgggacaagtgggctggccaggtgcgtccatctcatgacgatacaggagtgcagcagacagtagcacgcagtcctctcgccacctaggctggtaacttacacttcatcaccaccgctgcatttctttccattcacagtgccagcggattcaggggaggggaaacagacgccacctcttggtggaaggagcaagctgggggaggggggaaacctgtagccatggtgaattcaaggccatttttaatctagcacagcctctcctgaggggaagaagtgcagattcacatggagggggtgtggatacagaggggctgaagagcccagccacagatgcgaggggccatgcctgccgccctggtgtctggccacctgcgcaccttccctgcatccagtgatgcatttgaaacttcctgcaaacctggaacattgcccacctctgatgcaacagattcccccgtgggtcattcctagccacctcacagatctagagagtgagtctcaaatttggagtgacttgctgacagtcacacagggaatgcgtgagtgagctgggatttgagcacagtctgggggttccaaagtttgtcccctctgcaacagcaaaatgacccagagtggcgtctgcaggctattgctccttggcggtgaactgttgcccctgggacaaggttagccacttcatgtgtgtgaccatcagccaagcccccttgccagagggcactgggcagaaccttggagcctcatcttggctccagggatggagcccaaggctgtgagcattgggggctgtgtgaggatgtgttggtgccagtggggtcggcattaccatgcctcaccctacatcagctgccacacttgtgccatggcgcggcttttggtggctctgtgactgtcgctgtgcactgccctaccctgccctttatttctccaggggcccagggttaaggtctgttctgttctgacttctgatgcctgcatgggctggtggggcaggaggggagcttgctgtggattgcaaacaggaagtacagagccacatggccaggggagggacccagaggtggacctattcaagggcagagagcagaggacaccatgtgaccaagttgtccagctgcacacggtggaagggctcacctgttctctgcccccttccgtgggctccctgaattctgccgttccctgtctccagccctgccaggtcccacctcaccctgactccaggtttctcttgcatcccattcagaactgccactccttagtgggacctggaactgtggcaggcttgctgtgcatggggagtggggagaatgaggcagttcctgtcccagacccatggagctcactgtctcgtggaaggccaggcagtggacaagccacgcagatgacaaattcctctcagtgcacgggagccacgtaacccagctgcaggtgacacggggacaaggaaggcttccccgaggaggagtctttagggcaggctggggtgcgggtgtggagtgtggagccagacccctagttatgtccctcacaagctgtgtgacctggagcaagctaccgaccctctctgagccttagttctgtgaggctggagttgttcgccttcatagagctgctgtgagggtgatttgggagaatatgtttttgggggagcatgtgctctgtgcgctggaactgctcattcaaaaagcaactatgttgaagccacacggtggagacagggttccagacagaggcaacagcatgtacaggtgctgctaggagcagagaactgtgccgttgggaggctgtgaggggctctgtgctggaggctgggataaatcccttcctctcgggctcccagcctgcaggagtgtggtggccactccacagaagcaggagggaccccaccccagatctgctttgaaggtagagactgaccgctccacatgctcaccaagagagcacagaaagccctgctgctcacacatggcgcttggtggggagagcagggcaggctcccaagctggactgaaaatggcttgagatgttgagcaggagaggagactggcgtggggttctactgcgacgactccaggccgacgcgaggagcttcctgcccgggctccggggcaggtgcagggagtgtgtgtgtctccctgaggggaacaggtggcccaggcagcctgccctactgggtggggctgctcatctgtccggcagaagacgaggaaaagcaccaagggcaggaccctgtcccccaacatgggggttgcagaggactgagttgggaagagcaaggattcaggggcagctggagatggcactaggagggaccagatgccagatgacagagggccctatgtgccaggctgggaggctgatgtcctgctgggggcaggggcagccatgggagaagggggtcagagcagggctgtggggagagctctctgttgcccctggatggtggcgatagcagcaggggccctgtgagaggctacttctggcaataataggaaccagagacctgggagggggacagagggacagtgcattggcatgagattagaactggagggagaggtgctggcatgtgatcagccatggaactgctcagcctctgtgtcctgcagacactgggggtgcccgtgaccccttctgggaataaggtcagaactaggcctcctgggcttgtggctgcatcactcccatctctgcctctgtcttcacatggcttctctctcgtgcctgtgtctcttcccttctcttcttgtataaggacacttgtcactggatctggacacttggcaccagatcctcatcttcatgttgtgaccctgcgtggctctgtggggaggcagggttcagctaggcgggtcttctgctgctcttgcttggggtctgtcatgcagatggtgctggggatagagccattggaggcttgactctgatgctgggatattcaggccttgcttcccctccagctgatctcagggcttgcccctctccactgggactctccagttggacttctcgagtggtggctcaggcccaagggagcaaacaccgaggctgtcaggccttcttgaggcagaggcctggagtggcacaacctcgcccccatggcactctcctggataggatgaggcccagtccagcccagatggtccacagggcatgatgtcgggtgactgtgctctgggtgtggtctctgaacacttgcatggtctctgaaagctgggtttcagaatcttatgatgaaatgtttgaaatatgcacaaatgtttagttttcctccttgaatcaacgccgttcatttccgcttagtaacaacctgtagcctggcattctgtctgtgctctgagggctggtagcgtctcccctgctcatgcctccagggcagtgtttgcatttgatttgagaggtgaataggagcaggtaagccttggatatgtggcaccaagtttgcaggtcctggggtctttgctttcctccgttaggcctctctgagctctgggcactggacagaaggacagccactgactggcggagtgacacgaactcaccccaagttcccatctcccccctgtaaatgtcagagtgacactgatgacccctaagagtcctggcagctctgtcactttatgagattcctgaatctaaaagcgtgtgtgaggaagacgggcagtgccagccctggggccgctgtgtggcccgcgggcttggagcaccggcctgggaattggtgagaccggctcccgggtgcaggtctaagaccgagaacaatatcttagacactcagttttgtcatctgtaaaatggagtgtgaacggcagatgctgtgcaacgcagtccagcaggtcctcaaaaaacaaaacagagctattatgtgacccagccattcttctcctaggtatacacccaagaaaatggaaaacatccatccacacaaacatgtggatgtgaatgttcacagcaacgtcattcacaatagccagaaagtggaagcaacccaaatgcccattccctgttgaatgcgtaaacagatgtggtctgtccattccgcctaaagagaaacgaaggtctaatacacagcacggcaggacatggtggaccttgaaaactcaaagccaagtgcaaggagccaggcataaaagaccacgtgttgtatgatttcattaatatgaaatgtctggaataggcaaatccacagagacagaaaagagatgaacagttgccaggggctgggaagagggaatggggagtgactgctgatgagacagggtttctgtttggtgataaaaattgtctccaattagacagttgccattgctgcacaaccttgtgatgtgctaaaagccactggttgtacactttaatacagcaaatttgatggtatacaaattctcagtatttttaatgggggtagttgtctgccatcagagcgggaagatgaagggggtgctgtaggggaagtgcccggcacgaagtgggactcgctcttcttgacgtgtcatcttaaatctggctcatctgtctttccacccagcgcctagaggatgcccagctccagggacaaggaagagcttttgggataaggagaacttccaaggggagggctttcacctgggctgagtctgtctctggcatccaaacctggaggcacaagtcctgagtcatagggtggccaggtgccctgatgcccaaagccctcctggttggcacctgctgtcctggtctcagtgtaacgtcgcctgtcctactctcaaacacagtgggccctctgtgtcgtgcgacccatgtctgtggattcaaccaacagcagctggaaaatactcagaaaagataggggatagttgcatctgtactgaacctctgcagccattttttctcattgttatccctaaacaatacagtataacacccttctacatggcatctatattgtatttggtattataagtaatctagagatgactctaattgtataggaggatgtgcataggttatatgcaaatgccaggccgtcttgtatcaggcacttggacatccgcggattttggtatctgtaggggatcctggaaccagtcccccatggataccaagggacgactgtaaacgctcactcaggaagctttctccttggaggaagggcccagttcaggatgcacagagacatgctccctggagcatcgtctgttcgtctgtcgattcacccatcagcccatctccagcgctgtcccaattacagccctagcaagtggagacaacaagaaggcctagctcacgtttccagctttgaggccttagaaagttgctgccaggatgggggagtggatcaacttcctccaggatccagagagcatcccagcagcctcagggtcagaaaaggagcccagcctctccaggagccagacaggctcacagcagggggatggggggatgtggattgcttgagcctaatgacgggaagagaagaaggcactgcagagaggggtctcatgctgtcttgcagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccagggtgagtgcatgaaactggggtcctcgcccttctcgctgcttgggtgacaagcctcgggccatccctcggtcctgtcactgcccctgcttctaggtggagaggcccagggctcatccctgttacttgctataccttgataaaatcaggttaagacatcctggcagacagataactgggagagtggcacccgggaagggtgggtgtggggtgccggtcttcaggtttgcctgggcccaggattctccagatgcagagccttcagggctaagcccaggaggaggtgtccccttggggggcgtggcaggctcggtgctggacagaagtgagagccaagaattgcctgcccacccctgccccggcacaggttctggtcagcaactggcggacactgacacctgtctgggggcgttctacgctggtgattgcccttagctcctgggtcgggggagagtgcggctgcccacaccgtcacccctaccctagtgcagggccaggcctggcccacgccctccactctcgcctctgcagatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagagagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctcactgcattgtggttgggtctttgatgaactgagacatcttgtctatcactttcctgggcatcaggctccactgaacgctgcccccttggtttgggaggccctgtggtgcccccatctcaccaggctctcgaggaagcttgtgaccttgggttgagccctaagcagccgggtacccactggggctctgcttctctctttcactaagagagagaaagagaccaaagaaaggtctgcagggagggtgcctgtgcaaacacccagggaaccaggggcttgagccatcttcatttccttacagacacacattcccttccatgcctccttagtaagggcatgacgcacagtgtgtgtgtgtgtgtgtgtgtgtgtgtgtgcaggtgtgtgcatgcatatgtgtgtgcatgtatgcgtgtgcatgtacgtatatgtgtgtgcgtgtggatgtctgtgcatgtatgtatgtatatgtgtgtgtgttgtggggatgtgcagtggacaggaaggggagggcagctgtagctgaaagctgcgagtctctctggaaaaaacatcaagattccctggaccacagcaagagaatgttttcatttgagtccactttttgttagcatttaaagctatatcttgagtagcatgtaaaccttaagtaaactattcttagaagcattttcacagtaagataaatccataataatgtacattgaaattatgcaccctgcacctcctaaaattatcttgcaaacctgcacccaccaaaggatcccgtagcgcactttgggaggtgtagacaggaagcctggggctccgtcgctcattccatcttttcaccagctgtgggctaccacgctgcattggtttgcttgggcttccttaaagtaccacagactgggcagcttcagcaacagaatctcactgtctcacagtcctgcaggctgtaggtccaagatcaaggtgtcggcagggaaggtcccttttcagggcggtgcgggaaggctctgttccaggcctctctcctggcaggtaggtggccttcccggtgtctcttcacctcgtcttccctctgtgtgtctctgtccacatttccttttcttataataacgacaccagtagttagattgggggcccccctactgacctcatttttcattttaacttatttctataagatgatatctgtaaataagatcacattctcaagcactggggcttaggacatcaacacaggaatttcgggggacaaattcaacccatcacacaggccgtcctcgaggccacctctgcgtcatctttgtctacaggcaagttggcatctaaaaagtgtctgcccaagacatgcgtctggcccatggtacagccagtccacacggccaatggtgagatccgggtggcattgtttcctcaccgccatgcctcacgcaagcagctgccttcttacaacaaggtggacacaaatcccagaactggcgcagacgcttgctggctgtgggtgaagtagccccacgtcagcgtcctgcaaatatgcggcttagaatgttacggcttgtgtgaaagatatgcagatttctattccttccgatccatggtttcaagttctgctcgtctgaacccaaggggctctgtaggtgcctctggaacagccggggttttaggggtgttgaaaacacaaggtacccaggctcaaccccagcttcaatcacacaaataatcttgtggtggtgtttctttggtcagtttttaaaattgatcttttgtactcttttttttttttagaaagggatcctttggtagaaagaaaatctgaaactctaaatactgtccattttatctatgtattgttggtcctttccccaaaatatatcctgattccagccacttgtcatgatagttttaatctgagctctcatcgtttttcacctggattactgtaccagcctccccactggcctccccgctgccacctggcccctccccagggctcagcaagatttttctgcaaaggacctggtagtaagcatcttgggcttcgtggaccctgtggtctttgttgcacctactcagcagttactcagcttcgccactgcagccccaaagcagccccagacaagaagtgaacacaggggaggaactgtggctccaataaacctttattcaccatgacaggaggggactgcatctggattgtgggccatagtttgccaacccctgcctgacttcatggcaacactgaaattcgtatttatgcttcttaaaaacatgtctaagccaagtgcagtggctcatccctgtaatcccaacacttccagctgagcctggaggattgcttggggacaggaggtccagatcagcctgggtaacacagcaggatcccatttctacaacaaaccatttcaaaagcagccaggcatgggggcccacacatgtagtcccagctactcaggagactgaggtgggaggattgcttgagcctgggaagtcaaggctgtatagtgagctgtgtttgggccactgcacttcagcctgggcgacagagtgagacctcctctctctctattatatatatatacatacacacatatatatatctgtatatatatatatatatgtgtgtgtgtgtgtgtgagagtgtgtgtgtaatggttgtctgcaagaaacacctttaattaatcacagccaaccctcaaataatacgcatagtataggacccttacaatgctacactcccaactcttctccccacccaccttttgttttctttccttccacggattctgtgacatcttcctctcctcattgactctgcatgaaggggattcctggtgggggaagggtagctggtgagaaatgaggtatcaagaaactagcaaagcatcttctggctgtctgtggacagttcttgtgtggtccccagcctagtctcaagggttctgggctggtcaccctgcagcctctgtgctgtgtcaccagattcgggctctgagggaagggccctgggaggcccaacagagcggggtgccttgtctaacatccccccgttcctctggctgtgtggctcaggaataggcccagacagtgtgtccaggtggtgccaggtcacctcactgccccctttgagatgggcccagagggttttgtggggtgagcatgaagctgggcacccaaagcctggggccgagtgcccctccctgtgtcccagaggaggggccctgacctgagaagatccccagtgcctggcttatgggtgccaatgtggggaggggtggctctgaggactgaagcgggtcactgaaagaagacattgagctccatggctcagggaccttggcagtagaggcctggtaagcagagactaggacactgggacttggtcacaaaaaatatgatcagaaagggcatggccatcagagagttggtcaggcggcctggtcattgagggactgtcagtgaggacctggtcactgggtgcttggtcaatgggtcttggtcagtggggacctggtaagtggagatctgattactgggggcttggtcatcaagagcctggtcagtcaggacctggtcagtgaggacctggtcagtgaaggacttgtgggggggcattggtcagcagcggccttgtcgggggaggcttggtcagtgggggcctagttagtggggtcctggccagccggctgctgggtgacctcatgcaggggtttgtccttggagcttgcttgccgccatctgtagtggggatgagtcacatcaccccagagggctactgggaggaggagatgagcaggtgtgtggaatccggccctgcccaacagacctagcactttacaccctagctgagtcccctgctaaagagggggcctgctctctgccctccaccctcaattctctgctccccgtccacaggactgccccacctagggagggctgaggttggggaacacctgtggacactctgatgctggccacaggcccagggccgggcgtgacagtgacaaggacctgagtgcgtacatgaatggggccacctggcccagccacagaagcaacacaccatatgcacgtgttcacccacatatatgtgcacgctcacatttacaaacacactgcatgcacacatgttgatgcttcgggggtggaggacggtgactgtgggccctgctgacccaggcgggggcccattgtgatgggtgccgtgatcccgtaatgtcactggtgctgagtacccacccgcctacctggctgccttctctgtgtctggagctcttagagacaagataaacagcgatgtctggttctgctcagaggaggctttcttaagtgagaggcacagttggatcagcagactcagctgagtgtgacctgctctgttccctccctgctgacctgggacagtcgctaccaggcagtgctggcctctgggcgggtgccgaggagggtcatccctgagcactcaccaggtaggtgcctgttctgcactgacggtatagatgttcgtcttgttggtcgtcacagtgacgctggtgggggtgggtgctgtcccctaatgtacccattccacaggtgagatgtctagggtcagagaggcagcgactggtccagagacccagatgtgaccctgggccatgctcttagccctgccctgtgctacgctggactcaagccctgacctctgtggcctccctgccctggattccaaatccatccggggttccagcccctgatggggcagagtctggccctggaagagccactgggacagagatcctatgggtgaggtggagggggtggtcctcagtccaagtctgtgccctaagctgggaccccgcgggaggtctcaccaactcagacttcacatgtggtcactgagggtcattgtgggacccactggacacagggggtcccttgtctgggagtggggtgaagagccttctgcccttgggcagttaggtaggggactttgagcactgctgctttgggacctgggaagtggggacctgggcagcggggtcctcgtcattgagaacatggtcagtgagagatctggtcatcatgggttgggtcaggggggcctggtcagcagagacttggacactggggcttagtgaaaatatgatcagtggggaaatagtcacggggcctgctcagtagggcctggctagcagaggcctggccagctggccactggatgacctgacagggggtttgtccttggagcctctttgcctctattcatagtggggatgagtcatagcatccctcagcactcgccaggtgcaggttttgtgctgaccttgtagatggccttttccttcatccccacagcaactccatggggcggatcctgtccccgaatgtagccattccacaggtgagatgtctagagtcagagaggtgatgactggcccagagacccagatgtggcctgggccgtgcactcagccctgccctgtgcagtgctagactcaagccctgacctttgcagcctccctgccttagatcccacatttccctggggttctggaccctgatggggtggagggggtgattctcagtccaagtctgtgcccaaagcttggtccccacaggaggaggtctcatcaactcagacttcaggtgcggtcactgatggttgctgtgggacccactggacacatggagtccttcgtctgggagtggggtggggaggcctctgccctcgggcagttgtggaaaatgaaggagctctagagggctgcctggagggtgatgatcgtccctcttggtcaaaggggcttggggactggaaccttctctgtctgattctctagaggtcttgtcttccctttgtcccaagtattcccaaggaagatggtccccctgggtgttctccaggaccaagtccccagaattctcttgttttttccttggtgatccaggaaaacgaagccccctcctgtattgacagctgggaattgtggagtccaccgtcctccacctgagacgagcacagggtctccacgaggacagaggctgctttggactcaataggtcatttttcccccaaaccaaatgccctcctgcttagctggtgttgttcctgaagcggcttcaccagccagagtgagtgagaattggagcagaatggagcagtcaccagatgtcttgcttcctacagaaaactgggcatcttcatggtcctagaaggatcccaggaggctgatcctatagagacgtctggttcctgaccccaactgcctccaggtgcctggaacagcccatcgtgggccctttaccctcagcaggtggacgccgttggtcctgccagggcaagtgtgtgtctgtcttagggcatttgggaacaatgggcctctctgtccaggtccccctgtgttcaagtcctcaggaaggagcctactcctggtccagggcagggactctagagactagggcatgggtgggaatactggatttaaccctttgtcttggggagcaatcgtggaatggggctcacctgtctggccagcatttgggggtctggtgggagccgttcgggtgttctctggagctctcgggtgctgcagagcctttggatgactttgtcttgcaggatggagatggatgagcacccggatatcctgcccacccaggggcaaggcaacatcatcattactaagtatgagcaggtacaggtcgggccactcccttgaggaaggtggggcctcacctcccccactggtcagagcctggtcagagggtcctgggctccccaggaccacagggtgaagacaggctctccatgccgtcaggaccccaagcccttcaccttgcccctgtctccctggccctcgctgggtcacagggacgctgagctggggcagcagtggacacagagcatgagcgtgttgacatctggaaattcaccagtcgtctctgggttgtgtggtgagtcctctgtccccccacccacaagtctcacctcagggatgggttttgtttttagaaaggtctctctgaggtagggcaggcttccctggctcaggacaatctcctctccagggtaagaactcctctctgcctctcctgcaagtccagcctgtggtcagggttagggcagagcctcaaggcccatctagggagctcgagagagcgggtgggacagagagggggctgggtcaggcccggggctttcagcactgagctctccacatcagcaggagacgagggggcagcctaagggtctggccctgtccccttggggcctgccctggtgagatctgagggtggtggccacagggcaaggggacacctggccaggcctgtgggctgttgtgtagcaggtctccaagggctcagggggcccactggggcatcctatagggaggggcatggggacagcaagggctgtgaccctgggaggctgggggagaagaagtgtagggcctgtcctgggcatcccacagtgaggcctggggggcaacagagcctgaagctgaaggccccaggagtggtggtgctgggaagggacctgggcctggtaaggggagcccagcctggagccggcccctcaggactcacaggatggagagagggaggagcctgggattggggggcggtgagccggtgagacctgccacttctgggatgcacctgaaccaagctggcccagggtagagctgatagtctggggaggaaaacagatggggtggtcagggaacagcggctcacctgggacccctcagtgggggtgactcagtcagtccccaagctctacgtggccctccagagactctgcttcctgctggctcagtcagcaccacagaaggtggacgggaggctgagtcggggcaggcaggacagtagggggaggacagccaggcatcccatgtcctggtttttgcagtggctgggaggaggctgagggttgaaggctgactgccctgagagccagctgaggctgtaggcagggtggtggggccagccccactgcctgcagggcccttggtcacccttgtcaccccaggcttctccccagcagcgctgagcagcccagtaagagacctggggggtctcatacctaggctctgacaggaagagggtcctggaagggccagggtggccggagagagggtcacagtctctgtggcgggcaggatgggggaagatgaggaataggcagggtctgcagccgggatgcagggagaggcaggtgaacgctgggaggtcacaccctgcaaggcctatggggagtgtcaggtgggacaggtcccaggtgcgtcctcagggcactaggcagctctcaggccaggctccctggactctggtgggtgatgtggtcactcacgaggcactgctgtcagtcagggctcagccacccaccctgggtggcacccatctcgtctcaggactggactttctcagctccacagagggtgtcgcctccagcccaggaggagcagccccattgtgcagcccaaggcaccccacaggccccgagtggccccctccaggccagcctcgagctccctcttctccagggtcctggtgcctcgtgggcatcagctccacagggaggcccttgccttccttccctgtgccttctcccgggctgagacttagggtggatggggagggctggggccctctcatggatgaggatggctcctggcccaggtaggtcgtcagctctgcctgggttgccttacagtgagacagagctgcccgtgtcagtgccctggaggtgaagggaagagcctgtgcctgctgcgtgggagactggtccagggacagggaatcaggagtggttggtgagacagagggggtggcctgcgggcccgggcggtggtaagtgggccagggctgtccctgggaggggcggcctttcctgacggactctgttcccatgagcatttgaccaaaacccaaatcaagaaccacagtcttggctcagaggtcactgcctgtttgtaccaagtccccagctaagggccaggacctgaccaaaactcggggtgtctgtggcctgaggatggtgtgtcctggcatgaccagtccagaccaccagctccagttagttcagagggtctcagcccccgggctctgctctttccttgctccttcagggccccaaagcccaggacccagcatccatgggccgctgccggaggcctggcagctccgctaactccatcatggctcatttgacagcaaaggtgtcaggaaataaaatgtactgacaagtggctgaagatgcttggagactggccaaaatataagaacagcaagaaggtgacatggcggttgggcctggtagctcaggcctgtaaccccagcacttcgggaggctgaggtgggcggatcacctgaggtcaggagttcgagaccatcctggccaacatggcgaaaccccgtctctactaaacatgcaaaaattagctgggcacggtggcgggcacctgtaatcccagctactcaggaggctgaggcacgagaattgcttgaacccaggcagtggaggttgcagtgagccaagatcgcaccactgaactccagcctgggcgacaagagggagacttcatctcaaaaggaaaagaaggtaacgtggggagggagtggcctccatgactgctctctgcagagtcaggagacaggcacccatggccatgacctggcaccatctgcctctcagcagatgggtggcactccatccccatcataggacagcaggcctgtttaccggctttcctccccaagtcactacacatcctgtctcactggagtgttcttttgtctgtagctgtctcgaagcaggtacaaaggcattcccctggtgtgaggccaggcgtgggcacttctgctagacattgacaaagtcaagtcccagaacccaggaaatacaaggtaaggccctcccacactcagccagggcaggacaaataggccaggctgtgtcaggagcccaggactccagccggaaggaatgtcaagcccgggttgggggtgggggctgtagtcagatgcacatactaggc

SEQ ID NO: 1649 - DNA, 1358 bp, Homo sapiens
agcatcctgagtaatgagtggcctgggccggagcaggcgaggtggccggagccgtgtggaccaggaggagcgctttccacagggcctgtggacaggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagagagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctca

SEQ ID NO: 1650 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 1651 - DNA, 87415 bp, Mus musculus
  misc_feature (1)...(87415): n = A,T,C or G
tgcatgggcagatgctcttgaagcataaactgaacttagtggaccattgtgcagtgaatgtgccctgcagccaccacccaggtcaagaaacgacacccctgcttctcagaagcttctttcggtggtgccccttagaagtgattactgccctagatgtcagcaccagaaactaacttctaatttggtttttatatgaatgtaactataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctggctcctgtaatcctcccctcttccacaggattgttaagccttatgcttgtctgtgggtctctgcatctgtttctgtcagttgctggatgaagcctctccatgatggagattatgctaggcagttaggagcactcttatggagatccttattacctttttgcctcatttctgttagccttctgaccagagtatgatcactgtgctggattttaataggttggttacattgtttctcaagagtggataccagtttgctctcccgggtgctacattgttactctctttattttaaccattcagagccaggtaaagggttgtgcaataggtacactttacatctgctgtgttatgagtgagatggagcatgtttagtgtgtgctttgttccttggtttagagatagtctttctatgttacccgggctttaaaatcctggtctcaaaggcttataccatcatgcccgactctactttttttttctaatttattttgcttttgtttatgattgctttgcctgcatgtatatctgtgatcccatgcattcccagtgcctaaagaagcggtgaacctccatgtgggtgctgggaattgaacccaagtcaacagtgctcttaaccactgggccaactctcaagccctccacagtgtactctttactaagactcatcacaaattaatttttattatgggttcaccatttcctcctatatgcatgtgcaaacacacacacacacacacacacacacactttttcttaaactatttaattgtaaacagtcagtaatggtcctttactgttgaatagctgaatatttgtattttctagaaaacaccaaccttctcttttatagctatagtacaattacaaaactggtcattctatactctaatatagctggtggataggcttattaagtttgcagatggcaacagttcagtaccacgatgagactatcttttctctttaaaaaaaattgatttattttgtctgtaaaggtgtgttaaaagcaagtactctcatctgccgactgtctccagccctgtacttaacatttaaaaacatttcctgccttagttattgctgtgatgaacaccatgaccaaatcaagttggggaggaaagggtttattcagcttatacttttccatcatagtccatcattgaaggaagtcaggacaggaactcacacagggcaggaacctggagccaggagctgatacacaggccatggaggggtgttctttactggcttgctcagcttgctttcttatagaactagggatggcaccacccacaatgggctgggcccgcccacatcaatctataattaagaagatgccctgcaggtttacctatagcccaattgttatggaggcattttctcgctccctcctctcatatgactagcttgtgtcaagttgacataaactattagcacacttctttttttatacaatgggcatggcataatatacttttgtgttttgcttatttttacttagtgtattctggacatttctatattgatttttattgcctgtgtgtgtatgtgtgtgtgtgtgtgtgtgcaggtcagagaacaactgtagaagtccgttctttcaatcgcacagatgcagagttgaactcagggcttcaggcttggtagcaagccatctcaccagccctctgtaccactatactgagttttctttctgtagctctatgatacactgcatgtataccaatgcagttcacactacccttcccaagtgagtgtgtgatcgatcacacgctgtctgtttttgccaacctggtatgtagcaagtactttaccatctggtttcttttctttcctcctccttcatttttaaaaatttatttttttgttttgactgtgataaggattttaaaactttttctaaactaaagttttgttttaagatttttatgtacttaagttgatcaagtctttgttttatgatttcagaatttttggttgtgcttagaaatgcatactttatttttgatatggtattcaatactttgaactcattctttctctactttgtgaatacacagttgacctatcatgatttcctataaaacctatgttttctgcattaattttaaagctacagtcaattatctttctatatagatcttttatagaattttttttattatcattataattttgttgttttgttacaggatttctctagagccctggctgtcctggaactcactatgtagaccaagctggccttggacttacagagatccacctgcctctgcctcctgagtcctgggattaaaagtatgtgcccttactcctagcttattattaccattattggggtgctgagagcgtagcccaggacctcataaagctagataagagctctcctcctgaactgcaccctcgcttttggattcttattctagcttactgattttttttcttgtgtgaattctgtgtgatcagaactacacattaagagtttgtgatttggtatcccagtgtgtattgactttgccataacccaaagactgggattaagttcccttgcacacgagttaaagaaaagaatatttaacagtggtggcacatgcctttaataccagcacttgggaggcagaggcaggcggatttctgagttcaaggccagcctggtctacagagtgagttccaggacaaccagggctacacagagaaaccctgtctccataccccccaaagactatttaacataataagggaaaaattagtttgaaaatatgattcaaaaatagaaaatattgcatttatataactgttagttggctaggaaacttgagatttaaaggtattttataccagagttcatggctacttttcaccagctgagacaagtcttaaagaatgcacatattttatggttaatgtcatttctccctttctctgtaccttattgtgtattttagttgtcaaacatatgacaacccttaattattagagtttaattctgtgtaaatgttaaaaaaaaaacccacctcattttacttttagctttaaaaaacttttatgagctggtatgatggctcagtggctaagagcactgactgctcttcagaaggtcctgagttcaaatcccagcaaccacatggtggctcaacaaccatctgtaatgagatctgatgccctcttctggtgtgtgaagacagctacagtgtacttagatataataaataaatctttttttaaaaaagaactaaaaaaagatatttgtaaaaattaaaaaaaaatttttatgagtgttttgcttgaatgtatgtctgtgtactgcatgcgtgtctggtacacacagaggtccaaagaggggcaccagatcccctggaagtggaatcacagatggttgtgagctaccacgcagttgctgggagtcaaagctaggtcctctgacagtgctcttagacactgaaaccatctctccatccccctctcttgctttttctttgggtgttgggatcaaacccagggctatgggtgtgctgtgggtgtgctgtgagtgtgctgtgggtgtgttgtggatgtgctgtgggtgtgctgtgagtgtgctgtgggtgtgctgtgggtgtgctgtgggtgtgctgtgagtgtgctgtgggtgtgctgtgggtgtgctgtgggtgtgctgtggtaggtgagcatactatgacttagtttcatccctcagtcttctgagtctttctaagtaaaacatcttacctttctctgttactgtaatacagcttcatagttgactaagaaagggtctactgctttaccaggagccgggttctgtgcccaccactcactccatgactggctcacaccatctgtaactctagttccaggggatccaatgccttcttctgacctttgtgggcacaaagctcaaatgtgttgcatatatgcaggaaaaatacccatcacataaaatttaaaaaaatacaaaaaattgaatgatgaactgacatttccatatgcatccctggtactgaaaactggaagaaactttagaggttagtcacatgtggaccattttaacttgtagaagtgaattcattatgattatttaagagtattgctgcagtcaaagatagtaaatcagtcagctaatgtatgccttcaccttaagtggagaaaaactttgagttcttttatttaaaagtccccccccccttcccccctaccccaccctggtctaagaggtggttggtaaaggcatttgcttccgggcatggccacctgtgtttgatccccaggccccacatagaggaaggagggaataggctcccggaagttggtctctgccctccacctgtgaactgtgttacactttgagtacagtaaggcacatacatgtgtacatacacatgcacacacattaaataaataagtaaatatataagcaaagtaacatcaagtaggttttcttcttttctataggtttttaacccctggtgttctcataaagaagtcactttctgttgctacaattaaacaccattaccaaagcagcttataaaagagtttatttttggcttcactttaaagtaatgaagattttcttgacccttagtgacaatttttagaacttaccacagtataggctgtcctcattgttgcctgtgtagttcattgaggtcatccctgttcgtgagtcatgtcctaaatgcaagtttattaagggtgactccttcctggcttactgaatgtggcacacgtgggcacacagcaggcatccataaagtcttttattgtatgtgtgatttggtatcttaggaagaccagcatgattccctgtatctataaagaggttttgtgtctgattttgtagcacagtgatatgctccttgtttactaaatgtcagaaagtcttaccagagttctttagagtaaaagtcaagaaccctgcttagtcttcagatacttaatcctgcttcccgtagtcaatgtgtgtttattttctcttgcttctagaccaagagcaatgatgaccttttagctggaatggctggaggagtaaacgtgactaatggtattaaagcaaagaaaagcacctgttcatctgcagcgccttcagcccccgcccctgccatgaccatctcggagaacaagtccaagatcagcacaggttcgggctcctcagttctgtgctcattgcctttgcccatgctagtattttctagcccacgttccccgctgtcccccacctcttccctgccctttcctcttccagtccagatcaaactccattgttagttctaatggtcctgtggtgtgattgacagtggtattttatttgatcttcagtgtagcttttgaagtatagagtatattttcctcattatagatctgagataactatgctgaagtttatcctaatagtcttgctaaaggccatctatttgtttactttatagaagtttcttggaaactccttttataccaggctataaaaggtggaacctggtggtggaacaagatttgagcctttagtatgttacttgcaagtcctactcacattttatttaatgccctactcatagggcaggggccttgagatggaactctctctagccagctcctcttttagggctgagctggggacattccagtgtacacaagtggtttcctgttgatggttgcatctaacctcagagttcatttattacctcctaggattggatattccagttcagatttgtatatctcagtggtttacacaacagatttattttattattcagtggtctctaaatcaaaatattggcagttgtgttttctcctaaggcctcccctgcttgcatttggctgcttcctcaatgtgtcctgacagtgtgtccctctgcttttgtcttaatgtcctttttatagacacaaatctcaccggataagagccaccctaacattcctgtcttagtcagtcttctcttgctgtgaagagacaccatgaccatggaaattcttacaaaagaaaacattttattggaacttacagtttcagaggtttagtcattatcatcatggcaggaagcatggcagcatgtaggcagacgtagtgttggagtagtagctgagagttctacatctggaccagcaggcagcagggagagagagacactgggccaagccttttgagacctcaaagccctcccctagtgacacacttcctccaacaagtgccactccttaagcacttaaatatgtgaacctatggtggctattttcactcaaaccactacacagcactatgtgaattgaattgattgattgaattactgtgtctacaaatagaatcacattctaggggccagggcttagacataatacctttcaagggacatggttcagcccctgcagcacccttgttcttcagttcattggctttctcattatcttcctgaggataccctaaagctgtttgattttagtgtgtaagtgaggctgctcatctgctttgagctgttctacctctcagttcagttaccagcaaggttgctgctcttttccatttttgtctgtccttctgttcctctgtgtatctttctctttccttaccttctgtggcttagtcgattcttgccttcatcttgatgtctgttccttttgttgtttagtcatccacatttttttttaatgagaagggccttttgtgttggtaagaatgatggtaccagccccaatgttgtagaaggctgtaccatcctcttcctccttggttatccttttatatttgtttcaccatcctcttttctctgcctttgaaatttgccacaggcttctgtccacttcatcggagtcatcattgccattgcttccattctccccagtgcataggaaaactttgtatcagtcagggttctcttcagaaactgaatggatagaatgaatgtgtataaataatacaatacgatataaacatgtatctttgtaaaagggcttattagaatggcttacaggttgtgctctaggtagtccaaacatggctgtctcccaatggaaaagacaggaatccagtagttgttctgaacacaagactagatgtctcagcagtctcggtctgtattagcattctcaagactgttcgaatcctgaagtggtgggttctcataccagccttggcaacagggtatatgacttgccagagagtgagggcaaggaggcagaaggcaaagctgccatcagaaggtatggcccatctcagatgatccagtctggttggcttttagttgtttccagatgtagtcagcttgacaaccaagatttgctgtcatagtcttctatgaatttcacagacgttcccttttctgtgtttctttcctgcttaggaatcttcattgacttgttcagtccctgaactctgccagtgtccaggcctccgtagaaacacccctgagaacacttgttgacggttctatcttaatatgtgtgctgtgctcacctctccttccttttctttgtctttggaccagcctgacttctttcttgtctaccccgattctttagtaaaatagaagagccaccatttctgtcagtgagtggctctagaggctataacttagccagtaggcaatatttgcctctttgtaaaactgtgttatactcattaattaaatttgttgaacaaaatatactttgggggaagagggttgaaatggagccttagtatttagtcccaatgagcctgggactcagtgtgttgctccttcctccctgtttctgcctccagagcattgaggttacaggcatgtactacaggatgtagcatgagcatttttcttaatgctttaaacctttaaaaacaaccggcacgatcattttacatgatgtaaaagaaatagaaaaaaaaaaaaaccacaaacaacaaaatattttttactttaagaaacaagatgtagacctgattgtgaggtcctgtgtcctcattcttacactcctgtggactgagcacaaggcctcacacacgctaagcaatgcgccactgcttgcctgcaaccccagtcctctctctccccttgcagttggaggcaggctgagttgtcctgctggccctgaatgaattctggttcacatgcaggtctggaatttgtgatctacttccttagccttggaagtagcttggattgcagcttgcacaccaccaggcccaactaactggagtatttttaaggaactgccatcttatgtagtggacaacaaggctatagagagaggaacaattttgtgatacaggaatgtggttacctatgggctgttagtgtttttttttttttttttagcagctctgcattaataatagaatgggatgaagatattgcacatgctgcacaaatacactgcttccctcccagcctgctctgaagttttcctgtgtgcatgtggaataacatgggagttgttggtactttaaagctttgttactacttatgtgccattatgggatcagaactttgtttgcatttactttggttatcactcttctgtttcttgtaggttgcccagattttgggtttattctgaggctggctttcctttcatagtgatctgtgctcgcctctcactctgtttcctgtaggtaatcacctaactggttgatcttagagtcatcctaactgagcctgctctggaatatcgcatcccagccagtatgcaggtcctgctcctgtatctgagttagtgtgcatatcttaacagcctattgagatatagtttatgtccataaaatttaccttgtgatgtttaaaagtagatgtaaggtttctaatcattgcttactaaaagatgatgtccgggtttcaaggtgatggactttgcagatgacctgttgcaggtcagatgatccctggtctgaaggcgatggactttgcagatgaccagttgcaggtctttctcaggattgtgcccagctttcatctcagtagcgccaggttcggaacacgtgcacttttgttgctaataattttatcttaaattctttgttttaaacatgtaggcactagttcctcagccaaacggagtacttcggctggtaataaagagtccagttctactagagaaagattacgtgaacgcacccggctaaaccagagcaaaaaactgccctctgtaagtcagggagctaatgatgtggcactggctaaacgttcacgcagccgcactgctgcagagggtgatattcgtatgagcaagtctaagtcggacaatcagatcagtgacaaagctgctttggaagccaaggtgaaagatctcctcacactggcgaaaaccaaggatgtggaaattttacatttgagaaatgaactccgagacatgcgtgctcagctgggcattagtgaggaccattgtgaaggtgaggacaggtctgaggtgaaggaaactattattgctcaccagcctactgacgtggagtctactctcctgcagctgcaggagcagaatacagccatccgcgaggagctcaaccagctgaagaatgaaaacagaatgctaaaggacaggctcaatgctttgggcttttccctagagcaaaggctggacaattctgaaaaactatttggctatcagtccctgagcccagaaatcacccctggtaaccagagtgacggaggaggaactctgacatcttcggtagaaggttctgctcctgggtcggtggaagatctcctgagtcaggatgaaaatacactcatggaccatcagcacagtaactccatggacaacctggacagtgagtgcagcgaggtgtaccagcccctcacttccagcgatgatgctctggacgccccctcctcttcagagtcagagggcgtgccaagcattgagcgctctcggaaggggagcagtgggaatgccagtgaggtgtccgtcgcttgcctgacagaacggattcaccagatggaagagaaccagcacagcaccagtgaggagcttcaggccactctacaggagctggctgatctccagcagattacccaggagctcaacagtgagaacgaaaggctgggagaggagaaggtcattctgatggagtcgctgtgtcagcagagtgataagttggaacactttggccggcagattgagtatttccgttcccttcttgatgagcatcacatttcctatgtcatagatgaagacgtaaagagcgggcgctatatggaactagagcagcgctacatggatttggctgagaatgcccgttttgagcgagagcagcttctaggtgtgcagcagcatttaagcaacactttgaagatggcagaacaagataacaaagaagctcaagaaatgataggtgccctcaaagagcgcagccaccacatggagcggattattgagtctgagcagaagggcaaagcggccctggcagccacattggaggagtacaaagctactgtggccagtgaccagatagagatgaatcgcttgaaggcccagctggagaacgaaaagcagaaggtggctgagttgtattctatccataactctggagacaagtccgatatccaggatctcctggagagtgtcaggctggacaaggaaaaggcggagactttggccagtagcctgcaggaagatctggctcatacccgaaatgatgccaatcggttacaggacaccattgctaaggtattgcccacgtaaacacgttcttgtttagtttatacagctgccatgtggagaacctgaagtgtgacgttgccttttaaaaaaactccttctcaagttttaaaacgcactaccttacgtgagtaagactttccttacagtactgtcattgtcagccgctcctcttctgtcatcttcttttcagaggggctggaggggctgggaaccatgcagccagacttccttctgagcagtagatagctttacatcctcgtctctaatgtactggggcataaggcaggtgctgagtcaggatctcagttttccaggattggcaatgtctgctgccttttgccctggtgtagtttttcaaatagcattttattgtgagttcattctacttttagagtagagttgctcctgtttcttggaggtacaggatttattgctggcaaagagcttagagatgattcttctagtccctcatctcacagatgttcagtgtacttactagtaaagactcagtcagaatggctggctaggttgctagtgttgttctatatcctgagtgatttttgaagtgaatgtttttgtacaaattatctattttttccacccacctttttaaaatgtgtatgtgttaatttatggtacatgcgtgtgcacccacagaggcacggaggatgttggatcccttgaagctggagttgcaggctgttgttgagacccttgatgtggatgctgggaactgaactgggcttgtccagaagagcaggggtgctcttgactgctgagtatttctctgcccgagtgtggggaagttttaaagggaaaggttttattacatcagttgttaaactttgaataacttaacttattttttatgtattttaatgatccctttttaaaaaaacttatttcatgtttgtttcaggtgggggagggaatatgaaagcatgtgtattgggggtgcattagtcaggacaacttgtgggagttggtttctcctatcatgggaaacttcaaggataggactcagctcattaattttggcagccaacgtctttacctctggagccatcttgccagtctgttagtgatcacttttagagatgtaattcaggagatacatgttgaggggcactgtgaactagtactttgataaagactacttgaaatgaaagtgttctgtttgtatgtgcttattgtgtctacgtgtgtgtgtactatgaatcacgcgaggagattggaggatgacttggaggctgttctctccttcctccaggaaggttctgggaattgaactcaggccccctggcttggcagcaagcacccttccctgctgagccatcttgttagccttaaatgtttttctggtttcatatttgatttcattttttttctattataaatactgcacttttataagtgagggtagcatgctaatcactcatcaaatgcacaacttaagtccaaatgttggagaagagaaaacgtcccccaggtggctcatagataacctggggaagttcagtgatgcatcagttgactttagtcagtgaggctttgggcttgtgctcagacaaaccaaatgcaaacctcgtgcagttgtagtgctggtccccagcgtggctaggttgtcagtcagtctgtccgtagctgctcgcacctcacttccatatctaacggtaagtactttggttgtagagtttatccccaaacaagtctccttttaacttctttaggtagaagatgaataccgagctttccaggaagaggccaagaagcagattgaagatttgaatatgacattagaaaaactaagatcagagttggaggaaaaggacacggagaggagtgacatgaaggaaaccatctttgaacttgaagatgaggtggagcagcaccgcgccgtgaagctgcatgacaacctcattatctctgatctagagagtaagtaaggcagtgagtgagagcgacctcgtgcgcaggcgctcaggctttgcccaccccacctctgcgtgctggtgctccgtggtgaaaatagcagttctgactagcacacagtatggacacagtagcacgctgacctaccgaaagacactttgacagaggtgtgcttcacaccttagtgaggaaactctgggtcaactatgttgtgttctcagatgttccatagaagcattatttgaacattgtatctaattaatgagaatctctgaaatgaaaaggctaacagtcagttattttccagaccataagaaaagccattaatttatttttagtgattgcaagtgaacagagttggaaaaaataaaataaaataggttaatcttgtagcatactgatcatggaacacaggtttttgtgtttttaaatttatttgatttttcttattattctgagaattttgtgtcatggtagaatgaaacctgcattttaaagtttcattgtacattgaatgaattgatttttaaactttaaaatttttttgtatttgtaagaaagttgagcaatcagatttttatatgaacctaatctattttctcaagaattgtttattgattacaggacagaaaagaaacagcaactccttatgcagtagggaaagctgagcagtgtttgggttttcatgtgggtcatagaggcatgcggtactgggcatagcacaagtgagggctgctctgactcaggcacgtgccagccacagggaaacagaccgacagcatgagcatgcgctggtagcagaggtgtggaggggctgcagccctaaagacatcagtgttgcaaaagagaaaggctatagaaaggtcccagataaaagaagactcaggagacaagataattagatgtaatgcccatgtctagacaggcccattactacaggggaaaatgatataaaggcattaatcaaacaccgagttgtggctaagagattaaagatatgctaataatacatttaggaagttgataattacactatgtttacataaaatatcactgttcttagaaaccacacactgagtttttcaggtgaagggctgtgattactatacccccaaggagttctgggaagaaattaggctgatgggtagatatagaaacgagctatgacagctgataggacaagtgagttgtattcctgctgccttttgtgcgatgctggagatgaagctcaggaccttgtccatgtaaatttcacattcttaccactgaactacatcctcacttttatatgcctttatattacagacctagagatagattgattggagtaggcatgtctgatgcattaaagtttttcagacaatgggtgtatgcaacactccttccgacactctcagttcatcatttcttgacaaagcaattatcatattgggcctatcactaggctgatggggacattgaagatacttgaagaagagcaggtcaggtgcgggaaatgttcaggatagaacttgggaattctaagttctggttagctgattgtgaatctggattgaccaaggttttgttgaacattctggggcccctattaaaatagtcagtggtgggactgaatttttttttaaagaagatggtgttgttgtgactgccatgaaatttctcatccacaacttaatccttcagggtggtcttagtgtctcatctgtggtccaatgcttaattgacagagttctaagctgtcttcagccgctataataaggtcttgtttcagagtcaaaaaccaaacaataagaactttcagcacttatatttagagttttaaaaaatatataacattttaaatttttacacacacacacacacacacacacacacacacacacacacacacacacatctgtatgtggactagatgttcaagaagcccagaggagggtgtcagagcccctgggagctggagattaggtggttgtgagcagtctgacatgggtgctggggaccaagctaggttcttctggaagaacagcaagcaatctgaactgcggagccatctctctgaccctggatttagtatacattttttatttgtgagaatttatttaattctgcttttttattatacattttaaagtatttattagcacatattaattttgcatgacagtgtttcgcttagacactttgatatgcaggtatattttgaccatgatcacattaccctgttgtctacctcctgcttctcccttcctcttctcagctagtgtgtgcacttgtgagttctgctagggttacttacaggaatgtgggtggatttttttttttttaatttgggctatttataggcatatagttgagtcacctgtagttatcctactgatgagaacacctcttcccccaaccagtagtactttataaagcttcaaagaggggcggggtaatttttcttcttgcctgtaagaagtgtttaagttttccagacaattccagagtgactttggaagctccttgtactgtccgttgggtacactggtactgccctgtttcccatgcagttagtccttgtggttttgctcatgggcaggagtgacatcttgtggtaactggagcattagctaggaagatgttaaatgatgaagatcttggggacagaacatcacaagtcattcatttttcacatatggattttaactagaaaatgacaaaaaaccaagagtaattaaaaaaatttatatagcttcttttacaattttttaagatgaaaagttcaaatgtacattagtattagaagaataattattacctagtgctattgtctttgtatgtatatgttgaactacttaatactaaccctatgatgtttaattcttaaatatttaaatgtgattcctaaaagaagattttactgagcacttctagcaaaattattcttagttttctagtatcaactaatagttcataattagatttctctagctgtcatcaaaatgtttctttatagcactgtttactcccaggttttagtaactccttttttatagtccttcagactgatccaggacctcatgctaagcaagctttctcctagccttagatattcatctatttgggtttttatttatcttagaccagctttaaactcatgacccttgtgcctcttagtttctacagttataagataataagtgtatactatacctctctctcttaaataataaccagtgtctaaacaaattttatactttatgttagatctctagtgttatattgcagttactttttctctggaatttgatggcagttaatttttttttctagaaaattctcacatttggagttaacccagcaaatgatacatgaatttttgttgtttgagaaagcaagatttcttctgtggaatattttaacaagcttagaacctcctagtcagctcccaaaaaggccttataatttcaatagtagtcgctcctcagtcaccccaagataaattcctgaccttggaattggtatgtaggactttacaaccactcctgagctcaagtatgtggaggagaagacagattgaagggacaagtgggaaactgcagagaaataaaaactacaaagcagaacaagtgtaaacgccttagcatttaaggtagaaaggtgccatgtaaactcagaacttcggttcagaacacggcttcagacccccacgcccttcctttccgtaaaagaagactagggatgaagtgtgaagcctcagtggtgctaatgctgagagtgcgagtggatgagtaattctgagtaacttgtgaagtgtagaaagcatagtcagaggtggggggagtaaatcagaacagaaaagcctgctgtccaggagaacagtgaggctcagaggaatgatgttcccagcaggctctgcgtggaagggatcatgttaccagaactgcccgctcaggactggccactggactgaggtcccccacgtacctgtctgctttgcttatttgcctctgagctcagattcttgtggataaaggagtagaattggatgccagggttctttgaatgaccttggtgtcagaaagggaagtggattgtgtctccagaatggtaggctaccgtgtggtctgggagagagaaccacatggagggaaaagtaagttagaccccgctgtgaattggacacccctcccagcactggctagggtccagtcctcctgttaatgtggcattgcagagcctttactagttgctgttccagagaagcctgtgggtgaacagtgacacctgcagttgcggagtgatgtccccgagttgagtctggggagctggctcagtgggtaagaacttactctgtaaatacgaggtcctgaatttgaaccccagaaaagaaaacagaaaactggacatggctatgcatgcttgagagagcagattggctggccagcctaactgaagtagcaagctttggttctgggagcgaccctgtctcaagggaataagagaaagggcacacacacacacacacacacacacacacacacacacacgttttcatattaaaagtatataaataggcaaatcagaaaaagtcagatacttggcatggaaaagaaataaaaagaaaacaatgccagtattcattaaacatatgtgaaagaattaaaagattgatagcaagcaagaagaaggaagaatattcttatgtgccattaagaagagtatgattgctgcatctttctaaggatgttgatacaaaattttattaaaagagtcagcagttcacttcaaggaacctgtccttagtaacagcattgtaggattatagatgtgcatatgggcttgtcgcagaactgcttgtcaccacaaaacttggaaatagtctgttatattttttaaagatatattttattttatgtgtatgaggtttgtgagtgtgtgtgtgtgtatgtgtgtaagtgcactgtgtgtatcttgtgccctgagagttcgtaaaggggtgcagaatcccctggaactgagttatggatggttctcagctgccatgttggttctgggaacaggacctggatcctctgcaagagcatccactgctcttaactaactgctaacccatctctctagtcccacaatctacactttcaataattgtaatctagtacatagcttgtgtacacagtgtgagttcccgttttcattgccattatgccagtgaggatggaatggacagagctcagtacactggctagaagatgaaataagccagctgcagtgcatgtctgtactttagaaccacttaaagcttcaaatgtaacatgacatgagaatggcagccagatacagtgatcctttaaaatgctgacttcattgtgctgttaaaccataagtgaactgataacctttcaaaacaaacaaacaaacagacagacaacccaagaaacttaacagtgttcttgaggtatacccttctagtgtacactgaattagcttaggttggtacttgcaaaggacccttcatcatttctacctttggaactttcctccacataatatctgaacagttgtgtaatgacttcgctgtattttaaagttggaaattatgttaagtctgttaaaaggagattttgaaaacaaattctgatatgttactttaataaattactctggggccatctagatcctactacacatctggatttactgataatggagtccattatttgctgcaggcttatgaaacagtacaaatataatctcattgtgcttaataaagaaaaaaaccaggcagatgtggtagtgtatctctagtcccatgtagtatgttgccgaggtaggaaggatgtcttgagcctctgcaggaatttaaggcttgcctgggcaacacagcaagaccaagttcaaacaaaaacccaaaccaaatggtacacactcacaaatctagaaggatgtaagtcaaatgcaaatcaaggcaaccttacttccttacaacttctatcttcattgttttattgtgaacatgtcttacttttagaattaagaaaaaagttatagccacattttttggagaatgggagaataaagatttggacaaaattaaaaaataaagtaaaactctatagttcatttgaaaaccatttgtattttctcccaggttctgtacacattgcccatctcttgtgacagattatttactcttgacttttcctttgctctgaaaataatatttaattcattttctgggaaatgctggaccagatggaagcagctgatggtagtacccagagagcttttgggctacagggatctgggtgagtttattaagtctgcaagaggaccatagccagagcctgagcccatggtaactgcccagtaatgtctgcatgattgtgggcatatgagagctagcatggctttctcttggtttgtcagggataggtcattggaagagagacagttaagaagcccattactaagcaagaagggcagtttccagaactattcagaggaaagttagatggaataataatgcaagtgcagtttgtcagatttctagaataaaaatagttctgtaaaaaaaaaaaaaaatggaggtttaatctgtaatttaaaagcaaggagataatagttcttgtttgtgataggatttgaattgaagacagtaggtggcagtgtcgctcacatagggaaactggagaggaaagcagctcatttgaagattcctgagttgaggtgatacttcctccttgtgtggccataggctgtgctagtagcagtagtctttaccaaaaacccaaagaccttagaaacccctccaatctcaggagaagtgtgttgccatttcttaactttctgtctcagaggaaaagtacggccgtgatcataaagttgaaatcacggccctaaagacctgcctagtacaatttatgctgtttaaatatgtccctgtctgccagctttccttttatgtaaaaaggagtaatgacaggcactaattcgtgtgcacaccagtagcaacacatgttcttgttaagaggagaggttgtgtgccttctgtggacatgaatgtggaggttgatggagaagagaccagaagaacaaagagagctgaagaaattagaattttataaccagtctaagatggccagtgcagttaaatgtgccacaaatcccggcacttgggaggcagaggcaggtggatttctgagtttgaggcaggcctggtctacagagtgagttccaggacagccagggtgatgcagaggaaccctgtctcgaaaaacaaacaaacaaaacaaaaaacaaacaaaagtgctacaaagactaagatgccatggcctaacagcaagtcctaacacaattggcagtctgaggaattatgtcttcctttacaagtatgtatatatatgaatgagaatatgagtgaatgagtgttttacctgtgtgtgtatgtttctcagataccctggggctagagttgtagacagttgttaggtgccgtgtgggtattgagaattgaacctgggcaggtgaattgttgtgactttaaggccaacctagactgtgtagcaagttgcaggccaccaagggctaaatgcatgttgtatcaaaacaaaataacaaaaactcttatacatgagtagactgaatgtaaagaaaaagtggaatttctagtgttctcagtttttgtcctcattctttgtatttgaatgtctgaacccagccatgcctgagctgacaaggagccagacccactgacttcagggttcccctgtttgtgttagcagagaacagggccatagactcgtcctctcattgtgtggacttgcctttcggactgggtggtctgtccagcttaagggaggcttctcacagggcagcctccgaagttggagagaagtcactctgcttccctcgctcaacttgcttttggcactgtgtccagtggagacattaactgctggctgctagaattagacatctatcttgttttatctcattttatccaacattcgaaaatattattgcttctaataatagtttgtactaatatcttataactgaagttactttgtatcatttttaatatatcatgagctcatgagagaagtgtttgtcatgcgagcctgagtttagtcctggaacccatagcggaagagaagaaccaactttgatggtgtcctctgacctctttacctgtgctcacttaagtgtacaatcaagtaatctctctccctctctctttctctcctctctttctgttttacacacacacacaaattgacttttaaaaagccgaatgtagtgatccacacttttaatcccagcattgggaggcaggtgggtggatctctgtgagatcaagaccaggctgacctacatagtgagttccaggacagctagagctacatagtgagcagaatgagatcttgtctcaaaaacaaacaaaagggttaaaaaatatgtatcatgacccaggatatgttcagtggttgaaaacctatgtgtagcatatgaggtcctgaatttgagagtgattttcattttatgtatttgtgggagaagagaaagactatgtttgagaatggagagaactatagcatcaataggcaaaatcttagtacaggattatttccatacataactgcctttcctggtgcagaactgagaagtgatttattcctgagctgtgagagtaatgagtgtgaccgatgtccagcagagcagttacaacgtgatatgttcctgaggcatttctcagaacttcttacaagcagagaatgtaatttcctattgtatttagtgctactattccatagattaattggcagctctctggatattacaatcaatgttaaaaataattttactgatttcatgtttctggaatttattccagtgtgaaaggggagttatgcttgcacggtttagagtgataacttctgtgattaaaagttgacaatttaatagcagtcaatgctgttttggttggcgttgtgccaataatatgtatgtttccaacaattgcttccagtttacttaggaaatgatgcagaaactgtagtcttggattgaatattcttttcatgcttttaagttttgtgatgaaagtaaacaagtttctgcatagggaaacgatttagatgatcatatttttatcacctctttttatgtcatttcttttgaacatttaagatcattaagaactttaggtttaaaaagaaatatttaatctttgtggtcttttcagatacagttaagaaactccaagaccaaaagcatgacatggaaagagaaatcaagacacttcacaggagacttcgggtaggatgaatcttcatgtgctgtctcactagaaaacatggtattctgacatttgtactgttactttagactgtagatagggtaggatatcagccacactggactgaaagcaagtgccattattttaaattgggactggcactgcttttaaagtaggagaatgtactggtagttatttatggaaagatgtgttttaaaaataaagtttattaacttttgattttaaaatcacagagcaggctgtttgtatgtggggtttctgtgttctctgagttgggttggctgccagcatccatgctgctaagatgtgcagggacagtgctaatcatggaccctgagtcctgacccagttgttggagctgcgggtaccagaaaattgctttgagaatgagagggctcaggcaaggcccagctgtggctctgggggaagtgaagcccctggggagaggtctccgcccagccacacccgtatccttctgtctgtgggaagcggcagagtgctcagttccttatgcctctttgtatgactgtgtctgcctacactaagttcagtttttcttctggcttcctcttccttttcctttactttagttttttttttcctgctcgtttttgatgtcaggatatttatagttttttactgtgtggttcacataccatttatataccttcttgagagttccagaggtaaagctctaaatttttgatgatatttattttcataacacttgctttgaaacttgcatgaggaagagtagcctaaaatttttcctcattaatatttattgagcactctgaatacttaatgcctcagtaggaggatcagatggcaaatcttctctcattaagaacaagttcactgataaagagttgctttgttttaaaaatagcagcaattcttgggattaaaacaagtcgtgattcaagagtctgacatgttagggcaaactaatcataaactttattgcttttaagtaaatcttcatcgctttgttttggaactaagagtttagtgttttaatgtaggaagagtctgcagaatggcggcaatttcaggctgatctccagactgcagtggtcattgccaatgatatcaagtctgaagcccaagaagagatcggtgatctaaagcgacggctacatgaggcccaagagaaaaatgagaaactcacaaaagaattggaggaaataaagtcacgcaagtacgttctgagacaccggttgtgtttcagtaaggaacaaatgtggccctggtgctgctcttagtcctgacactcgctcacggtgcagccctcttatttctctgtagactggaggtctggaagcaggctgtctggccctgcctcttggtggctgtgtgctctcagttaacagtggtcatctccctgtgccccgtgccccgtgcctcagttctctcagctgtaacatggaggcccgtgagctactttatagtcctctcgtgagtaagagagctaatgcttgtagagggatgaagcagccagcagtaaacttaagttaccaatttggaaaaacagtcgatcagtacagtgtaagtttctttccatcactcacttgaggaagttcctttttttttcaaagtcctccaaattagtaccctccacacagagatcactggaaattcataaaaatggccacaggagattatacctgtgatatgttttgagttcccacagtaacattccatctgagttggggaatgagtttatgtgtcagaaatgcctcatttgatagttaccctgagtttagaagttggttctgtctggccatccatccatctatccatccatctgtcatgctagggattaacctagggccttacatctaccaatcactctaccactaagccctaaaactctgttcttgaaggatcattccatgggatcctgaaagtttactagtctttatgtttcaaggagatgcctaccaaaagacgcagcatcttgggatggagaggtggaagtggttaagagtacttcctgcttttccaaaagatctgagtttagttccagcagctcaggactacctgtaactccagctccagggaacatgttgctcccttctggcctctgcaggccccacacactattaaatgatgagagagccatcttgtactgtgctgttgtcgtcagagtgatggaactttcccaggctccttgcacttagtcttcataataatactaaccggaagttgatggtttgcactgatttttgcattgatagtgaagaacaaaggtaaacttggtgacccagggccttcgtatcaaagtcaagctcattataacatgtgctaactttttgttttttttctagtgcaaaactgcctaacaaaacatgggtttcacttaaaatacccttgttgaaaggtttaccagatcccagccctggagtgccctgtttctaaccttccatgtgataagtggaagtgtgagccggcacttccgctttaaaccctgtgtccaggtatgaggtggctgaggcgagcaccgtgctggcttcagtctgagctactttctcctagtaagtgatgtggtcctgtccattaaggggacagctgctggtatttgctgatgacgaaaagtcggtcttaaaaggagcctgagacagggtctctctgtatgtaacctggctgttttggagctcactatacagaccaggctggccttgcattcacagagctctacctctgcctccacagtgctaagattaaaggcatgtactacctcacctggctaaatgcattcttttcaaaatgtaatgggctagagagatggcttagcggttaagaacaccgattgctttactgtagatcttgagttcaattcccagcaaccacatggtggctcacaaccatctgtaatgggctcctatgccctcttctggagtgtctgaagatagctacagtgtactcacataaaataaaattttaaaacagaatgtaagaaaaaaaagtttcttttaaagaaaaaaaaaagggggggggatggagagatgcctcagctgttaagagcactgactgctcttccagaggtcctgagttcaaatctcagcaaccacatggtggttcacaaccttctgtaatggcatctgatgccctcttctggtgtgtttgaagaaagtaatagtatacttacatacatgaaataaataaatctttttttttaacataagacacattattcttaacagtttttgaatttggaaaataaagttttttttttataaaatatttttactgtctttcaaacagtgtctcattaagacagtaaaatgttttatggccttaactgactccatgagctttccgagcccgttggaggcattctctggagatacagtagtttacctcttcttaggaagatgggacttctggtcttactcctttgtgtgtctctgtgaagcagtgtttagctggatccagcatagatgatctctgctagtgaattccctcatgcctgagaagggctgcgccttactggcagcacagaaccagagattcccagttgcgtccggctgaggccggtctgcctcctgactgactgctaattgattactgttgtcctcacctgacacttaatgcagatggaatttgatggctatttaacttgcttaggatcacctgataggaacatttcagtatcatttcctgctgtctaccaggcaaataatattaggtcaggcaattgtgttcaactggtacaattaaaaaagctaaaaaacaaaaggcaaaagcaaaaaccaaaccctaataacttttaatgcttttcagtcagaaatttttaaatgggcattttctcatacatgccatgcctttctttattttcctgtttttaggcaagaggaagagcgtggccgggtgtataactacatgaatgctgttgaaagagatttggcagccttgaggcaagggatgggactgagtagaaggtcctccacttcctcagaaccaactcccacagtaaaaaccctcatcaagtctttcgacagtgcatctcaaggtaacttgattatgtgtgtgtggattgcaaggcttatggttctgctcacatgatgtatcctccttgtctagttcggtattctatatcaccgtacgccgtacgctctgagtttcatcaggttgactatggtatcatacagtgccatatagcatcacttagtatcgcatggtatcatgagttaaggtccattctgcagcgttcagaatgtacctcagtttagaaatcctggtctcagcagtttgccttacttcccaggccacccagtaacttttctccctaggtgggtcatactcattcctgtgacttcttgtatcttctttatgtgcagacttctggatacataacgttagctcccaaccttcctctgaattcctcaatcctgtatacccaggtaccttgttgacactgacacttgagcatccttatgccagaccagatctcattctctgcttcttctcttcattgttccccatctctattgtcaatagagttctacccagttactgagaccagaaacctaggaacctaagctaacgtcttttcctcactgttgagcctcccccatgagcttccttgttctcttctctttcctcatctctagagtcaaagacaagagttcaaggcaccttcgactattaatttcagtaaatttggaattagtctcatcttttgcctttgagagagtttttcttgtctaaaatcctggataattggaatgaagttcagatcaaagttctgtaacctcaggctcctcttctgtacactgcaagctagactcttgatgatctagctcttccagcgtgaaccctgaagatatatctgcaatctgtcataaaagctgtatactgtctctgtttatatgtctttcgctgtctctctgtctctgtttgtgtgtgtgtgtttgtgtattcatattggttattgagatagggccctactacgcggcccaggttgacctagatagagtagtttcaacttgtgatccctctgcctctgcctctgaagtactgaggttataggtgtttgctaccttgctgcctcttagtttcttatagaaatagtgatgctagggctggaacctagggcctcatgcgtgctataatgctgttccaccgagctttgccccgtcctctcgttttctttctatcttagagttcattgccttatgtagtattttagccaaacattgtgattaaatagcagaagtgaagtgctggcctagagcagcaaccattcgtctggttgaagaaattcctgtgcaggacacattcctgtaccatgctgtgtctatccttaaatttcccatttgctcttttcctagtaccaaacgctgctgcagctgcgatccctcgaacacctctgagtccaagtcccatgaaaacccctcctgcagctgccgtttctcccatgcaggtaagagcctaggatcattgaaggtgcagacagctttaaatatgcatgttagatcctctttcagtcatgcacatgtctcaggtggacagatgactgcctcagagggatgtttgttagatttgcttggtaaaataccatgagtatgcttcattgaggcaaattacaaatgtaaattgtgatgctgttttggaagctttgatctctctaagtctgtaggtggcacattttatcttttgctgtccaatagaccatttggctggagagatggctcatggatctcagagaggacctatgatcagttcccagcactcattgggagacctcacacaataccctatgacttgagctccttgggcgtatctgacccttttctgggcctccttggcacgcctgaatgcaagcacacatatctacacacttgcacatacacagcccagagctaaatgtcagtctactcaaggcatggattgagagaagtgctgttcgttgaaggccatttgtcacagtcaagctcaaagatatgaatgctgatccattataaagaactttgagaattgctattctttgccattgttggagtgcacccaggagcagggcagagggctgttctctgtagtactccagagaccatcttgttatgctgttttctcagccactttcagaatatggctgaagcaaaatactttaacatgggtgagagtagctgaactagtgttttgtaaatacgggtagcagtggcttactccctaaagttaggccttgggacattttcttttttaattgacacttcatgattggccctgtgatttgtgagtggacttttaaactctcacagtctaagatagatgcagcctctcagccagtggcttgcatttcatgtttatacaagatgtcttcttcattctaaaggaaggcaaggaagctccgtgttttgcctgttgatttaatgctttttagatgttctttattaatcagatttgaaatctaaaggtacagagcaacatgccaagtaagacaggcctcaaataagatgaataatgtgtagcttctgtttctttgtttgttttttcagacatggtttttctgtgtagtgctggctatactatagaccaggctgccttgaactcaacagagatctgcctgcctctgcctcccaagtgctagaatttgaggcatttaccattactgcctgaataggtttttttaaaaacttcatggacaggaattcttgttatgtggttacaacaagagttgtctcaaacacaaatggaaagctgggtaaaatgtaggaagccattgttttcagacattgcactgctgtggttcctgaaaaacaatactgacagatgagggaagtcctgctggggctctctttttcctggaggcagtttctaggttgtggtttagggaggacgattcaacttggaacagaaaaggatacaccagttagatctgaggctacaaagcaacattcaaggaaaatgaagttgctagactcttcagggcatagctgcctttcctgattggagtgaagccctatatggcctggcaggaggacttttcagacagatgctttctgtagtttatacagcgtagggaatcctgtgattgcatatcagccactatgaagaacctccttgaacagataaggagataaagtatatctagctagctctcgagtgcttgatagcctaggtctgcccaaaagactgtaaaagtaacttccaaaaggattaggagagctataaataactgtcgtgggcagtctgtaactcccagtgagtcaggtactggtaggcattgtttgtgtgctctgctcttgttgagtgttggctggctgactccatggtttgtttctaatgaatagagtatagcagcagtaacataatggcacttcccagagaaggttataaagttggcttctgttgagagtgctcctcttaaattcactcttcttgctacttagattcacccactctgaggaaaccctctgtagttgccacattgtgagcttgtttgtgccaaggaccattgagtaatcttagaattggctctgagcctcatcaacaaccgctgctgacaaacttgaaatctggagatttcccctataccttacctccaatctatctttgtgataactgatagctagatttgcctgctcactgaagacctggagctggagttaactagctaagcttttgatccagagaaatcatgagatcataagtgtttattctttaaagtcactgtaaaatattggggtattttgtcatacagtgtacataattaatatagtaggttatttctgctagttacgactgccagaagaacaacagtcttacaatttttaaatagaatccaataaaataagatgtagttttatatttatatagaaatgcaaaaggatttgaatatgtgaaaacatttggaggatttagagtacttgatttcaacatttacagcatgacattaacagtatgtttcattcaagagagatcagagagtggatagaggcctgggatagatgagctgacttcagcacaactgtcagggttatttagtatgagggtagagaaagtgtatgacatactgagtttgaccagtaggctcaaatgatggcactgtacataaagcttatagacaggaacagtagtgaaaatatttgtattctttgagcatgagaaggcttcttatttaggacacacacacgaacaaatgagtcattaaacaactgatatttgggtgtcaggatttttaaaatttgccctaaacacatggcaaataagcaaaggcataccatgcgtaagagcatatatttacaatatttacttgttgtagaaaagacttgcatgcagtaacttgaagacagcatgtactaaagggcaagtgatttatatgtaagcatatgcaagggtggtcagcatcagcagtcaccaaggagatggaaatgaagttcacagtaagatagcagtacataccatgggcagaatgaaaggtcagcggtgtgaagatgtggagaagctggccttttgcagagctcttacgggaaagcaaaacaagtagctggaggttagttagattttagagagatagggctgagggctggggtgtagaggcagagagtttgaggccagcctggtctatacctagcaagttccaggacaaccagggttacttagtgagattnnnnnnnnnnnnnnnnnnnnnnnnnnnnnnnnnnnnnnnnnnnnnnnnnnnnnnnnnnnnnnnctaatagcacttttgtcaggggtgctgatgaaaggccacagcctaatccagggaagttgtcaaattattgagtaggaggcatagttgaggtctgtttggaatggggacaagaaaaaacaataaaaccactatagaaacatttccatatttcagtttggaacttaattttgtatttagtaaattagcatatggttgtttaagttctttaagcagaagagttaagttttattcagagtgccaggggctgttaggatcagtggtatatgttactataatagggtcctaaggaagtgtctttgtgtagagggagtgtccttgccttgactgtgccagtattgtgatactaccattaaaggaaaccaagtgaaaaggatgctggctatattatttcttaaaaccacataggaatagaaatgatttaatttttattttatattcattggtgttttgcatggacatttatctatgtgagggtgtcatatcccctagagatggagttacagaaagttgtgagctgccatgtgggtgctgggaacacgagtcctctgggagagcagcctgtgggtgctcttaaccactgagccatctctttagccccaaggattttttttttaatctacagatcatacattgtatgtgtctattatgtgtttataccttaccacagcagaacaaaggaattattcattgtttataattaaacatctactcttggaagcctctgtttttttctgtgattctcaggactagactttacatgcctttgctttcatttcagagacattccataagtggtccaatctcaacctccaagcctctgacagccttgtcagataagagatcaaactatggagagcttcctgtacaaggtacaggtaacatgttcatatcatttcactgttttgttaatttttacattctttggctaattaacttattttcttagtgctggcattatgctagctgatctggtatatccaaagtgtttattaacatgtcctaactacaagtagggaaatgagttattgttcatgaagctttcatgacatacttacttttttcttgtgttttgagacaaagtcttgctatgtagacagactggccttgaactgacttcagggtcttcccgcctaatactttaaaagtgtggagttatatatgtgtttccccttccaggctgatgccttttaagttatagtaagtaatacagagtatatgccactgtaagacactatttcgcagctctcaccaaaagtgtattactgtccttcccatctttacagacattgtcagaacacataaggaagttaagatccaacaacatgcatttgtagactcacatgttaatatacaggcatagataaagtaaaacaaaggaaaagacttaaagacagggcaggaagactgagttttaggcaagcctgggctacacagtaggaccctgttttagtataactataaatgtagaccattcggggttaccatgcttattcatgagtctgaactaaagtctgccatcttggtaaatgttttcttcttgccttgtcctgttcttttaccccctctattaacattgatacactttcttcttttttttttgttttgttaagacagggtttctctgtgtaataatcctggctgtcctggaacacactctatagaccaggctggccttgaactcacagagagcctgcttctgcctcccgggtgctgggattaaaggcatgcaccaccactgcctggcaacatcctattttttaacttaaaattttttattgggaggctcagttgttaagagcactgactgttcttccagaggtcctgagttcaatttccagcaaccacgtggtggctcacaatcatttgtaatgggatctgatgccctcttctgatgtgtcagaaggcagcaacagtgtactcacatacataaaataaatcttttaagaaaaaaattttattggaaatggaaagatagctcagcagtgaagagcacttgatgttcttgtagaggacctaggaccagttcctggcacccacatgggaatggtaaaaatgtatgcatgttcagttggtctctcctagtttgttttcttgtacttttcatcttccacagaaattagaaaaataagacaaactgtgagagtcattctctagattacttcaactgaaacaaaatcttgctgcccagagggaccatgtgggcatttgcactacccacatgctaccactaatgcgtgcttacctttcactgtttagaggtcacagaccctgctgaacaccctccccttcacaaacaatcccccacaaccaaggtctctacagccccaaaactctatgtgtgccaagtgcctgcagaggccagaagagggctctgggtccctggaattggttacaggcagttagaagccactttctactctcttcaacattcttttctcctttcttttaaaatcagaaactatcatctccaatgtgtctgtccatatacttctggctctgtggccatctcctgaagcatggtcaatgtactagaagaggagctagacccttaaaaatcttggctccccccttatactcatctccatctctggttttgtttttaagaaagtagaaaccatacttaggatagtatagtgtgttagattacctgtgtgtgtgctgttgaactatgcagcatcctcccattgttgggaattcaacttcacagactgacatcttggctaattgaagtcaaggagaaagggagtaggcccttctcaggctgcctctgatagaaaacaaaccaaccagcctgtttttcaagagtggggatttcttgatcttttctggatgtctcagcccagtctcatcagctggttcccagaattattattattttttcttcccatgaatcctttactcacagaatggtggttgtcttggttctgctctagattccgggttctgtgacaagcaagtttcaagtttgttttgttttgttttggtttggtttggtttggtttggtttggtttgctttcttctcctttctttgactttttcagtaagctcactacccaacaagtagtagatgctcacatgattttttgtttgatgaatgaactgagaaacctgcggggtttctcagcaggcagagatgcctgactccacatctgaggacctgacttcagtacctgaacaaggtcaaaacttaagactacttaaaaaataagagcaataatagcctcggatatcaacacagtagaatttatcattataaactataacccgtgagtcacatttcctgaagagggctgacccaactttacatgaagacaaaacccagcctgctcactgcagacataaatggacccgtgccgctcttaccttgggtttctggaatgacaatgtgttaagaaactgcccatgtcctgctttatggctgcccagttactacgggtgcttttactttttgcactggggctggagtctagggtctttctcatgcctcttaagcagcactgtggaactactcctacatataattttaagaagaataacgtatccaggtgtggtgttacatagctataaacctaagacttgggaggttgatgcaggagaatagagtttgaggccagtctgggatatagtgagctcctacctcaaaaaaaagaaaaaaaggttttggtacattttttcaggaagggcagctgtattatcagggactgtctgctgaaatgagacagagaaggaccttcagatgcactatagagagacaggtggggtgcagagcctggcgctggccgagtgagcagttcccagctgtgtgcattgtagggctaagactgaataagggggcgattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcttcatttacatttcaaatgctattctgaagtcccctacaccccccccccccgccccactgctccactacccacccactcccacttcttggccctggtgtttcccctgtactggtgcatataaaatttgcaagaccaaggggcctctcttcccaatgatggccgaataggccaggcaccggcatagcctcacaagagacagctatatcagggtactttcagcaaaaccttgctggcatatgcaatagtctgcgtttggtggctgattatgggatggatccccaggtgggatagtctctggatggcccatcttttagtcttagctccaaactttgtctctgtaactccttccatgggtattttgttccctattctaaggaggtatgaagtatccacaagttggtctttcttcttcttgagtttcttgtgttttgcaaattgtatcttgggtattctaagtttctgggctaatatccacttatcagttgttttaccttcttaatttgctatgttgttctttggaaaacttaagatttttaaggaaatgatactttaggttcataattgattcaatttaaaacattgcttataggtctagagagatagtccagttggtcaaatgctttctgtgtaaacttggtttgatggccaacacccatgtagaatgccgagcaaggaggtgcacacatgtaagtcccagcactagagaggcagtgacagtcaggtccttagtgctcactggcaagccacctggcctaattaacaagacccaggcaccagtgagagacccttttctcagaagccaaggtagatggctcctgaggagtgacctctggcctccacatatgcatacacacacacacacacacacacacacacacacacacacacacacacacacacacacacaaacgcacacacgtcaataaagaaggaaataaaacattgattcctgtttctgttctgtcttttagaatttgtatatgaaatattcttcctttaaaagctgataggatttgggactctggttgatgcttgtaggctgtttatattaaagtgtttgtttagtcaggtgtggtagtacatgccattaatcccagcactcaggaggcagaggctggtggatctctgagtttgaggccagcctggtctatagagtgagttccaggacagccagggctatacagagagaccctgtcttgaaaaaccatccaactcaccaaacaatgtttatgataatattcctaatgattttagccacatatatccttatgtagaaaataagctttccttcctatttcctaggcctcctaagtagaaagtacctctttttatttcaaactacaagttcctaagactcttgcaaacgatttcttgagggctggggaggtgactcaatgcttgagtatgtactgcttttccgaggactttgaagcagtagtattttcatttgctctaaactttccagcgggtgcacacctgcttctcgctctactgccccaatgttctggattccccaaagaaagaccacatacacagccttatattttaaatacctttaacagctcaatggctaggccattccctaactccacgtggctaacacactcccctccaatattcctggagttaatccttatcaaatctatattttatctttgctgccctggaccctactggtcagctcaccctcctggggctgctttccccctgcacctacatgtcagctgtctctctctctctctcctgtacctttctgccttggtccatctcctgttccctcatcatggcggaatcccctcttcctcctttcttggtccagcctctctctccctgcccagacattggcctctggtaaatttattgaccaatcaaaaaccaactagggacactgcagataggtttttgggtaataaaattagcatgagaacacaagctcctcctggatttgagtgtgatttccagtccccatgttgggtggctcataacttgcattaattctgcctccagggtacctatactcaggcatgtgtttatgcacatacagacacaattaaaattacaacagatcttttaaaaaagaattattgggactaaaatatgtgatattctaaagacttagtactgtatgccgtattttttgtgtgtttgttatttgcttgatgttggcagtcattgaacctggggcctcaggcatcctaaagcatacgtaatcattgacctactaaaagaaatgggtgggcattcttggaatgtaaggctaataatagtctttattaaatacaggcattattgttgagttttatactagtcatttatctctgacatatgaatcctggctaggcagaacacatgcactcatgtcttttggcttgagcacagcctgttgagttcgtaaccctagataagacgtgtgcaggaagagagagtgagcaggacagaaagattgcaccagtgttccaggaactaaagagactcctaagaaggcttgtgggtaagaaccatgctgaagccgtaatagaggcgtcatctgattgtgtcattcctggctgctcagcagcaatgacactagactagtcctcagccacagatgaggtagtgaaagctctcagtgtcacccnnnnnnnnnnnnnnnnnnnnnnnnnnnnnnnnnnnnnnnnnnnnnnnnnnnnnnnnnnnnnnnnnnnnnnnnnnnnnnnnttgttgtttggctgaaatgcagttcccaggccttctttctgggaaagcccagcctactaccactatggttttcagcccttctctgctgcctgaaataagaatcaactattttccttttttggctgtctaatgaaattctaactatatcgtccaggtctgctgatggacacttatatatatgacgttccctctaactgtaggcacagaaaagcaaggttttatttagttgatgccttaggccaatgtaataaggaacctcttaattttgattgaggtgctttaaagagtgaattaaatggcaaaaatgacttcgaaagagtcacctgcatggcatgtctctctctcatctctagaaatacattgttgactggaggcccgtatggtcctggtctatagagatttacttttagtaaagatgctgtttgtggttgagtgccttggattaggaggagagacgaacctgaaggctaagaaaagtaagagtcaccttccctgtacttctgccacctcagcattcatccatttgcttttgtgacctttccactttgtgcagagcatctactaagaacatcttcaaccagccggcccgcctctctcccaagagtccctgctatggaaagtgccaagaccatctcaggtaatgacttttatctgaaaaagtattaaaaacaaaaacaacaaaaaccttctggaagttttcagctgcccacattgtaatagatgacatgttgaaggtatatctttctgaaagttgagaattagatatgcaatgactgatttgaagaattagtcaaaacacaccaaaaatccctggaagctgcttgcaggtatgctaaatcccctcccagcgtcagcatggaggctcactgggcttgtctcagcatttcacttgctgctgacaatactctccctgtggcctttcctgacagcgctgctgtggtctgtgtgctgtcctccttgacatggagtgagcacttccctctgtcctctcaccctcgcttcccgaggactgcagacaagggttggcgtaactcacataaaatgttgtctcatctttaagacatacaatgcacttgaaaaaacaaaaaatagccataaaattatgcttaaaaacatgtaaatacggcactctacagtcatttaatatgagagagcatctgtgccttcatgtggctaatgctgcgtgtttctcctgatttcatccagatcttgttagccagcccggcctgggtgtggcagcacagacctgtgttcgtgtgcagaggctgaggcagaaacactttggagttccaggacggtttatatccagtgtcagccttgcagaattaacgatggttgacttgataccttttcctttctgtgtcctggtgtgtgtttgaagctgcatccagctctgtagagatgcccctttccttcctcctccctttcagcagtgcttgctgcacttggaggggtgtgttttctttagttgtgggactgggcagggctgggtagatgcgcatactgctttggttttgagttgtgtttgggtagtcctcactgtgtaccaggtagacactgtgaatgttacatattaataaggcacttgttcacctaagatttgatatgctctgtatttccactaccaatctttcacagattttagactctttacttttttatgataatgtctcattcagtagtccaggctaacctcatgttcatagtaggcctcctgcctcagtttgaaagtacaggaattgtggacataaatcactgctgccagctgcatgggtgttctgagtgaaaactaacccagtcatgagtgggttcaaggagtagctcttcctctcacaggagtctttaggagtcttgagaagaaattctcaagctcacactaaaacaatttaaagcatgtatattactctatacttttaaaacatatgcagttgtaattgtcaacatatatactacatttaaaaaattatttgacaaagcatttcttttctctaacaaaacaatctaggtgtcaaaaataaaataactcttgtcttagtcagggtttctattcctgcacaaacatcatgaccaagaatcaagttggggaggaaagggtttattcggcttacacttccatgctgctgttcatcaccaaaggaagtcaggactggaactcaagcaggtcagaaagcaggagctgatgcagaagccatggagggatgttccttactggcttgcttcccctggcttgctcagcctgctctcttatagaaccaagactaccagcccagagatggcaccacccacaaggggcctttcccccttgatcactaattgagaaaatgccttacagctcaatctcatggaggcatttcctcaactgaagctcctttctctgtgataaccgcaacttgtgtcaagttgacacaaaaccagccagtacaactctcaatctaagacattttatccctagaattttcaaacctgctttaattgaaatagattttctactatgaattcagattataatttcttctccttcaacttttccagactctccccacttccccaccctcccaaattcacactcttttttttctgtctcattagagaacaaacaggcactacaactactactgtaaaacaaagctagctggaatagaacaaaacaaatatggaagggggagaagagccaagaaacatataaacacatgtaggatctgagacacacaaattcttatacacagaaatctttccttaaaaaagaatatgcattgtatttgttcatagtacttggtaccatgtcacataggacttttgtacaagtataaaaagttgatcatatctccatcttcttcccacccctttcttcacttctctgtgttcccctacacagttgctttttcatatgtatttacatgattttatgacctgtatagcatccaggagccacaagtgagaggaaacatatttgtctttgtgagattgactgagttcgtgtaaacagtataaaatattgggagatggtctcattagagtgcacgtccctttccctacagtgatgaaagtttgttctttttggcatggagaaaaaaatccactgtgtgcacatgcacagttgctttgtcccatcctctgttgtgaatcctagcttgcttccatgactcagctcttgtgaatagtgctgcagtccacattgaggaaccagttcctctatgatgccttgatttggatagatgggagttctaattttagttttgggtgaaacctccatagtgagttgcacagcagttggactagtttatattccacgacgactttctcacagtgtctcgacggagtagtgaagaaatgaaacgggacatctctgcatctgagggcgcgtcaccagcctctctcatggctatgggcaccacgtcaccacagctctccctctcttcctctcccactgcatctgtcactccaagcacccggagccgaataaggtaggaaacatgttctgtgtactgtccctagcctttgagagtgaagggcctgcttacaagtcagtgctgactgtccccctttctcttttcctgttactcagtgttgacttttgttttgtttgaaactagaaatggctcagtaagtgtagatgagacatcttaagtctgaaaactcaagtgcatgccttttgagtagcaacattaaagcttgaacatttcagactttgtgttttcaaattagagatattctactggtaaattctatgcagatacttcaagatcaggtacttgcttttggggagagtgttgctcagcaacacacacacacagtttagatgggaaaaaaaatcaggaatttatcatacattgtaggaatgaggaaaaacttttgacaggtaaaagattaagaataggaggactagaaagggtttcagaaacgtcactgcatgttaatttctaggttttaaggataaagtgtagcacttgaccattcaaactcaaattatgaactttaaaaaaagattattgcagagacaggatcttactgccttgaactttagattcttctaccttagcttcccaggtattgagattataggtttacatcacatgcctgttatatgaacatacttttcgttatatttgtttattttttaattgtctttattttcattttatgtgtatgtttttcctaaatgtatatctgtgaaccatgtgcatgcagtgctcccagaaaccagaagagggcattggattccctgggctattgagtggttggtgagaatcaatccaacttgggtccttgggaagaacagctgatgctcttaacctctgagccatccctccagctccatgagctaacttttaaagctgtacctcttgtgtgaccaacctctgaggagtgtatacccatacactcatttatgtagtgagtatgtagcagtacattttatgcataaatagacagtgcagggccacagcagcttggccattttgccatgccaaagacttgctaggcgcagtggaccacatatgtactcttaggactcaggaagatgaggcagaaaggtgaactcaggagtttgagcccagcctgggacacagtgagcttttatcttaaaaactcagggtatacagtttagcacatacttaatatttttttagaagtgatatatgggtttttgttttgttttgttttgttttggcaatggtggagattgaacctaggcatagtctaggctggctggcttccttcccccaacccctttgtgatgtttgaatatgcttggcccagggagtggcactgttaggaggtgtggtcttgttggaagtggtgtgtcactgtgggggtgggctttgagaccctcctcctgactgcctggaagtcagtcttctctcagttttctgtggagcaagatgtacaactctcagctccttctccagctccaggcctgcctggttgcttttttgctcccaccatgatggtaatggactgaacctcagaatttacaagccagcctcagttaaatgtcctttacaagaattgtcgtggccatggtatctcttcacagtaatagaaatcttaactaatatgctatatatttatctattttgaggcaaggaactttcaccaaagcctagacaggtcttgaacttgaagtcttcctgctctcacctcagaaatgatggggaatggtgggattacaggcctgccccccccaggctagtctggtgggaatggtgggattacaggcctgcccccccccaggctagtctggtgggaatggtgggattacaggcctgcctccccccccaggctagtctggtgggaatggtgggattacaggcctgcccccccccccaggctagtctggtgggaatggtgggattacaggcctgccccccccagctagtctggtgggaatggtgggattacaggcctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttgtaatagttttgcttttggtgtgttgttgctgttgttgttttgagacagggtctcatgaattttatatgtactagggtagtgtagaactttacagaactctcctacctctgccttctgcgtgccttcacatatagtataatatgtgttttaagtgtttattgctgtctcttttttcctctgtatcttaaaacataaagtaaaattatttttactatatgatattttatgtatggatattttgcctgaatatatatctatgcactgcatgcacatgtggtatctacagaggctagaggaaggtgttgggttccctggaactggagttacagaccattatgagctgccatgccagtgctcagcattgaacctgggtcctctggaagagcagtgtgtgctcctaaccactgagccatctccagccctattgtcatgtcttctctgtctcatttgcctaattttgggctcttcaactcacaaaaccctgtcctttatagttacagcgaataatgttgaaattgattaaggacataaggagatgaaagggtagaaataaactaaagcatgttgtagagttaagcagggtattgaataaaaggcccagagcagtttatatgttgccatattgtgttgagcaccctggagtacagcctattactcaagagtgctctcgtacagaatgttgccatgtggatgagcagtagagttcaaccgttagccttgacagctgtaggtctatgggaccacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgcagagaagtgcttgtgatcttatcataggactcaaatatttcaacttgggttccttattttcacaaattagggaagaaaggaaagaccccctctcagcattggcaagagaatatggaggctccaagaggaacgccttgttgaagtggtgtcagaagaaaacagaaggctatcaggtaagcgaggggttctctcattccacggaagcagtaactgcacaagtgccacctaccccgactgactgtgtaccttacattcacatggttctatttggttggttgttttcaagacgggctttctctgtatccctggctgtcctagagcacacttgtagactaggctagcctttaactcaaagatccgcctgtctctacctcctgagggcttaatctaaaggcttgtgccactaccgcctggctaaaatgatttttatattgaattttaggaacacattctcaagttgatagtgaacttggttgagtgtccctgggacaaaataagtttcttgtgtttgaaaagtaaccagtttccaggtgcttttaatgaacacctttaaaagtcttgcttatttcatgtttgtgaatgcgcctgtggaggccagagggccgcttcagacagtgcctttctccttccacagaaaggtgcagggttctagttcacgcagtctgtcagcttgtgctgcaggcaccacacccactgaagaatctcagcctttccagcttaagtgcttctgtggagatgacgtctggctaaatactgaaaacatacatgctcctcttaagagagttcaatattaggttcatctctgttctcacagcctttgccattcctgttggcatacctgccactccttcctctgtcttccagcatgtcactcaggatttattttagatgatgttaaatatgactgtaaagatgatttaattctacacaagttgaatgtatttattatcatcctgctaaaaaatgcaatttatattcccggtatcctcacataagatttgaggtacagagattttttccagattgcaatagattttcctcagaaatttatagaagtacacaagaaggtgatcagagttctgtattcctgggctcataacaacaaaatggccaaaaaagtactaacaaaaagaaataccaaagtagtagaggaagcagtgaacaaggtctatcattaagagacttcctatggacaaatgtgtacacgacccaggcagtgattgtcagttcatttaggattaaagacccaagtgtatgcagatgtaaggcggcagtagtcactgagcatcgactagtgggctgcctgttcctagctctcattagctaaggtggagtttagagtgagggtatagggacatggggagctatgccttgccaggcacagtgtactgtgttataactgctgtgaaatgatttagcagtcctcacagaaattcagaattaccatatgatctgacagttagatgtaagcagaagaactgaaaacaaggatctgaagagacagcgtaggcattctggtctctatagtagcttaattcaccgtagccaaaaggtggaaagtggaggtacaccagggaccactggcaaataagggcatacaaagatattctcagtcctttgtatataagaaggctactgatctttatgtgttaattttgtatcttgctgctttgctgaaagtgtttatcaactgtaaaagtgatcaatctaaaacctggtgaagtttttagagttatttatggataaaatcatatcatctgcaaataaaggtgcttatgctacttccttccatttgtctcctttggtcgccttccattggagtggagtggaagcgccattcaattctattatgacttcatgtactaacgggcatccttgtcttggtcactaatgcacatccttgtcttggtcctgatttaagtggaaatgcttgagtttctctctgtctaggttgatgggccatggtcttagtgtagagtgtctttattatcttgaggtgtatcctttgtgtccttgtaaaaatcttgccagaactgttatcatggaaggacattagcttttgtcaaaggctttttctcaccccatgaaatgatcatgtgggttttgtctttcaatgtatttacatggttcattacttgattatggaggaaattgcatttgatgtgttcttaaatccagattgcaagtattatattaagaatttttgcatctatgttcataaaggaggttgatctgttgttgttgttcttgttattggtggggttttttgtgtggttttgggatcagggtaactgttgccttgtatgaaggattagtaagtgttcttcagtttctagtttgtggagcaattttacaagtattgccattaattcttttttaaaggtcatgttgaattctgtgctgaatctgtctgacttttctgggttttgttttttgtttcgttttggtttttttgtcattgtttggttggaagtcttttaattattgtttttgtttcactaggggttataggtctgtttgaattgcttatttgatcttgattaaatttggtagattgtatatatcatattcatctatttcttttaggctttccagttcggtagagattgttaaagtttatccttaggagtctctgaatttccttagtgtctgttgtaatgtgccccctttcatctctgattttattaatttggatcttttgtctcttatttagtttggctaagtatttatttgtcagtcttttttttttttttctctaagaaccacctctttgtttccctgattctttgtattttgttgtttgtatttcattcagcccttagtttgattgtatcttaccatccactctttttgagtcagtcaccatttattgcaggttggttctcagtcaggatttagagatttagccacagctgaattcttcctgggtcggggctgggtaccaactatgctcagctgtgctcagctgtgcctccacactgacccttttcagtgcttcttactttactaatcatgtttgagttcctcataagaaagcggaagctgaaaaccacacaggctgccaacaccatgttaaacccacagcgctgcctttctggactttgatgtacttgtgatactggctgtaacctctctgagaggttcccataatgccactggggctgaaattccgcatcactatccagtttagcagctctccaagtttaacctctgtgagtttctccttcagtgacactagtgacgccatcatgcagtcctggtgtcccaaccaatgcggatgctggagactgatttcaagtcctctgtaagaacagtacgtgctattgactgcagagccatctatccagccctacccataatctttttaaactaaaagactgatctgttagagttcttaatgtgtcagacaccatgtaagaagtgccagaatccctgtccaggctggctgtgtgcatgtgtgacgtgtctccttaggcatcagcagtgggttcaggcctttggtctctgctgcctcacaaatctctgttgagagagggcacgttgtgacacttgattgttgagtggagaagaagctgacgtgacacttagtatgcactgttctcacagacccctaaatggaccatggatgctttatgtcaagggaactgtctaatcaatggagagagattccatatcttctgtcattaactcttttaagtggcatcctcaaattactgtgctgatgactgtaatcttattaaccatccattacaaaacaagcccctgtgaattcaccttttagctaacaaatacttttgtctactttaaatcgtgccctgccatgcattaaaaacactgtagagtggctaactctggagcattagtgttggaaggtcctagatgctctgatttattgagggagtaaaaccccctcaaagataacaaagtgcctcagttatattgtgatttcacaggcgacttctagatttttcaagacctactttaataaggcttcttaaacacttcaacctcctttatagcccacccatcaaaggtaggggagtaagatggatagtaggaagagagggacattatagcccaccaatcaaaggtaggggagtaagatagatagtaggaagagagggacatggacctgttgagaagtagttccttggggcaattccaatcttcattgtcagcagtccagttcactcagatcagcaggagggctcgatctcatgattggcatgagaatgctgacgcagcaggaagcagcgggaacacctctagaagtagtttgggtacatttcttagcaagcagaggtcagcaaagaaagcaaggcaaaccaatgccagagcattgcccactgtctgttgggttagacttttagtctttgcaaacatccagtgtcctctcaagggtccactccagtgaaagatctcatgccctttcaccagatagcttccagaaaagcatcacatgacataacgagtctctaaccaaaccagaaattcccatcaacagactcttattctctgctcctcaactagttttcgatcggtgttactcatcatctgctgcatacataaagcttcttcgaggcttaaaagctgcactaatctatggacataatgctaagtcattaggagtcaacctaatactatgtcaatttagcagaatagtagtagtaggttctcctctagggcccaagacctgtctggccacaggttcttggctgataatagtgccaagtatgggttttattttgtagagttggtcttcagtttgaccagaaagtgattggttctcccatggtatttgtgacattgttgcattagtgggcttgtagtgcactaccaggccagtagtcattttagctctcagggttcacagctaagtaagcctggctgcttttctgttccagtagtatgtttgtatagcaacttgcagcactgtaaaacctagacagtagtgatgaatcttgcgggtcagtacctgcttggtttctctatgttcttattgtttccttcttttgtttctgtgtgactttcaggtcttcattagtgaccccttcccatatttcctcctctaccctgcgttcctgtcccctacctcagtttaacactttgatcttgtctaacaatttttcaaagcttttagtaaagaggaatccgaattgccctattttcttatgccttaattagctttggctgtcaacttgtcacaccttgaatttagtactacatttacccctatttatttatttatttatttacttacttacttaatttttgcttgatggcatcagtaagtaaggtttccttttattacttctttgctgaggatttctttaaaaacaaaaaaatcaagaatgtgtcaggtgtggtggtgcacggctttaatctcagctctcacttgggaggcagaggcaggggcatctctatgaatttgtggctagcctggtctaaacagtgagatcctatcccagaaaatggggagggatagttcagtgtttactcttccagaggacccaggtttggtctctagcacctatgtggcagcttttaagtgtctatatcaaatgccgccttctgtcttctgtgggcatgaatgtagtgcacaggcagatatgcaggcaaaaaccccatgcatacaaaataaagaataaataccccctttaaaagaaagaaaagaaaagaaaagaaaagaaaagaaaagaaaagaaaagaaagaaaagaaagaaagaagcaagcaagcaagccaggaatgaatattgggttttgtccattttttttatctgtagttgaccctgtggttttcctttttggcttattaatagaattacactgagttttgaatgttaaatcatttgtatacaaaggacaaatttcagtggttagtggagtttcatattttctctttattgttagaacctcttgtttctagttgtttctttatactttgtcagatggtatcaagatatgctgactcctaactgggcatggtggcgcacgcctttaattccagcactcgggaggcagaggcaggcagatttctgagttcgaggccagcctggtctacagagtgagttccaggacagacagggctacacagagaagccctgtctcgaaaaacaaaacaaaacaaacaaacaaaagatatgttgactccctcaaataaacttttaggaattacctcttgaggtttatggagaaatttgtgtaaaactggcattatgttctttatatgtttgatagaatttcccagagaagcttgtggacctggggttttctttgttgggaagtttttaactacaaaatctgacttctttaacagtccagactgtttatatctctgtctgtgagtgaacttggtttgcatgtgtgcttgtttcatctgagttgttggtgaggttttcatggtgttataggatcctctgtatctaatagtgtgatttatgtagtgtcttctttcctcagataaatctacctagaagtttgtcaaatttatttatcttaccaaagaatcaatgtttggtttggggttttatattctttgttatttttcttttctgttttattgatcccactgcaattgttctttctttcttattactttaagggggaactgagaaaggcccattgtgtttcagtttcttatgttgaaagatgttatcttatttatttatttattatatttaagtacactgtagctgtcttcagacattccagaagagagcatcagattttattacgggtggttgtgagccaccatgtggtttctgggaattgaactcaggacctttggaagagcagtcggtgctcttaaccgctgagccatcttaccagcccccgaaagatgttatcttaatttgaaacttttcatcttttttgttgacattctgtaagttttggtgtattatgttttaattcagaaaactctttaatatttctttcatttctttcctttttttacttaattttatttcgaaacagagttttgctatgttgcttaggctggccttagactgctggatagcagtcactctcctatcttaatctgtcaagtaggtgattaatttagtttatgacccatgggctgaccatgggctacttagaagagtagcatttggtttctaaatatttgaggatttttccagagatcttcatgtttctagtttaattccagtgtgctcagagaattctttcagatttttttaagactcctttgggactcagaatatgccttgctaatattcagaggctgctgatctactgtggctggagagatgctgtgtagacagagagagggcagttcagtctcatttgttgagagtagtgctcatggcttcccagccttagtttttgtgtgcttactctggcacctgttgaaaggaaggtattagaatctcttaacagtgattgcagctttctctacctgtagttctaacaattcagtcactttgatgctggtcagtcggttgttggtttctctctgtatctcaggctgtcctagaacttgaagccattctccttgcctcaatactaccacacactgggattacagctgtgcattagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttcttttacacagtctcttattgactttgggtctgctgattaggttagactgactgaccatcaaggcccaggagtcctccctcctgtttctcctttcccaacactgcgaaaacaggcatggcccctgtgcccagatttgtaagctgcagtgctcatgcttgcaagcaagcacttttccaactgaattatctacccagctcctttattgggcttctttttgatggcagataatttattagtatctttgttaatgatttctctaaggtttacactatacatttttaccataatttacttactggttgtcaagggaaagggaaaaaggcaacgttgccccagtatagctttgtttcttctttctctgcactgtcaatctcaatgtatctctgtgtgttacaaacttgaggttatagtattagaaaaaaaagagcttttaaaagagtttttaacgggggaccacactcactatttttacttcatattttagccactttacctgaaaaatacttcttaatttgttatctgcctttagttgatttccagtgttcttaatagttatttttttgccaattttgtttttggatttgatttttaggagaaatatttgtctatcttttgctctaccacagccaaaaatctcctagcatgctttttgggattcctttcccctaacctcagccctctttggactaagcaaatcaaaagcaggaacttaatcttcattcttttaggggtgtgtacctctgtgacttagagtcagcatagtcagaaatggttaacacataaaccttgctacgccctttgggaccatagaccattccctgacaagcgggagaagaggaagtgcttttgatagacctgatcaagtgagcatgctcagctctctagacttgtgcgtcacgtgtgtgcaggcaactcagcccaaggagactgcctccaaagcttcggttcctccattcttcctgggcccacacgacagagcagaggaggattccataggaagagagaagctgcttcccagacttgtcccgtgtcttgttcctgttctttcttcccttacatttttctgagatgactttaagtgtctttcagaaagacaggaccgcatgctgctttcctccccccaccccactccacttgacctcttcctcctttctctacctgagaccacctttactccatgattagagttaggaccagaccagagaggtagaaagagaaagttaggcacaacggttacaacacagttcccgaggctgagtcaggcagagcttcgtttcctttccttcccagagttaaatgaaaaaggtgtgagtgtagataaggtttcagtctgaatcaaatctaagttaaaaatctaaatcttttcattttacattgtcttttacatggaaaccaaatatgtgaaaagatcttattgtttgtaaatattactgtgtcccaggggttaaaaatacttgaacaaagaatagcccactgtatagccccacccattctccctgtggagtgtgccagctaaaatgtggcacagtgaagtaggaatacagctctcacgtagcatcttccaccctcatggcaagcgaccatcacctagaaagcagtcacagaagagagcttcacacttcttcaagacacctcagggaatagagccccaatttcagggctttgtacactgcagaggttagatgatagcttcgtggtcacagtggagtgaacgagctgcttcctgttttcaggggattccttttaatgccaaacatagcagtggggaaacaaaagttttcccagaaacaaatgcacttactgcatttttgtctaaacatcattttgacagcaactaatgacatctatttccagaaatgtcagtgctataattttaaaaagttaatttcttagtactattgcataaattactttgatcatgccctgtgttttggctctcagtttgtagcccaggctgtcctcaagcttgcagtctcccaagtgctagagttgaagtgtgagccatcatcatgccttgcaagtgtactttttagcacagaggggatggccctactgagtcactaacctctccctggctgacacagtttgctttcctgcacaggttcaggagttgagaaatgataagaccaattcttaaatgcctacttagaggttcttcattgtaaatattttgatgtacattcaagggccataaagttggggaactatttggtaatgagctccttcgaggtgcttgacagccctggccagcatacagcaagaatagctgtgtggatataagtattgcttcaccagtgggctcctgaaagatcagaagagagactggtttaaagggtctgaataggtttctaggtccctgtctttccactggaggcagttggttcattctccctgcattttgcctgtgtgtaacttccacccaagatgtagaacaaagctgctggctagagtgacatgcttgattcccattgttcttggttcactttaaaataattgtcttgagagtggatttccataagggatccaacaccctcttctggattctgaggatagctgcatgtgtgtacatacccacatacacacaattaaaaataaaataacaaagacggcagaccactgaaggaacaacaaagcaagacactgaagccataagtggtgttgcatgtctaaatatctagtgcttggaaggtagaaacagaacattagagttcagtgctgttttctagtgcagagtgaagttgaggccagcctgaactgcatgaatttgtctttaaagggagggggacactatatctcggtttggtggcacatgaccttgaactcagtatttggaggctgagcagaaggattattataagtttgaggccagcctgggctacatagctacttagaatataaaggtcctctctcaaaagaaaaaaggaagatgataattgctgcgtcagcacttcaaattccagcctcagaaggtggaggctaaggcgggggatccagctactgcctggttatacactgagctagcctacaccccagcagcaagctgatttttcagtatgttttcgtaagtatgttttttattacgagcaatactaagaaatagaggaaatagctaagtaacactttcaagatctgtttaattttactaaaaggaggatcattaaaatatctgattcacataattttaaaaatatcattgtaaataaatctgtacagtccccatttactcttgtgtttcatctagtttggatcttagctcaatggtatggcagctacagaagagctgaagtttgacacattgatttcattatatacatgattgttttggatttcataaatgagtttagcctgaggacatcctgggtatttagggtgacctctccatttgtagaagcagcttacttataaagattgtcacctcctgataaataattatggaaagggcaatcagctattaggcattgtcaggagaggggaaagagaaggtttcttttctgaatgggttttttaggtctgagggaaagaaggttgacctgcttatctgcacgtaccatccagaacttaatggcttcagataatgacttcatctgtttagctcatcactctccagtctgggtggagtgtaatgggtatctctcttcatttagtttcctcagaggtggctcagtactgcctggggctggaaccatctcttagttttctcccccaggactggtggttggtggctaatggctgtgacagagcctctgtatatagcctctcttagctatacctgccttctaggaactagtgtcttcagagagacaggcaaaagtatctctccttctgtgacctcgtcttggttacagtgtcctttctgtcatgctgttttcacaggcagtaatgaagtaatacctgttcacagggggcaggaaaacagcaggcacatcttgtggtaggggtggggtgggagtggggtgtgtatgtgtgacaggttctaaagagaatctagaaagattgctacagctatatgcccagagagatggctctctcttatataagtcaccagagatgctagtagtcttatactccttttaaaaataacccttacttcagaagaagcaacagtttgggggagttcagcagtctgaaggcgagcataagcaacagttgagggaagcagttcacatcttcaatccgaatgtatctccaggactttgtagatagtgtcctggagcacaaaagcaggtgagccctgcccctcagttgccacccacattgttcttcatcagacatcacctttctttggtttgtttgtttgtttgtttttggtttttgttttgtttttgagacaggttttctctatgtaaccctggctgtcctggaactcactttgtagaccaggctggcctcgaactcagaaatctgcctgcctctgcctcccaagtgctgggattaaaggcgttcgccaccactgcctggcagacatcacctgtctatcagaggtacttgggctgtgtctgtgctgagcataaaccctcctatgctggtctccaggctcggggttacaggtgcacgccagcactattgacgtggcaggtgcacgccagcactgttgacatggctctgatttaaaaactggggatttctgagctacctgaatagtttttgtttgtttgttgtacacgtggaatgccttttaaaataaatgtattaaggcataattggtaaatactaataagctagatataaaattttaggttagtaacatcacatttatatacttagactgtaaccacaggcattagacacatagtacatgaagatcctcacgcactgtgtgttccctcaggccctacctcatccctcattgccaggcagcctccgtctgctgtcattgtgcatcatttgtccgttttatgaatagatgtttacagactggaaagtgcctctttcacgtagcattatttttgagcatcagttctcttgtgcatgtccatagttcatctccctctcttctgagtagtagtctagattataggtgtctcttcatttagcaagcatttgggttatttccagttactgtttactataagtaaagctaggtaccttcatgcgcatatgtttatatggtagctagctcagcttagctgctcttataaagtatcatatgtaaacaaagtatcatttataaacaaaaatatttctggnnnnnnnnnnnnnnnnnnnnacagacagacacacacacacacacacacacacacacacacatccttcttggtttttgaactctgcagtttcaatgcaggcatagaagttgcttacttggttggccaggggaaaatactgcctagcccacttcaagctgtattttgcctcaactgaaggattcctcagtaatctagaagcctaccacaaatatcccaagataatcacagtgaaaatataatcaatagcttactccctgaacagttgttaagccttttgaattaaaattgagatggtctatggattaagggtgggacaatgtgttctttctacaaaaagcaaaaacaagaacttggtgtgaagtgcagatttgatgtgatttgtttgaagtgctagagaagagacaaggagctgtagtaaaaggctttgcacctagaaaaaaattccatgtgtaagtcttaagtctttcattctcaatatatccccgtgcattttgtggctttaaaatatatataaatgtgggtgggctgaagagatggcctggaagttagaaagcttcctactgttccagaagaactggttccatgctgcgtcattcacaggtacctggaactccagcttcagggaatccaacaccctcttctggcctctgcaagtacctgcactcatgtgttctctctctctctctctctctctctctctctctcaaggtcacaggtttgagtgtatgggtctggggagtgactagtagcatatctacatatctacacatatatctaagtgcacgtgtaaagagagggatctgaggtgaggagaggcagtttaagaagctgccagtttgtctatgggaggggccgtctcactttgcttttccacagtgttggaggggtctgctcatttcttatcttcataagactctcgacagccttcagaagtggggagtagagtttccttgggctttagttcctgtagcacctttccatattcttgtttgataccatatatttaatttggtgaattgtacagttcttttgcttaatttgttattttatgttgtttgttgattaggatttctgtaaatattctgagttcaagtccttcatatgaaatacctgacttttaaacattcctcactttctatgacttgtcatttctactcttaatatcttatgaaggaccagtttttattttaatagcttttaatttttgaaattattttaatgggaaatgttttatggatactttagtttaatttataagtgttcgatctcagagaattctttctttttttcttttttttggaaagtttatacatgtaggtctgagttcatctctgtgtatggtttaagacatgaattaaggtgaacactgtagccaataggctcttaagttggggaggattgtgtatgatagaaaaatttaaaagcatcttaaggacagagtgcatggtcacactgatttatccaggatgcccctaatatcagagatagcaaagcaaagagcacacaccttccccaagaggaggatgtctcaccagaattggtaatggcggctctagaaaggatggaagacaaaacagattgtggggaaaggaagcagattgtagataatgggttttgagtgtctactattgcagtgcacagagctttcatctccacgctcctcagaggaaattcagtttaaagaaaacaaaggctatgaccttgctgagagcaccgagcaagctgggacaagtggtcttggtgccgagtgacagtgatactttggggttatgcctcagtggtggggtgcttgctgggagtttctctgtggtgccaacttctttaagcttctcaacttgtgaagaacttttttcctgtttgtgttctaaaccatgaactatgtacttagcacttacggtggacagccagagaggtaatgaaatacaagcaggaacagcttgtaatctagaacgtgacctttgtcctcaggaactgtcaattacttctgaaactattatttccaaaccttttagaattatgccttttcctgggcataacttaactgttttttaatgactcagatttgtcattataaatatttttgactggaatcaacatctagctttgtgttgccttttcttttcccttcaggtctttagtgcttttatgtcttggtgcatagtgtgttgtataccaagaaaacagcaaggacagctggtacttgcaaaataaaatcagaagcagtatggagtccgggatcaagtgtcacacacagggcggctgtggtagagtacttgctcccctctaaggcctggtcagctctgtccagcagaacagtgctgtctgttatatctggtccaagggaaaatctcctgaggtttagcaatcttatggtaaaggaaagtgaattgtggagttaggggcttagcaggagcaagcatttccttctgccagaacggctctaggtgtacagagtaactcacagggttaagaaagcagcttggttcctgctgtaaacagcaaaagaggttcatcgtgaggtgagcatgctgcatagagaatctctttcctgagatcatttcctttctgagctcccgtgagaccacaggcatttttacatcaaggatatctgcacttggtggcctgggtttgctatgtcaggctaaatgcagcattttagaactaggaagaatcgtggcaggagagatcattggtccttacaagtctcttgtgccagctcagtgtgatggggtgaggcaaacaggtaaccttcctgagatgtgaggcccaggagagaagtggtgtgtcccaggtgtacagagcagctcactgtcagtgtagtggtgcacgtttgctcactatacattgaattaattagcagcaagctgtggccttgggctgtctatgctttcagatgctctggactttgtttctgaatttgtacttctcttgatgttttctcactctgcatattattcagcaaaccatggctaacactagaaaaccatcagattttctgcttgtcttagtcaggatttctagtcctgcacaaacatcatgaccaagaagcagttggggaggaaagggtttattcagcttacacttccacactgctgttcatcaccaaggaagttaggactggaactcaagcaggccaggaagcaggagctgatgcaggggccatggagggatgttccttactggtttgcttgcttgctcagcctgctctcttatagaacccaagattaccagccaaggtttggcaccacccacaagggaccctacccccttgatcactaattgagaaaatgccttacagctggatctcatggaggcatttccccaactgaagctcctttctctgtgataactccagcctgtgtcaagttgacacacgaaagcagccagtatactgctctgctttgcagattctctttgggaagcaaagctatataagtgtaattttcttgaatgtatactttgatggcccatgataaaggctttctttatctctgggcatggttatagaagagaaattggaaaccattgtggctgtcttttggtaggtacccagcaacctgtcctgagggtgaggaagcagttttatatgtgttctgttttttgcttgaatcaaccctgtcttgtgaacaagagaaggcacaatgtgcccaccttcaacaagaggatctgcatgttttacccgctgtcctattgatcctcacatgtggctactgtttccttctgcttgggagaaagagtgaaaaaccatgtgtgcgagctcttctagctagtgcagagtggccaacatagtgcagagatgccccgtccataggaggctggaacatgtgaggctctgatctcactttcccctttcagtaatgctctacagagaaggtattttcaaatccataggactcaccttgatttaaaggagagtagttagcctctgaagagctgcatctcttaaccgaagttgtagcatgaatggaagagccttcttgaagagtgcatttgaacaaggtttctgtgttggttgagtaagatgccttggtagagttcacaccccacactttcagatctgaatacaagattgatgatctcccctcccccaagaatacactggaaaagaccaacagagatgttttggaatgcttaattttcttcctctcaaacatgcctgttctcttaggagtttgggataggcaatgacttccacaccatcaccctcccatcttgctttgccaagctcttcccagaacacactccagggcagatgtttgagggtcactgtgagtgccctgggaagtcagaattttatctttgtgagtaataactctgccaaaactaaactgagtctgtggaaatagcaaatttgtagaaatgttaattaagaaagacaaaactaattcttaagctgctaataaaactgcttacaacttgctcttagttcattaatgggcagcaacccagccaccagctttggccaggcacatggctctttctagctgtaatctcctgagctctcaggaagcagacattgccactcttctgtgctcctccattaaaaagttactccctgttagaagggtttatggaaggcaaaaggcaggatccttatttttcagtgacctttgccctgaacctgctttgaactatcccctcaaaatatgttaatttgactgaaaaaaggttagaaagccattaacaccccctccaaacataacgtcttattttttgtgatgattcaatatattggaagccttgtcctggtggcattcctgacactttgaactggttgggggagagtgtctgtgttctttggccgtgctctgggtgctcagccttgtagtggtgagagagccactgctgctctgacgctcaccccttggtgcttttctatttctaagaagtcatttcttaaggctgggccacaatacgttgccgtacatgtctatcaacaatcaagtacatgcaagctatgtgacctttcagtaaatactccaaaagaccttacactgagctccacctggcacgagcagatgctgggcagagagcactgcacagcgtctgctggtttaaaaatgctgtgctgaaaacatatttaacaaaattaccgtttacccatttaaatatatatatatagtccagcggtcctaataatgtgtgcagtgctgtacatggatcagcactacctagctccagaacgttccattagctgcctgtggaaatcttccacacaggaagttgtcactctctgttcccttattccagtacctggcaactactaatgcgctttgtacgtgtttcacttagtttccagatgtattcatgctgtaatgtgtcagcacaccattgcgctgtatgactgacaaatattctattgcatagaaaaaaggacattttatttgcccactggtgggtgtgcaacctgtttccctatgggggccgctgtgaggaatgcttcttggatggttgctgtctagttgattatatgaacatctgttttcagttcttgcttgtcacatggtggccatggtagcctgctgaagacctgtgaggctcgtcctcagtggcttcagtgcgtgccatatttctttgtgttttggtggtggagatgaaacgcagggctttgcacgtatgagcatagagcctaccactgaattgtacccctagcttattttctgttgctgtttttaatagccatcttgatgagtatgaagcagcatcttgtggtggcttcaaattgcattttgtgaaaaattagtggtattgaacacttctttataagtgtattagtcactttaatggcttcttcagggaaacaagttacagtaggtaactgtcagccaggtagtaggtttcctttctagatagtactgtaagtttgcttgtggtgggaatgaagctttcttgtgtactccctgcagctacccatcatctgcgtaggatcttcctatcccttcaccacctggaggactctaaagccaagtccagccattcagtctcattgtagctcagactatactattgacttgcttagattagatgcacgtacataaagttccacattacatttggatagtgtgagctttgaaaaagtctctgtcagtaagttccttctttctatcttcggtttatatcagaggaactgtcctgtgtgctgtatcccacattgtatattcttctcagtactcccagtgcttctgtcccttgtgaactggagggtagatctgcttcctagtcacgcccagcagaactcagctgagaagctctgcggctcagtaggaatgtccgtcttctgaggtgccattgctcctcattgtgttacacttattcttttcctctcactccagcaggcaccagttcattaacataaaacctctttacagagatgtttttatttgagttccttgatttcctagcttctaggctgggctgagtgtgtccctgtgaccatcctcatgaacttacagtgcatgttctggacagtcctgtccagtgcgctttctacctgatcttggttctcccccacatcacctaaagaaaaacaatgccatgactttctctaaaatagttggatcaacagctttagggttgagccagggagaggaaacccttggcagatgcttgtggtatgcagggagaattaagggtctcgagtgagacagctctgccgtggctctctgacaggaacttcagcaggaaagatttatttttgctagtggtttcatggctgtttagtcccatgtgtttgagcagaacgtgaagcagctagtgtgtgtagtagagaaggctatttactcctggcgatgaggactatgcctcaagtcctcactcccaatggatctccttcctccagaggtaggtcctacctcctgaagtttctatagcctccacaaatagtgccactccctgggaagcagctgttaaaaacaagcctgtggggatcgtttatattcagactgtgacagcggggcccaacatctggacttcatggtgcatcttctttcccctaccttacagcagcttggttcagttcagaaaggaaagggcacagtagcacaagactctcccatctcccctgggccctactgggagggatttagaaagagattcttttcacttttttttttttttttgtaataaattacaccacctagcatatcatacccaggctcccaaacaacctgcaagccccaccccagcatgaaggtaggtacctggagtaactcactcctgctcctgctgtagtttgggggttttggttggttggttttttgctttttgttttttgggtttttttcactttataccgcaaaactgtttgctggtgaagatggctgtaccacgtgtggtctgcagattctgctttccatagccaagagcatacggaagtagatgatgaaagatgaatcatgccctctggcgtcttgccagctgcccataaaatggcatttccttaaatagatcagacctttaatagctttttaaagaacatgtgatctttaggggtatattctgtggtccttaattaaatttgtgtgtgtgtgtgtgtgtgtgtgtgtgtgtgtgtgtatgagtatatatgagtgtgtatgagagtgtgtgtgagtgtgtgcgcacctgtttgtctatacctgtgtgtatatgcatatggaagccagaggtctatgctaggtatcttctttcattgctttccaccctattctgaacctataatggtctctcactgatcctggaactcaacagctaggctagatggcctgcctggttagcaagcctcagggatccttctgtctctgtctccccaatgctgggattacaggcgcatgccactgctcccagcaatgtgtgggtgctaggaccttaagtccttgtgttcacatggcaagcaattaactgagccatctccctagtccccacttttcagtattttgtggcattttaaatatattgagagatgtatgtatgtcttggctttcatatcctacccctaaactcccagtgcttgcacttgaaggggtaagaagacaggcccatctgaaggccactagcaggccttccccctaggctcatgccatagaaatgtaaaggggcaggggactggacttctctgctccaggacctccaaggtagtgtgacaggtaacatcacgtgtaaccaaggaaaaagtattttctattcacactgaagacatttcctggatgaaactgtgtgtggctctttaaagatatagtttcattaagtagcccaggctggcctttcctggttcctcctgccttggcttcctgtgtcaccacaggtgagctctcattggacctttctcgaattcctatgtacagacacatcacaaacttgtttctgtgtcctactccagacacagaactaactggtctgccaagttgaaaagcccaaaaccgatgggaaaactaagtgcaaagtctgaattcagaactaaaactggagctataacgactagtacatttctcagctccctcttggtttgttggcttaagaggcaggtgctcactctgttgcccaggctggcctcacactcagcatctccctgcctcagccttagaatactggattgcaccattgccaccctgcccagcctctgttgctctctttcgttgttgttcctttaagatatttctttttttttaagatttatcttttttattattattatgtgtgtgtgtgtgtgtgtgtgtggcatacgtacagttgagtgcagctgtcatggaggccagaggcattgaatgtgctagaatcacaggcagttgtaagaggcctgatgtaggtgctgggaaccaaacttgggtccttcggaagaacagcacatgcgcttaaaagctgaaccaaccccaagatttatcttaattttaattgtgtgtatgtgtgtgggtaagtgcttgtgactgcgggaggaaggcagaggtgcgaagggacttgtgggctgcctgatgtaggtgataggaacctgccgagcgtttggcagtgttgcctgtgagcactattttgggggatggtgagatggttcagtaggtaggagtatttgctgcccagcgtgatgatctaattctgatccttgggattcacacggtaagagagagccagctcttgcaagttgccttcagacctatgtccacacacatggatcggctgtcgtgtagggctggggagtaacatcctcagcctgtagtccttcctcatctgcagtgtagacacatcgctggggcagccctggaaggttaggattcgtcttacacaccagaagctactttctaaactaggaatgtcactggagatctttgtgggaaagtgcttggcagggttgcactgttgcaggttagtggcctttgtgctgtgcttgcctcgcaagtggctgctcacactgtataagtgcagaggttttctgtccccttggcttctgagcagtactactgcgttgcttgccctctgcctgtgtgtatttccattcatttacgtggtgctggggattacacccaggccctcatgcaatgataggaaagttcctaccaccaagctgcaccacaacccttatctcttcagcactctcttcctctgcgtacaagttcctcttcagttctttggtcctcttcatgcccccattaatgctttttgtcagcatgtccactgctttggagagctccagggtctcctttccccttactgccccacagtgtctcctgggtgattccactggggacaccgatggtcttactctttcactgaattctctctcatgacccctgcacccatgccttgaggccccctctgtctatttacaaagtaccttaaagttaacacactcagaatgtacctccttgtatgtgcaaaccctgtgcccagttaattctgcttctgtgaaggtcactacgggtgtttggttctgccaagagaagctaagggctacccttggcactccatgcacttcccttttatgtatttaacctgtttccacgtggatttacttcagctcccacatacatccataacctgactcccttttctctgctgccacaggcctctacagtcagcagccccctaacacagccccagcctgccagctcccattggctctttggagtccacccaaccacacttcactgggcaaccttctgttggccctagactatgtcaggtccacatgtgggcttctattttactccagggcctggcctcaggtgagggtccgtggaatgggtaaatgatcctcagagcaactgcatccagcacccctcctctctcgtcatctagcaggtacagttcccggtcctggtgctggctcacgtgtaagctcgagtttaggtgcggacctgaggtcatcactgtctcctcaggttgtcagtcaaatcccctttaccttctatttagttctttgagacttccatacaatgtgttttgatcataataccaccaccaccaccccaacacacatacatacagctccttccagattcgttcccctttccctggccattccctttgtgtctttcttttctttaatgtttctatgataagctcataaagccttattttaggcctgcagaaaacagagccacttgaggaggccatactcatcttgctgttgtggcacaaatgatgatagattggatttgttagtacctgcttctttgtagtgaatagacaactcagactcttcaggtgtctcctaaaggcttagtggttcaccatcagagtggactgacatttatatatctactttcctgaagcctgggacagctgctatcagttacgtgttcaggaaatgtgaggcctggccctcctcccccatctacaagcttcacacagtggtgttgagttgggtttttctgagtcacaaacagtttaagtttataccaaccagttgccaagaaaaccacaggtgccgttttgtttggccaccgtgggcaggtgaagtgacaacaggactgactatatagaacagcggtctgcagacaagtctggctgcctttgctgctgacctgagggagggtgtttagctttgtacctgcagaggcagaacatcagactgtgcctgcttcactccgtcatccggactgtaaaagagacagtgagaggttgcttctggtggcaacagacttggtgaaggccccaggatttcccacccatcctgccaacctggagcccactcacagtctagctttaggaacagatggtagcatctgcagggaggagccgttgggcatgggtgatgaagggaaaagctgtttctctggtaacatggtatgactttttattattcagtgtgtttcttctccaagctgcttacaaatcttgtcatgatatcactggactgtcataaccatgtcatgaagagcttcacatgtggacacgtgggtgggggcttcccctcttctgtttctagcactgagcttttccccccctccccctttgcaagccagtttagtgtttgcagacatttgtagcaagactttcagccctgttcactacaaatagcaatagtggttggagccaggagacctgctctctcaggcttgtgggcttccccgcttcctaaggagcaccccatgcccaggcctagcaccgttcctcactgtgttcgggagtttttggaagcaggtctgagctggttccttgggttcactgcttaatggactcatagtccttggtcaccttacttaaatagctcatctccggccacgggggggggggggaagagctcaagcctcagccagcttgattttcatctgaaatgctatcaactatcaaaagcacctctcacctggaacccttgctccatccaggagccgtatcctgtgtctattttgaggggaggaacagggtaaggaggcaccagcagcttttcccccagcagggtggggtttgtctggaggaagccagccttagccaggcagctggggtgtaggagcctctgctgtgaggcgcagtgaagccaggcacgtccacagccctgtgagaactgctgtgtcctcgggagcgaaagggggcaccgacacaggaagaagaggtttgtctttttccagcactcagtgacctggagtgagatactgccactggtctgcaagctcagagctctgcatgtcactaagacacttcctgccctgctgtctgacaaggcctgtgcctcagcttctgcttcagtcacttggatgcaagtcctggaagcatggaaaggggttttccttttccttttttcttttcattgtagtccctttagtggactttgctccttggcattctgtaaacaaaagacctttcagtttcatcttatactgggccttgtataccatgctggccatcacgccgggcccattctttgtcttacgtaccaaataggaaagctaccagcagtgagaactaactctcaagctaccaccctcttttaagactgtttcagggtgagctgcccagtggtagagcaaggcctagcatttgtggggattcccagcccagcgctgcaaaaatgacagtaatagaaaacttcagctaagcaagacttagaggcttcttttttagtgtttgagacaaagtctccagttcctgtgatctcttctgccgcagagaaccctgggttagtgtttcatctcctaagtcccagttttcctcagatggagctggccaccttagatggctacgtgctaagattcagatgagaaaagagacagagaggtaattacacatgagtgtatgcctacacatctatgtctgggaggggaggtgtctttcttctattggcaactgttacacaccatttatttcaaggtgactagaatatcatcagaaaccccttgggtgtagtagctattagccagagcagagactgtggggaggggaggggaaaaatggccagaacagaaaattggttagtatggtaccaagacagaggcttctaatcagacccaggcatttggggaagaaagataccagtgaacactgggtgggagcacctttcagttgctgttcactctgggtgggagcacctttcagttgctgttcactctgggtgggagtgcccttcagttgctgttcactctgggtgggagcacccttcagttgctgttcactctgggtgagagtgcccttcagttgctgttcactctgggtgggagcacctttcagttgctgttcactctgggtgggagcacctttcagttgctgttcactctgggtgggagcgcccttcaattgctgttcacactgggtgggagcacctttcagttgctgttcaggtgtaacactttggccaatgtcagcttataccacccatccttccaagcctggtcagattccttctccatacaagtttttaacggttgatgtcaactggagaagtgggaaacaacaagtggtcaggttatccattgctataggagcctctgcacttagcaaggtatgtttggtgaaggtgctgccagaggtcagtgctctatgcacacagatgggacaagaaaatgcacttggtggtgtgcctgatgagtgcttggccccatgctgttccatgaaggaaccatgtaactctgtgagacactggccagcatggggacagcctcccagctcagagcttggtctccagtgttcttaggctctgtccttttataaaaagaagtgacagtggtaaagagccttgccagctgtgaacctgtagctccatatagctatggagggtcctcagagctgcgtggtctgccgcacatagtgaacttggatggaccttgttgcctcaggaggctgactcttaatgcagttgaaggtggcatgcaataaactgagatgtgaaacaaggggcttttcataaagtgtgtgccaaggcctgatggatttggggtactttacaccattagtgtataggtcagtccctgtacagaacacattttcgtctgtgtatgcatacttctgagatgcacagtggctagaaggatgggagtttattggagttccttagaggagcatgagtgagcagaagtgtaataaaaaacaaaaaaaacaaaaaaaaaccccactctcatgtagactattcaccaaagccaaatctctgcagctctttacacaatctgcaggcagataggagagtcctcagtgttgctggtgtttgtcagagtcttacaatggctgtatgtcttacaagctggctttgaactcacagtctgcctgaataccaggattacaagtgtgggccacttgcctagcttgaagaccttttaaatgctttactaaacaagaagactctcactggttgtcgttcacatctggcagtctgtattgttaccacagcaggccttggagaggccttccatgtgtggagcagcttatagattatgtctcagggccaggctttgccaggcaggaacacagttctacaactggtaggtaagtgggtaggatgagggatccataaagacctagtcatggtcacagggtaagtgctggacatggcccatagcacgctctggttcctccagagtgaggtcacgtgatggggttatgggtggggttctgtgtcctgccttcttgagaaccgagcgatcatacttgagatctgaaagatcacactgcatccctctttttcttttccctcagaatattgacatcacaaacttcagcagcagctggaacgacgggctggctttctgcgcattgcttcatacctatctcccagcccacataccatatcaagaactgaacagtcaagataaggtgagccaaaaccagggatggtgcctcactggttagtgggccactcattccagcctcgcttcacaatagcctgtcctggctcattcccctggactcattgtttacacttcagctagccagtccctggtctacccattgcccatgtaacagtattcctagtggaagtcgttggctctctttggttgacagcatttaggatcaagggctttaagaagtnnnnnnnnnnnnnnnnnnnngtgtcccactctaacggttcttcaggttccccctgctttcctttatggcagccaagccctgtagaaaacccttggagattccacaggcgagaatgatttttggataggtatctacttctagctttgggggtctgtctccagttaacttcagcccttttgctagaatacaactttctgagtaaggggggggaaaaagtaggtggagccggagctggttgcagaggagagtcaaggccctgagggttactgtctgtcctgcatgatcttcagttgtctatacaccctactgacatgatttctcttacagaaaaggaacttcaccctggctttccaggcagctgaaagtgttggaatcaaatcgacgctggtaagccccttaccgaggagttgctgacagtgcctaggagaagtggtctcaggtggactgggctgaggatgtgaacacttgcaggatctcaaatgctgtagaaaatgcttctctcgaggaagtttccaaaggaatagttgcttttgaccacagtcccagcagcccttatatgcggctcttctttgtgattgtctgttccttagcagaatctttgggttcaggggaaaagtgtcacatggctgtgtgccttttgttggtctggagcagtgcctcctcagcctgtggatcatgactcctttgatcggtcgagtgactgtttctctggggtcaccaaagactactggaaagcacagatatttatattatgatttataactgtaacataattatgaagtggcaatgaaaacagatttatagttgggaatcaccacaccatgaagaactgtattaaagagtcacagtattaggaggggtgagaactactggtctagagggtgagggccaagggcatcctgagcccagagatatctgggagttgacagcactgcccacagttcctcacaggggccataaaatgctgctcatgatgcgaaacacaaattgtagaaactgaggccctttctaggcttctgccctgcccctgctgagctcacagggacaggcatctgccagctctagcaatgcaaagggatgcctctgtccctgcagagacagacctgctccacatgagtaacagtgacagtgcccaagcctcttcctgctcagggctgtgtacaaaagaaacgatcctgtgagaccagaacattcataggatcctaggatacctgcaggtctccaggtctgtctccttagctgtttcctgacttgtagcaactgcaggggccagaaagaagtatttacattaataattacactataacagtattcacctatagagtgtccttgaaactcatagaagcatgcttgcctaggctagcttccatccggatgagtcggaagagatcaggtacaattaatgtagtaggacattgcatgctgtgtacaaagtgttgtcacgtgtaaaacacggctaggtgttttagcctaacaaagaattttatagtcaagatttgttcacaagccaactgacttgtttcctgtcttaacttgctcaggacagcccttctcatcccatatgattagtgacatttctgggttccttgactgtggaatagtcctctcagactccctagccctgctctgtagttgccacaggcacttgtgacaggtgctgagaccctggggcagagctgctctatttccacaccccaggtcactagtactctgcagaaggcagctaaaaaaagaaagtttttgataacttgtgacacaccatgatgccgtgagccctagagtgtctccagagaacagcctagaaagagcctagaaagtctggggagagtttccacttgataagctggggctggggcagagaggagaccctagtggcacaagagtgtgacttggaatgatgattctgatactcaggaaggagatgctcacagggacctttggagatagagcagatactggagacctgtcctctgaaagaggcagtgcaccttagactaaaagctgtctactgcttatgggactagaagcccattggggtggcgtgggaggggaaataagtcctaattgagctccttctccacaggacatcaatgaaatggcgcgtactgaacggcccgactggcagaacgtcatgctgtatgttacagccatctacaagtactttgaaacctgagcacacaggagcggctgataccagctagggacctctgcagtcaccaagtgacaccaacaccattagctagaactcctaaagctttcagtgactctgggtctccctgcagggagtgtgcccagctctaggcctctgcattggaactggaactgcaggccagggctcttccgcatggccgtcctcaggagcagaagtacagcacaccgccagcctacttccagagaccgtccggctccaccagggccctggagtgcaaacagcataaaggctgtgcccggccgggcttatcttgggaaatgggattaagttgtgggaaccatgggttagtgaaagctttagccatccaacttcttgactattatccacgtgattcccagtggtgggacagagctggctttggtcccttcatgtgggcctgggttctaggagtgtgtcagaggaaagtgtcagtacccgttccatggagaggaccgtcctaaccactgcacttagcttaggagtgttaaaaccctgcttataggcccacagctcgttgagtctacactgccaccaagtaggtttttgtcagcagcaagacgcaggtggcacactcagtgggtgctcagccacttgcctgtaacaccagggaaaagactggtcacaaggagttctcctcattgaagttgttgttttattataagcaatattggtgaaatagctcctgttagtaccaaagttaatcgtttcagtaagcatagaactaaaacacagactgggcattagcatgtgagagggagggttcgtgcagtagggaaaggggggtgctttagggagccagagattcaagttgtactggtggctgcccctccagggcaggagttaagacagtgccttagccctgcaccaggacagctgagcctacacccacatgaggatcctgtgtgctgattgggactccaggagaagtggctctacgctgtgcctgggctgtggggcctatatcacgagccaaggccttacccggtttgttgatttctggctggaatttagcagcctcttttcgagaataggaagcccttatttcatgtgcctgacacagaagctgttgtttgaacaatgtcaagacctgttgctccgggatacacttgtttgtcacctgcaaggcaccatgtggaagactggccatcaataaaaatggggccacagcttcagtaacaagatggatggtgggaatgtctcccaggaggcatgccaggccaaacatggactgagtgaggttctgtattcaagcataatgctacagactaggaatctgttgtatctatggaacgtagagaaggaagcaatttgaaagtagttattgggaagtgggccgtgtctgtttgtgttgccatcagatggccagtcccacccctccaccctgcttaaatgtcccaatctggcagcttatgctgcagagtgtaccaggagaccctattattctgtctgcccagtgcctctctggccctccttggcccagttctgttcttgttcttgttctgctgatgaactccgttggggtgaccattgtgtgaaaatgactgtttccaaatgagtctccactgaactcctctgagcttccagcctctgctgtatttgccttcactgaggccttccactgtgcaccaaggtggtggatctgaggccaggttttatttattatcatgaaaaggggttgtcttgttagagactttcctgggcttgcagttcacaccttctgtcccctgctggctatgtgatcctcatggcagtgtggaagttgcccgagttttctgaaaggatttggagtaagtcagctgctgctgaacgagtatgtccatgtagaggtaacattctgttttggaatctgtgggcctgggctaggcctggagccagtgcagggacagacagatggtgggctagaccctctcacatgcacacacagactgggtgtctcacagccagggccaggctgcccacatttgtgtgagggtccacagtcaagtgctgtcttcagaccactgctttttgccttctctaataggccactaaagagcactgttgaccctctgggcatgcttgtagatggccatgtgctattaaaagtagtatttgggagttcttagagtgcctgtctacaatgcacgaagccctgggttgatccctaccaccacatacactgagtgtggtgcatacctgtcattctagtacttggggaaacggaggcaggaggatcatgagttcagtgttactgttgattacacggtgagtttgatgtcagccctggcatgtgagaccctgtccgccaaaaggtgatatttggaggttttcttgttctggggctgtttcctgggaagctctaagatgtaagctcgcctcttcctaaagcacaagcttcgctacaaaagggccagctacctttctactgttgtcagtcacaggcttctgccgatgaatgacactttgtcattttgttctagtaaatactcttgaatgtaataaactgtcatgcgtcgatttcctagtttgttctccctccctgctgtctgtctgaccttacacaaaccagagctctcaccctcctgtggaactggaatggaaggcatggatgcacctgcctcagggtcacatgctgtgtgggcccaggcaggtctggacagaaggagaggaaacgggtgagcccagaggttccggcctgccctgaaaccacgtggtaactgtggcagttctcaagatgccatcttagagccagcatgtcccacagcagagtcccggcagaagcaaagcctccagcagagcctacacgtttgatcaggagggcccaaggatttttattttgttttctttttataaatgttaacttcttagagttgagtttcaaggtgtataaaattacaggggtggggtttctaccaagaggcagctatataagtaattttcccctgtgcatccttttgttttagtgctagggctcaaactcagtaggaccttgcacataacatacacgtactgtgcttctgagccataccccaactcactggtacttcttgtgtgcggtgttttcaaatccagagtgatcaggctagataatgctgtctttcagctttgcacgtatcacatgcagaaagaagtctgtgggcttaccacctgcactccaggcatccatgataagctgcctgggcctgctactctctaggacttggggtcctagggagtccaaaagactcctgctggcctgagtttgaatatgaatatgttctcagagtgcccacaagccatgacctctagagaagccaacactccaagtacccaggacaacccgtgagtaaaagtagctgtgctgaattcttggagcagtcatggcagaggctggacagggcgtgtttcagcccttcctcagtatctggacactggatttgtgtcctaagcaagacagtgagaacttgatgcatggtgagaggagtgcttgaccctacctgttgctctctggtctgtccctgagacagcatgggccccctcagccctgcccactgcatgtcatatgctgaccccgaggggctcctgtgtaacccggtttatctgctgagagtcccacagtggtacttccttatcagagacctgttagtgcctgtcccagccagtaccttgatgaggggctgggagccggggttcagcacttctgtgagagacagctctgttagaaaaggaatataggttcctgggaagaaagaggtaactagaaagttcctcagacccctggacctatagcctctgggaatcagggcacccagcagccagctcttgctctgtcctgacaagggtagcacttccccaagtctcgggcgggggggggggtgttgctgaggtgggggctgtatttgtatccctccagtgggaagtggtcagatgtgaatggtctcagtgcgaggcagccatgtgagggggagtcccaggctgctgtgactctgttctggtaaaagtctgacagcagcaggttggatcccccagcaggccacgtggggatagagaggaggaggccacacttccaggggatggattggcatgagggtggatcagaggcgctcggtttacacaaatcagcctgggaggactggtctttgtcacaaacattcctagagagcgtctaccttgtcctgtgtgaggagggacagcagggtctctgccatttgggagctgagtcctataaagagggagaacaagatctcaggatgactgcgagtagctgtgctccgcatgcagttcttgcatgggctggacccccaaggtcgtcctcaaggtggaccccaacatttgggatatgctggaactgttgtgacctctgcagaaccccactgccaggcatcctgtcatgtggaggaggcgtactgggtcccaggactgggggtatggggagcacaaggaggagttcaagaccatccttgggggtggtaagtggcaaagccttgttaggagctacggagtgctgtcacattccatcatggggccaagcaagacagctgcacacacctcagctgtttttctgtctacagtaccacatcagatatagctccaaggctgactactggccagcttctctcactggtaagaggtgtaggatggagttcccataaggctacaggttgggagggcctgccctcctgtctgccgtgccttggattcgtgcatacagcccctaggagccatacgttggacttggctgcttcctctggtgttattttgccctttcagggtgtccctctgagggtgaacataagcctcttgctcacaggaagaagactgaacacttggggtggcctgaggttcttgggggacttggcccagggcccactaggtctatggtcctagtcttgtcgtgtcttgttccctgatgtggctcagctggccctagagcaaacaatgagggccagaggccacacaggtgcatcctgggcaggaacaaagggctgagggtagggtgggggagtagtctgagagtggaattctggaacttgacagagcccagctggccccatgattagggctgaggagttgggacctggacatacagaagggtgggcagctgtaaccttcagggactgccttgaggctatactgacaaaccaaaacccagagctagaaaccaggcttctgggggctacatgtactgtcaaggggcagggcggttcctgtttggtctcaacacatataactggggagggagtcaggccaagaccaatgtgaacttttattggcttggaaagcctgagccatcttcttgtggctctacacagtgtcatgacatggagctgaagccaagcaggctttgactgtcacggccataggacacagtttctgtggtgagatggtacccatcagaacctaagggtgaactggccactggctttgttttcctgaggaccagtattggaaaggaggccttactccgtgggccaggcatcaccctctggccccgtgcttctcaaacttcctaatgctgcaaacatttaatagagttcctcgtgttgtagtgacacccaaccacaaaattctcttctctctctctctctctctctctctctctctctccctccctccctctccctctctcccttttcctctctccctctctccctctctctctttcttccctgctttgtaacagtaatttcctgctagtataaatcataatataagtatttttggagatacaggtttgccaaagggattgtgactcacaggttgagaaccactgctctaggagggtccccctggagaaaggtgctgggccctggaattggaatggttgagagagaggagggatccccagaactggccaagagttggtctctacttcatgagtccccatatccccttcaatggggcatttttaagatagtcatcccaggacacgagtcttgacaggaatgggcaggatagtattgctcccccaagagaactcaggaacaaacacgcagagtccagtttgagaatagaccctagcttgatcgtgtctcatccttacccctgcaaggcacatggcgacgcacgccagtgtcagggcagcccttggcactggtcctgcttggtgatggttttaggcttcttaactgaagctgagatggcagtgctccagtcttctgtgctccctccagaggatctcaggtttaaagcaaattgcacgaaggtccctactctaaccagatctgtagacacaggcacaccctctaccccacagatgctgtaacactgcgagggtgggctcatcaaatggaaataaaaggtcagactttggaagaatgagcctgagagatggggtggggggcgtccaagtcaagtcctggtagatgacaatcaccatttcaaaggcagacattggcacctgcactcactatgtgcctacttctgaagagatattccttcccatcctgactgcagccccccgggggtctagcctggctctcagcaagcctcccctcatactttcctctaaccagacagcctgtgggttgcaaaggttctagaagacaaggttccagaaaggctgtggccttgtgtgaagggcttgccctgttgtgaacagattgagatttgcaaatccttccagaaagacaagattccactttgggtccagctgcctccagtcgtgagaggaggagattcccagcccagaagtctgagagtcctagttaggctgtggtgcagatgcactccctccttgctcagtagttcagagaagtaaagatgtgggggaggagtcacggttcacaggcatcagagatgtaagaactgtaaaggaccaacccccctccgcccccagccccggcctagggtcgggtgtgaagcagcttgggtcataacagcatcagggcagcttagctccgataaagggcaaaactgggaggaccagagtggcatagacagcctaatgccttgtggaggagccaccggagaggggtggggcgccaaggcttcatgggtgggggcactcgggtgggggtgggagtggcgctggaggaggcggtcaggacgcgtggacctgaagcgcccacgttggggcgaagggtgctttgctgccggacccatcaccacctcgcccttccagagacagtttcccctggttcccgcctcgaggcctcggtttcccccagcagcggggcggggcgggagcagcgctggtttcgaagtcgcctgcagggtgcgcccatgagcggcgcggccggagctggagcccgagcggtcgctgagacggtgggagccagagcaagaggcaggtcagcgggggtcctgggtcccggggaccctgggggttttcgggtgggcatcttggcggttgtggccgtcggaggctgcggagcctggaggtctgagcgaaccagggtcctcccgcccctcggagcgcccgccgctccctccgacccttcttccttcctgctgtcgggaggggagttcgcgggtgccgaggtaccgagcctgccctggccacttcgggagcggtagcagcccgggtcctcggcgcggtcacatctcaagtgtggtgccatcggggcggtcctcggcgaccggaaagtgctcaagggcagctagggaggaaggggctcgagtaaggcagggtagcgggatgccttacagtcgtctagacccgccggcgacacgagctgctacagccgtcgatttgtcgccgcgcggaggggactgaacctgcaagcacacaagtccctttagggcgcgtccctaccaaagctaggctgcggacgtcgaggcgcggccggaggtaggcgggtcagactctcgggttgggggttcaagcgggcaccggctgcttcggggaaggcacggcaagagcaggggagtttggaacccgggggaggggagcatcctgttgactgtggtggcgggaacttagggcactgcggagagtccagtggacaacagggtgggtgcctgggggtgcccaaagcaggggtgcaaatggcgggaacggtaacaactctcaagggtttggcagaggatgggcactgcctttggaacctttagactaatcttgcccgcccatgtaatgggaggagcaggaattcacagtggaccagagagacagatgcagcagccagacaatcgccaggactccttctccccagaatggctcaggagggatttgaatccctctccttacccaaccatagactgcactttgcctccctgagatgagagcctgttctctgtccttctacctgggactctgtgctggttgcccgatctctgcctctactgcccagctcctcctctactcccagacctcgtgggctttcaggaggttgctcacaaccaaccaaggatgtcctaggtgccaggacccttaagacgatgatggagagcttttctgggacagggagttaggaaggctctgcctgtttggttttgtagtcgctgctcaaagatcggtgggtccctgagtatggtatcaagatctcaaagctcagcccttgcattctgggacttcccaggttctctcaagttctagtgtctcttgagcaacccctagccagtgcgcattcccttagaggctgaccatgactgttctgggctgggctagccttcctgctcatggcttgaagttaggctaaggtcagcccacacaagtagtacgagacaaaccgtgggccaggcagaagaagcagtgggtgatctccagtgtcctgctaatgggtcaaagatttttggtgtcccaacctagagtttgatcttggccccttgatgcacactaactaggtggctgagggaaggtcactgtcctggaaaaccattttcccacctgtagaggaatggtgttcttagtagtgctaacacacaagggtatgggggtgggtgggagaagggaataaaaatgacagtttttggttgggtgtggggcaggttcaggggaagaggtggtggcagtggtgactggggtggggacgggtatgctagagggcaggtcaggggtctcctctgttcttaggctgggtaaccctggaaggggaagcagagattgccgtgaacagagggaaatgtggacaagagttggtttgggagcaagcatgtggctcccaggcatcaggttctgcaaagtccaggacctgtcagtgagaccacagtccctggtggctctcggttgttgcctggatttgattcagcagctcttgcctctaacctgctccttcctgagctaccccctctccctcgaagaagctagagctcaatggccttttggtagccctgagtagtatgtgcataggagagtggagggcgagacagatggtcagatagacagatggacaccggtaggaagttttggtgaatgtgatggtgtagttgaagaggtgaggatcttgctacaggcaagtactgaactggtaaaagagactttctccaagtgccagggaagaatctggtctgtgggacacactggggacccggcagggtagatgatcaggacctggggaactcagtggaggaaagtagtctgtaggtgggtggcagcagaggtgacagaacctgagaataggaccaaggtccacactgggaccccgattgtaggaggagattagaggtacagagaggagcccttggagactgttcatgcccagagcaagacccggaccctgagataaggaagaaggagccatgtggtgcagagagggaggtcccggccctgagatcctgccaggtgtcaagcagggatggaatgggggagagaagctgcccttagtccaggcctgggaaggcactggacactaggaagacaggacttgtgctgtttcccagggctacctctaacttaatgtgccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcacggatgttgaggctttcgtgggatgctcttaccatgacccgtgcacatggagaagccaaggcacggtgggggtggcggggggaagctggcgtggaccttgcatggatgccacttgggcagctcccaccgcaggctgctctcacagtacttctgtgaggactggatccagggaagggctttacccggagaactagcctgcaatggatgagtggtacctgaggtaggactggggacctgtggttctctctgggtaccagacctagacaagtggggctgccagggtcctccctagggctctctctctgtgggagagaagagagatgtggctagcctgtggcctttgagtctcgagtctggactctagactaaggtagcctggctcctggctggtggaggtagagttatttagcagggtaagctggtgccctggcctccagctgcagaaggctggttctcccttcctgcccacatcctgtccccaggaacacaacagcagccacatggtccctcccacccatggtcgttgtgggagggacttactggtcacctgcttgtatactcggggcccagcttttaccaggtattagaattcgggtgctgtgcaattctagaagtatcaggaagggaaaagagacccagaccccatagtcagtcaatgtggcattaggcaacctcaggagtgacccatcttgttgactgatgtgttagggtggggtatggtaggttgggggggggttattaatgcatctccagttactgttgaaccactatatggggacagggtagagcacagacactgtcccaggtcacctccaggcacatactgtggaacatgagtcgagagccttgaaggaacagccgctcggccgcccagcattcagatttagcattgccgcctcttcgtccccattcgctcccatcctgaaccagccactttaattaaaatcatttaatcccaacccacatctctcctgagccannnnnnnnnnnnnnnnnnnntccccagtccatcctcttgtgattcttgcttggtgtcattcccccaaatcgaaggacagatgttgaatctcctcaatctaaactttgtctctgattccagtaagaactcctccgtgttctctcttctggccaccactgccttggtcctcaactttacctgcaggcccaaagcttgtcatgtagagcgtgctctttattttggcccctgtctttcccactcaagacttcgtgcttcttgctcgtctttgctcttgtgtgccagcgagtctaataactatcgttcttgtttatggcgcttcctttttcagttatcaaaataatcactacataggctatacctccctctcctgtgggtttgatgtttagtatttttatttcatggccttttctttttgttttgttttgctttttgtttttaaggcagggtgtcactatgttaaccagactggccaccacctctcagagacccactaaccagtctctgcctccagagtgctaggataaaaggtacacaccacatctcttatggtctcagtttcttgccttctgaattctggtttgtggctcatctgaagtgggagctgaggtcctagggtcagggcatggcttgtaacaacttccctgccaccatccaggacccaagctatctgaatctctaaggtggcagctgttattgaagaattcccacagttcttgtcttttgagacacctgcgggagaccccaggactgaagggagcaacaggggcagctgatagagttccccgtgacacagacaactaggtagctggtgaacattgtccctgtgaggaagaggcagcctggtgtgatggcacatgccagtggaactgtcacttagtgggtagaaatgggaggatcaagagttcaagactatgcctggatacatagcaagcttgaggccagcctgggctaacagggacctgtcacaaaacaaaatggtaaggctgggattgtagaacccaggaagaaacccactgcagctgcaatgggcagtgtgtgtactgccctgtcccctctgcttggccggagcaggagcagtgtgtgcaggcctgcctgtgagctcgtagacacatctagcagggtctggagccaccacctgggcctgtgtacacagagcttcgggtggctcaggagagatgtgggttgggattaaatgattttaattaaagtggctggttcaggatgggagcgaatggggacgaagaggcggcaatgctaaatctgaatgctgggcggccgagcggctgttccttcaaggctctcgact

SEQ ID NO: 1652 - DNA, 4890 bp, Mus musculus
ggagctaatgatgtggcactggctaaacgttcacgcagccgcactgctgcagagggtgatattcgtatgagcaagtctaagtcggacaatcagatcagtgacaaagctgctttggaagccaaggtgaaagatctcctcacactggcgaaaaccaaggatgtggaaattttacatttgagaaatgaactccgagacatgcgtgctcagctgggcattagtgaggaccattgtgaaggtgaggacaggtctgaggtgaaggaaactattattgctcaccagcctactgacgtggagtctactctcctgcagctgcaggagcagaatacagccatccgcgaggagctcaaccagctgaagaatgaaaacagaatgctaaaggacaggctcaatgctttgggcttttccctagagcaaaggctggacaattctgaaaaactatttggctatcagtccctgagcccagaaatcacccctggtaaccagagtgacggaggaggaactctgacatcttcggtagaaggttctgctcctgggtcggtggaagatctcctgagtcaggatgaaaatacactcatggaccatcagcacagtaactccatggacaacctggacagtgagtgcagcgaggtgtaccagcccctcacttccagcgatgatgctctggacgccccctcctcttcagagtcagagggcgtgccaagcattgagcgctctcggaaggggagcagtgggaatgccagtgaggtgtccgtcgcttgcctgacagaacggattcaccagatggaagagaaccagcacagcaccagtgaggagcttcaggccactctacaggagctggctgatctccagcagattacccaggagctcaacagtgagaacgaaaggctgggagaggagaaggtcattctgatggagtcgctgtgtcagcagagtgataagttggaacactttggccggcagattgagtatttccgttcccttcttgatgagcatcacatttcctatgtcatagatgaagacgtaaagagcgggcgctatatggaactagagcagcgctacatggatttggctgagaatgcccgttttgagcgagagcagcttctaggtgtgcagcagcatttaagcaacactttgaagatggcagaacaagataacaaagaagctcaagaaatgataggtgccctcaaagagcgcagccaccacatggagcggattattgagtctgagcagaagggcaaagcggccctggcagccacattggaggagtacaaagctactgtggccagtgaccagatagagatgaatcgcttgaaggcccagctggagaacgaaaagcagaaggtggctgagttgtattctatccataactctggagacaagtccgatatccaggatctcctggagagtgtcaggctggacaaggaaaaggcggagactttggccagtagcctgcaggaagatctggctcatacccgaaatgatgccaatcggttacaggacaccattgctaaggtagaagatgaataccgagctttccaggaagaggccaagaagcagattgaagatttgaatatgacattagaaaaactaagatcagagttggaggaaaaggacacggagaggagtgacatgaaggaaaccatctttgaacttgaagatgaggtggagcagcaccgcgccgtgaagctgcatgacaacctcattatctctgatctagagatggtcattgccaatgatatcaagtctgaagcccaagaagagatcggtgatctaaagcgacggctacatgaggcccaagagaaaaatgagaaactcacaaaagaattggaggaaataaagtcacgcaagcaagaggaagagcgtggccgggtgtataactacatgaatgctgttgaaagagatttggcagccttgaggcaagggatgggactgagtagaaggtcctccacttcctcagaaccaactcccacagtaaaaaccctcatcaagtctttcgacagtgcatctcaagtaccaaacgctgctgcagctgcgatccctcgaacacctctgagtccaagtcccatgaaaacccctcctgcagctgccgtttctcccatgcagaatattgacatcacaaacttcagcagcagctggaacgacgggctggctttctgcgcattgcttcatacctatctcccagcccacataccatatcaagaactgaacagtcaagataagaaaaggaacttcaccctggctttccaggcagctgaaagtgttggaatcaaatcgacgctggacatcaatgaaatggcgcgtactgaacggcccgactggcagaacgtcatgctgtatgttacagccatctacaagtactttgaaacctgagcacacaggagcggctgataccagctagggacctctgcagtcaccaagtgacaccaacaccattagctagaactcctaaagctttcagtgactctgggtctccctgcagggagtgtgcccagctctaggcctctgcattggaactggaactgcaggccagggctcttccgcatggccgtcctcaggagcagaagtacagcacaccgccagcctacttccagagaccgtccggctccaccagggccctggagtgcaaacagcataaaggctgtgcccggccgggcttatcttgggaaatgggattaagttgtgggaaccatgggttagtgaaagctttagccatccaacttcttgactattatccacgtgattcccagtggtgggacagagctggctttggtcccttcatgtgggcctgggttctaggagtgtgtcagaggaaagtgtcagtacccgttccatggagaggaccgtcctaaccactgcacttagcttaggagtgttaaaaccctgcttataggcccacagctcgttgagtctacactgccaccaagtaggtttttgtcagcagcaagacgcaggtggcacactcagtgggtgctcagccacttgcctgtaacaccagggaaaagactggtcacaaggagttctcctcattgaagttgttgttttattataagcaatattggtgaaatagctcctgttagtaccaaagttaatcgtttcagtaagcatagaactaaaacacagactgggcattagcatgtgagagggagggttcgtgcagtagggaaaggggggtgctttagggagccagagattcaagttgtactggtggctgcccctccagggcaggagttaagacagtgccttagccctgcaccaggacagctgagcctacacccacatgaggatcctgtgtgctgattgggactccaggagaagtggctctacgctgtgcctgggctgtggggcctatatcacgagccaaggccttacccggtttgttgatttctggctggaatttagcagcctcttttcgagaataggaagcccttatttcatgtgcctgacacagaagctgttgtttgaacaatgtcaagacctgttgctccgggatacacttgtttgtcacctgcaaggcaccatgtggaagactggccatcaataaaaatggggccacagcttcagtaacaagatggatggtgggaatgtctcccaggaggcatgccaggccaaacatggactgagtgaggttctgtattcaagcataatgctacagactaggaatctgttgtatctatggaacgtagagaaggaagcaatttgaaagtagttattgggaagtgggccgtgtctgtttgtgttgccatcagatggccagtcccacccctccaccctgcttaaatgtcccaatctggcagcttatgctgcagagtgtaccaggagaccctattattctgtctgcccagtgcctctctggccctccttggcccagttctgttcttgttcttgttctgctgatgaactccgttggggtgaccattgtgtgaaaatgactgtttccaaatgagtctccactgaactcctctgagcttccagcctctgctgtatttgccttcactgaggccttccactgtgcaccaaggtggtggatctgaggccaggttttatttattatcatgaaaaggggttgtcttgttagagactttcctgggcttgcagttcacaccttctgtcccctgctggctatgtgatcctcatggcagtgtggaagttgcccgagttttctgaaaggatttggagtaagtcagctgctgctgaacgagtatgtccatgtagaggtaacattctgttttggaatctgtgggcctgggctaggcctggagccagtgcagggacagacagatggtgggctagaccctctcacatgcacacacagactgggtgtctcacagccagggccaggctgcccacatttgtgtgagggtccacagtcaagtgctgtcttcagaccactgctttttgccttctctaataggccactaaagagcactgttgaccctctgggcatgcttgtagatggccatgtgctattaaaagtagtatttgggagttcttagagtgcctgtctacaatgcacgaagccctgggttgatccctaccaccacatacactgagtgtggtgcatacctgtcattctagtacttggggaaacggaggcaggaggatcatgagttcagtgttactgttgattacacggtgagtttgatgtcagccctggcatgtgagaccctgtccgccaaaaggtgatatttggaggttttcttgttctggggctgtttcctgggaagctctaagatgtaagctcgcctcttcctaaagcacaagcttcgctacaaaagggccagctacctttctactgttgtcagtcacaggcttctgccgatgaatgacactttgtcattttgttctagtaaatactcttgaatgtaataaactgtcatgcgtcgatttcct

SEQ ID NO: 1653 - protein, 789 aa, Mus musculus
GANDVALAKRSRSRTAAEGDIRMSKSKSDNQISDKAALEAKVKDLLTLAKTKDVEILHLRNELRDMRAQLGISEDHCEGEDRSEVKETIIAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGVPSIERSRKGSSGNASEVSVACLTERIHQMEENQHSTSEELQATLQELADLQQITQELNSENERLGEEKVILMESLCQQSDKLEHFGRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDTIAKVEDEYRAFQEEAKKQIEDLNMTLEKLRSELEEKDTERSDMKETIFELEDEVEQHRAVKLHDNLIISDLEMVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNAAAAAIPRTPLSPSPMKTPPAAAVSPMQNIDITNFSSSWNDGLAFCALLHTYLPAHIPYQELNSQDKKRNFTLAFQAAESVGIKSTLDINEMARTERPDWQNVMLYVTAIYKYFET

SEQ ID NO: 1654 - DNA, 71887 bp, Homo sapiens
  misc_feature (1)...(71887): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggcctcccaaaatgctagttttacaagcgtaggcccagtgcccagcctagataatctttcaggaaaaagaagcaaatggaattctccccaactcactgtgaatttagtataggcttaaaaccaaaccagacataaatagtacaaggaggcaaaagtatggactaacttcttatggacatatatgcaaaaacgctaaataaaatattagcaaataatccagcaatggattaaacatgtatcacgaccaagttggggttttcctaggaaactaagattatgtaataaaagaaaaaactattaaagtagtacaaactatcaaaggaaaaaacctgtatgatcattgcaacaggttcatttgcgacataatacaatttttttctttttttttttttaagtctttttggctgtaagtttattcaatgcaaaataatcctctccaattctactgaggtggctgacggtgtccacgaccaaatttgcctctaaactggaattcggttgctgacccagccccagcctcggctttcttgtcggcaccagggggcacagcactccttctgtaggtatctctgtcggcttctcctcttgtgagtcttgcaggtcgctcaccctccagacctttagaccgaggcctgccagtccctggacggctgcggcgtagggtggcaggcacaatctccaggggcagatgaaggtaatcacggagatactggatatcctcattggtaaggtaccagtagacatgtctccaggcaaactgttccttcacgtagtagcctcgggactacatgacaggaaggttgggcacacacattcttttttttttgagaggagtctcactctgtcgcccaggctggagtgcaggggcgcgatctcggctcactgcaacctccgccccctgggttcaagcaattctcctgccttggcctcccgactagctgggattacaggtgtctgccaccgcgcctggctaatatttttgtatttttagtagacacgggtttcaccatcttggccaggctggtcttgaactcctgacctcgtgatccgcccgcctcggcctcccaaagtgctgggattacaggcctaagccaccgcgcccggccgggcacattcttgtctgccaactccaggtgcttaggcatgtggacatccttcttgaccaccgtgacttcctctttaaaaaggagttcataaatggcaatccggtttttcttaggcatcagcattctggggaggagcagccgctaaggtggcagggtggcccggatgggggccgatggaactcgaactcccccagaatttctttaatattttatatatatatatatatatatacacatatatatatgtatatatatacacatatatatacatatatatatacgtatatatatatgtatatatatacatatatatatacgtatatatatatacgtatatatatatgtatatacatatatatatacatatatgttgctcgcttattctttttgtctgttcccttatgtaccgggagtgccaggaggacagggctttgtgttttcctcactgctgtctggctcatgcatagcacagtccttggcacacggtaaacacgctgaggagaacttttgggactagcggactctgagcatcattccgctgggcccagtggggcctctgaagggacccgccttgcccggctccagcccaagacctgaggcatgcgcaccggctggccggctactttcttgaccggccaagtggcagagcggctgcgcgacccagtgccgagacggacgcgagccggagatgggggaaggggagggggtggtggtgggggacggcggcgcctgcgcagtgaaggaatgtaggcggggcctccacgacgcctgcgcagacggccgcagccctgctgggcgcgaaggggctggccaagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcggtaagagcagcagccgggttcccgcagtgttcgctggcgggttggtttatcgcctcagcgccgcccgcgctgccgcgcccgggcgtccccgcagaccccggcaggcccagcgcctgcgccgtctctgctcctgggcccctccagtgtgtcccgcgcctgcgcctttcccttcccgcgccgtcctcgttctgggcttcggggcttctggaacaacccgcaggcttcgccgccgagacccactggccttcgtccgttggtgttggggttcagctggttctgggaccccgcttgcggcttgactgtgtgcagacaggccgggtgcgaccctcgtgcttgcctttccgccgctccgggagaggctggggctgccgccccatcgcccgggtcccttgcctggggcggggacagcgttgttcagtggccccgagggcgcagagcggaggagcaggggccacaggcggcggaccccgggcctgctgccggtgctgcttctgctgtggccggcgcccgaggcggacggaacgtccttttttcttgagacgtggttaattgcatcaggttggatgtgaataatccggtacctgtctgaggaaattttgcgtttccaggaatttggtaattgtattaccttaagtagttaagtctaagacatcatagtcgcggcacgttgggcaagctgccctggagatgacgaaaagaaatcagtttccagtagttttagcccatttacagaacacgcaaaaattctgtgatcattcaaatgcggggaaccttgatttgttgatatccttgatcatttgtccaagtaccagaagggcgaggaaaagattcccgtgaacagcccaggtgatttcagggaacagtgttttcttttgtcaaaagagcctcttaagccatgataatatttcccaagcttataacagatacaagcctttaaaaaatggcatttgctgtcacccagtaggacacatcttgagatgaaatcagagctgtaggctttgtagacaacagcagtcatttctggtggcttcagggagtggagggggactgcaattttgccaatgtaggtgataccaaagggactatagtaattttttcttcgtaattaaaaaccaggccaggcgcggtgcctcatgcctgtaatcccagcactttgggaggccggggcgggcggatcacctgaagtcaggagttcaagaccagcctgaccaacatggtgaaatcctgtctctactaaaaatacaaaaagcgcgcgcctgtaatcccagctactcaggagggtgaggcaggagaatcgcttgaacccgggaggcggaggttgcagtgagccgagttcgcgccactgtaccccagcctgggctacagagcgaggctccgtctcaaaaaaacaaaaaccagatataacaaggccgagctccctggctcacgcctgtaatcacagtagtttgggaggccgaggcgggtggatcacctgaggttaggagttcgataccagcctggccaacatggtgaaaccccgtctctacaaaaaatataaaaattagtcgggcgtggtggcacacgcttgtgatcccagcggctcgggaggccgagacaggagaattgcttaggaggcagagggtgcagtgaaccgaggtctcgccactgcactccagcctgggcgacagagtgagactctgtctcaaaaaaaaaaaaaaacagctattacaatatacatgtatgttgtaaaataaccaaaccaacatagaagggtatatagtgaaaggagaagtattgttgtgggtaaaattgtttcaataaatggctaatccagtatttttttcctccaaaaaaacaccttttcccctttgatttagtgtataccacacagagtcgcttagccgattcagtgacttttttgatagctggagaatgcttcctaatggttgcaggtgtgtaggggttttcttgacattttcagtaagaaagtgaatgttgtgccataggaaagctttatcacaggtgcacgttggtagccaactaaataacgtgagtgtcaagtacagtatctagtgagtggagaataactgtaataattacaattacagttgtagttaaagtgaagtttgtatcaaaatttctgtttcaaaggtgaacttttaggaggtgtatctgcggtgtttcttcctcagatgtgatttctctgaagcagtggttctctataactgacttgacacacagtgcatctgatatttcgaatgacttaagtgatagtatcaaaattactatcatatacatatttaaatcacatgactaacctgtgtgtggtattatgcaaactgctcagctcagtaagggaacagaaataagaaaaaaaggacaatattgggagtcttttatacaattcaatttattcaattgaaggactatcttttctttaaaaaagttctgctttcttggtgttaaaataaagcatcttttatgaaatgatggtgatagtaaatggtgatatatggtaaacgtaaatagtaaatgcaagggtagttattgtgatttttaaaaataaagagagccgagaatctcttgttttcctgctgctgttagggagttcaggaaaaagttcctggggcttttgctgttaagaagattcaaatatagagtatttcttaagagtaaatatgagtttattttgagatcattggtcacagtctactgagaaatccactgagaaagctgttaaatttgcatggcattaaagatgttcctattctgatcattgttaaatagatcttttttattagatataattgtttttgagacagtttcgctcttgttgcccaggctggagtctaatggcatgatctccgctcaccgcaacctacgcctcccaggttcaagcgattctcctgcctcagcctcccaagtaggtgggattacaggcatgtgccaccacccctggctgattttgtatttttagtagagacagggtttttccatgttggtcaggctggtctggaactcccgacctcaggtgatccgcctgccttggcctcccaaagtgctgagattacaggcactagccacctcacccagccccaggagatttttttgtgttgtgccaacaaataagcctaggcagggaaattctttctggtggttggaattgttagtactgaatagactagatgcgaggtaaagaacccccatggggttttctgtcagctcagaaatcattgtgacctcagtcttttactgtgaaataacatgaccattaggaaagtagccttaaacaacgtattttgggtatgttgagagggagggacaattatgatctgttccaaagtgaacataacagatgatccctgtgtctgtgaagcctttaaaatttatagtgctcttctattaatttcaagtaagatttagagttattgtgacatactcttaaaaaacctgcagtgtatcaaaaggcacgtttttaaagcatcttgaaatgaaattaataatgtaatatctacttcttcagaatagtagtttttacattctgaagactgactgactgctctcagccacttctgagttctctattttcaaagaataatttggtattccataaaggaaatctgtaaataagagaagagagtgaatatcttttaacagtgtttttcctgatcttttccaaacatcttcattgtggttctgtcctttattttttggttaaatccagaggtttacttctgcctgtatctttccaaactattaatctgttcacaatcactttcccatttaaatccttcagcagccccagtaccttcgtaataaggtctccttagcttggtatccagaacacttcaatactgggctttgacccctgttctccttcccctacctctgtttaggtgcttcactgagctgcactgaacagctcttggccccttgaaatctctgcagtctccttgtctccctctgctggaatattcttctctcacttcatctgatcattgccttcaaaactcagctcattttcttatttccttgcccttttcatgtcccttgttttcctccgattaaattaatgttccaaactcaaaagaaaaacaactcagctcaggcatcaccttgcctggaaggcttccctagtcctcctgcctcctgcagacttgtctggcaccctgtgcatttgggatttggcacactatgtctcgtctgcggcctccactggacaatgagaccgtaagtgtgtggcttgacagaaagttgttgactctgctggggtgctggtacagtgctgggcacggcagtgttacagaggaagtgagccacttagtttctgcccttaggagcttttattctagttgcacttgaccctgacagctgtgagacacctcccagtagtgcgtaccaacttttcaaagtctgtttaattgtaccttagtgtctgattccaattttatttcttgaaggaggggagtgtctctaatgtcttattttggcacccagagaccaggtaggcatcatttttatcccaaattgtggaaggaatgtacatttgacacagatcacttcccttttttctcttgtacacctttcaccttttttttttttttttgagtttgatgtgtttggacagtaagggtttaagagattaagattaaatttcaactttgtctattgtgcatatagcctaaggaaaacaaaaagttaaagaggaaaaatacattgcctctaaaaagaagactcattattcaactttttttatttttaattgttttcagagactgggtctcaccctatcacccaggctggagaggtgatcacagctcaccgtagccttgaactcctgggttcaagggttcctcttgccttagtcttctcactagctgagactgcaggcccgcaccagcacacctggctaattttacaaaaattgtttttgagagacgtggtcttgccatcttgcctaggctggtgtggaactcctgggttcaagcaaacctcccaccttggccaccctaagtgttgggattacaggtgtgacccattgtgcccagcctaaacttttttttttttttcaatgctgagctgtacacagaagaaagtaaaggtcttggtcaagcctaggaaagaagtatgcaaagaaactggtggcaggctggatgtgggcatatttcagggctttggaaggtgaagaggagaggactgcttgaggccgagagttcgagaccagcctgggcgacataacgggaccctgtctgtacagataaacattttataattagccaggtgtatgtaccctagaacttaaagtataataaaaaaaaataaaattcgccaggtgtggtggtgcgcacctgtggtctcaggtacttgagaggctgaggcagggggatctcctgagtccaggtgtttgaggctgcagtgagctagggatcacaccactgttctccagcctgggctacgaagcgagactctgtctctaaagaaaaacatactggtggcattgtcaagatttgtcaagaaatagccattatgctggacccagtggtgcgcacctgtagtgccagcttttcaggaggctgaagtgggagaatctcttgagcctaggagtttgagttcagcttgggcagcattgcaagagcccagtctcaaaaatattaggtcaataaggtttattttaattaaacaagaaaaagaaatatctgctaaaatttaaagctattctattcttcctctctctcttctagtgttcttggggaagatcccgactaagccattttccagtggcacctcttccatcatgagttcctgaggcagtccgatggggctactttattccagaacaatcacagtgagaccttttctcccaataaatgccccttttctctccttaatatattctcttgcttacaaaacactggtgtctccttatcatggtttggttctaccccactgggcccaagaattcttgcccaggagcaactgaattttcttcttgcttgctttttaaaactttggtggggtagagccaattttaaatcttctgatccattttttcattgtttttctcgcccttctgcattttctgcaaattccgttgaatcattgcagttacttaggtttgcttcgtctcccccattacaaactacttgctggagttttcaaccctagttccctcatttttatgatttatgctcatttctttgtacacttcgtcttgctccatctcccaactcatggcctctggccctggattattgttttagccttttattttttgtcttcttctacctcaacacttatcttcctctcccagtctcctgtaccctatcaccaaggttgtcattaacctttcatattattcctcattatccatgtattcatttgcaaataagcgtatattaacaaaatcacaggtttatggagatataattcacataccttaaaattcaggcttttaaagtgtacctttcatgtggtttttggtatattcacaaagttatgcattgatcaccaccatctgattccataacatgttcaatacctcaaaaagaagtctgtactcattagtagtcatttcacattcaccactccctctggctctgggcagtcactgatctttgtgtctctatggatttgcctagtctaggtatttttatgtaaatggaatcatacaacatgtgaccttttgtttggcttttttcatttagcaaaatgttatcaaggtctatccctgttgtagcatgtattagcacttcatttcttatatgctgaatgatatactttatttgtccatcagttgttcatgctttatttgtccatcagttgatgaacatttgcgtttttgccactttgggctattatgaataatgctactgtgaacaagtgtgtacaagttcctctgcaaatttttgtgtggacatatcctttcagttctctcaggtgtatatctgggagttgaattgctgggtcgtgtagtagctatgttaaacattttgagaaactgctataatgttctccagagctgtaccattttaaattctgtgtatgaggattccacgttctccacttcctcaccagtgtatggatttgggggtatactttttaaaaagtgggattaggctgggcacagtggctcacacctgtaatcccaacacttcaggaagctgaggtgggaggatcacttgagcctagtagtttgagaccagcctgggcaacatagggagaccctgtctctacaaaaaataatttaaaataaattagctgggcgttgtggcacacacctgtagtcccagctacatgggaggctgaggtggaaggattccctgagcccagaagtttgaggttgcagtgagccatgatggcagcactatactgtagcctgggtgtcagagcaagactccgtttcagggaagaaaaaaaaaagtgggatgatatttttgacacttttcttcttgttttcttaatttcatacttctggaaattccattaaattagctggtaccactctaactcattgtgtttcatggctgcatagtaatattgcataatataaatataccattcattcatcaaagttagcagatattgactgttaggtgccaggcactgctctaagcgttgaagaaaaacacacaaaaacttttgcattcttagagtttattttccaatggagggggtggagggaggtaagaatttaggaaataaattaattacatatatagcatagggtttcaccagtgagtgcagcttgaatcgttggcggctttcttagtagtataaatacagtactaaagatgaaattactctaaatggtgttacttaaattactgtaataggtattactattagtcactttgcaggtgaaagtggaaacaccatcgtaaaatgtaaaataggaaacagctggttaatgtggctctggagtttttctaggacataaactgatgagctagaaaagtaaatgtgtcagtccttggtagcacagtttgtacgtttataaattttatccaaatcctcttaatctagtgattaatagacactcttcacaaaaggatgagggaggtatatgtatatgtgttgaaaggttccgaaggatgcaaccgagagtacttcgggggacgtggcaaaacttccaggcccattcaagagtcttgttttctccctgagcttttatgtatttattatattgccctattaattattgagattgtgccttacagtaaaagctgctttaaattgttgacgctataatttaaaataatctgggtcacctagagtggttaaacctggaagaaaaggatatccttcctgccagggcagattgtatgtagatatgcaacctggttgcgcctgtgctgacctctactctgttgggcctggaagtatgcagttcaacgtttctcttctgatttttaaaaaaaatttgactttgtttactttttattttattttaatttagagacaaggtttcactattttgcacaggctggtctcaaattcctgggctcaagtgatccccttgcctcggcctcccaaatactgggattacaggcatgagccactgcacctggccttaactttgaaatgaagttagaaatgtacattttatttttttaattattattattattatttattattttagaaacaggtctagctctgttgcccaggttgtagggcaacaatggtgcaatcacagctcactgcagcctccacctcctgggctcaagtgattttcatgcctcagccttccgagtagctgggattacaggcatgtgccaccatgcccggctaattttttgtatttttagtagagaccaggtttcaccatgttgctcaggctggtcttctgacctcaagtgatctgcccgcctcagcctcccaaagtgctgggattataggcgtgagacaccacgcccaggtgaacagaatagttttccattcaccacagtttgtgacagtctctacattgtgaagtgacaagttctcttctattttccttctgcccctcatcacctttttcttcctcatttcttttttgaattttgctgtcttgaattgatgtctaaaggatgacatagcagacaaggggactgacacatgaactctcatgagttactgaggagtttctcagtgctctgtctgcatcatctgctcactctctccttcctaggtgctagcctgccaacctgctttgagaaattggaaatgaattggggggtaatcagcctccccttgtacatgtagggaccgcatctccaatgccttgctttacataatgacgaatggtgttttgcttacctacttccacacaaactgctgatatggttaggatttgggaaaggggaagaagggaattttgggttttgaggagtagctggggcttgaacaaagaagaggtagtaatgaacattcctggggtgaggcaattagttagctgagggagaagaaggcatataataaattagggattgacagactgtctgtaaagggccagacagtaaatgttttagtcattgaagaccttaaggtctctgttgcatctaatcaactccatcattgtagtgcaaaagtaaccacagccactacagatgtgaatgaatgtgactatgtttcaataacattttttttttttttttttttgagacagtgtcactctgttgctcaggctggagggcagcagtatgaccacagcttattacagccctgacttcccaggctcaagtgatcctcccacctcagccttccaggtagctgggactataggcatttgccaccgccccccattagtttttgtatttttttgtagaggcggcgtttcaccatgttggccaggctggtcttgaactcctgaacttctgggctcacgctctccaccctactcggccaccgaaagtgttgggattacaggcatgagccagtgtccagcccaaaatagtcttttgattttttttcccccaaccatttaaaaatgcaaaacattcttagtttttgggctgaaaaaagacaagtgatgggtcagatttggccccggattgtggtttgtttacccctgttacagaggaacaggaagcagagaggactggttatagggcctgggaagccaagccagggagttagacttaaggtagtatgtaagaggaaaccatttttgtaatgtaatgaaaattttaaaggaaggatgttttgtatttatatgtgttcctggaagcatctgagtttttattcaaaacatgttttcactatggaaaatttcaaacatttacaaagtagagagaaaaatgtagtgaaataccaagtgatgtatttatcacctaccttcaacaattatcagtcctaggtcctttgcatttctgtgttttagaatcaacttgtcacattctacaaaaaagctcctggaatttctgttgggattgttttgattctgtagataatttcaggggaagaattgacttcttaataaaattgaatctcctaacccatgaccatggtatacttctcaatttatttagtttttctttaatttttctcaacaatattttgtagttttcagtgtacaaatctttccagttttttgaagggatgtggtcagatttacttctatttcatatattttgatactgtgaatttcagcttccagttattcattgctaatatataaaaatacacttggtttttgtatattaatcttgtatcctgagaccttaatgtaatttgttttcaaagcttttttgtggattccattggctattctgtcaatgttgtctgtgaataaagacagttgtacttttttcttcccactctgaatgccttttatttgtttttccttcctttactgcactggctagaacttctaagtacataatgaatagaagtgtaactgcccaatgggttcaccttgcccattgcctagacagagcggaatcatcaagacgggaattgtaatagagaaagagtaattcaggcagagcctgctgggtgggagactggagttttatgattactcaaatcagtctccctgagcatttgaggagcagagtttttaaggacagcttggtgggtggggggaagccaatgggccaggagtgctgattggtcaggggtgaaatcaaaaggagttgaagctttcttcttgagctgagtccgttcctgggtgggggccacaagatcagatgagccagttaatcgatctggatggtgccagctgatccatcaagtgcagggtctgcaaaatttctcaagcactgatctcaagagcagtttagggagggtcagaatctttagccttcagctgcgtgactcctaaaccataatttctaatcttgtgtctaatgtgagtcctacgaaggcagtctggtgcccaggcaagaaggaggtctgctttgggaaagggctgttaccatctttgttttaaactataaactataagtttctcccgaagttagttcagtctacacccaggaatgagcaaggacaactgggaggttagaagcaagatggagtcagttaagttagatctctcactgtctcagtcataattttgtaaaggcagtttcaatcgtggtaaaagtggatttccttgtctcatttttgatcctatggggaaaatattcagtcttacgtcattcagtatgatattagctacaggtatttcatatatgctgtttgtcaggtttagtaggttatcctctgtgtggagttttgtatttttttaataaggaatgaatgttgggttttgtttagtgtttttctgtgtgtattgagaagatcatacagcttttctgttttagtttacaatgtggtgagttacattgagttttgaatttttttttttttttttaagacggggtcgcaccctgtcacccaggctggagtgcagtggcataatcccagcttactgcaacctctgcctcctgggtgcaagcaattctcctgccgtagcctcccaaatagctgtgattacaggtgtgcaccaccatgcctggctaatttttgtattattagtagaggcggggtttcaccatgttggccaggctggtctcgaactcttgacctcaggtgatccacccacctcatcctcccaaagtgctgggattacaggcgtgagtcactgtgcctggccgataactttgtttttttttgagatggggtcttgtactgctgcccaggctggagtgcagtagttctacctcggctcactgcaagctcctcttcctgggttcacaccattctcctgcgtcagcctcaggagtagctgggactactggcgctggccaccatgcccggctaattttttgtctttttagtagatatggggtttcaccgtgttagccaggatggtctcgatctcctgacctggtgatccgcccacctcggcctcccaaagtgctgggattacaggcgtgagccaccgcgcccagcctgccttgccgatttttgaatgttaaactaaccttgcatttgtgggataaaccctacttggttatgatatattatcctttttttctagattgttagactcaatttgctaaaattttgtttgtaatttttacatttattttcacgagagatatgggtctgtaggtttctttttttgtaatgtctttgtcagattttggtatcaaagtaatgctggcttcatagaatgagttgagaaatattcttctcagttttctggaagagtttgtaaagaatttgttttatttcttctttagtggaattcctgagtgaatgcatctacgcctggggttttctttgtaggaaagtttttaactacaaatccaatttcttcaataactatagagctattcaagttatttatcactgtttgagcttcgatagtttgtctttcaagaaattcatttattttatgatagtttgtctttcaagaaattcatttattttatctaggttcttgaatttactggcataaagtggtttctaacagtctcttattttcctctgatagctgtagaatctgtagtgttgttaccctttccattcttaatgctggtaatttgtgtcctctcttttttatgagtgtggctagaggtttatcagttttcttgatcctctcaacccattttttgtttcattgatctctgttttacgttttctatttcattgatttttgcttagatgtttattcttttcttctccatactttgtgtttcattgctcttctttttcatgtttcttaaagtaggagctgatttgagtcttttcttcttttccaacataggtgtttagtgttataaatttccctttactgctttaagtttttaaaggtaatttaaggatagcccacaaattttgatatgttatgttttcattttaagttcaaaacacattctgatttcccttttggtttcttctttagttcatagacgtagaagtatgtgagttcccaagtatttcagaattttccagagatattccattattttgtaatttaattaatagagaatcttttattttattttattttattttattttgagacagagtcttgctctgtcgcccaggctggagtgcagtggcgtgatctcggctcactgcaagctctgcctcccgggttcatgccattctcctgcctcagcctcccgagtagctgggactacaggcacccactaccacgtccggctaatttttttgtatttttagtagagacgggatttcaccgcgttagccaggatggtctcgatctcctgacctcgtgttctgcctgccttggcctctgaaagtgctgggattacatgcgtgaaccacaacacccagctgagaatctttaaaattaaaaacaccaccacaatactattatcccatctttaaaaagcaacagttcagaaagaaggaggacaatttgaaagaatacagaaaggatcagagagatcggtgtcagtcaagaaagcctgataaaaggccagtggagtgactcatgcagagtagagggagtggatgagaagagaaagggagagacacatagtcaccagggacaatcaaaggaaaagtaagtgtaattttgtagttgattgaagaggaagatggaggaaggtaaaagaaagctgtgttgaattaaactctagagtgatcaaagctgtggtggttaggattggaagagggtggcacacacttagattgggtgacaaagtttgtagttgtctagaagaacctctgaagtttctctgcttaagtcggagtggaagcagccctggggattgtagtggaaagggagagctatatgtctactagtactgtgacaagatagaagaaagtaagtttaggataaagggaaatttgtccttctggttgtagtgggaaggaaaggagatggatgcttactgtaattctgtgggctgagcattttccttgttagtttccacacatcgtttgatgtggttcttatagcatcctatgtgttagctgtttctacttaaagatgaaagaccgaaatttggagatgagtaatatgcccagagccagataactaataagtagtggagttgttagcatttgaacgcatattctacccaaccagtctgagttctttccacttggtatgtaaattcatgaatacaagccagcaaatgtcccaggctgctcctattcaaagagctgccttctgtgtatcacgtggtctatgttaagtgttatgatctaaaacaatactgctgtttttttttttgttgttttgttttgttttttttgagacggagtcttgctctgtcgcccaggctggagtgcagtgtcgcggtctcagctcactgcgacctccgcttcctgggttcaagtgattctcctgcctcagccttgagtagctgggattacaggcacccaccaccaagcccggctaatttttgtatttttggtagagacggggtttcactatgttggccaggctaatcttgaactcctgacctcatgatccgcccgcctcagcctcccaaagttctgggattacaggcgtgagctaccgcgcctggcgcgctgttcttttttgaaaagaaaatcttgattttgtgttttgaagtccttaaaagcgattgtttatttaagctaaaataatcaagttactcatttattcagtaaatcagattcgacaggcaacattctcagaggcatgtatatgtgtgtagggctttggtgattttttggtgatgtttgtaacctagaatatagtttcgaaggcttagatttaagacttccatctgataaagtgggggtaagctgcagtgaaatctgcatggtagtctattcttgacacttgctgttagtagtaaccttttactgaaagtcaaagtttgcttatgtcttacagtactgttctgaaagtttactttttaaaaatgagaatgaaatattgggaagaaacatcatagttattttacatattctgtttttttagtacctgattggttatgttatattgacattctcgcatgtaattacactttattgcttgaacttgcaatacattgctcctgagataaagacataggtgaagcttatcctaagttggtaacagcaaaattattgtattaataattgagtcatatggtgtgtttcggcattttaacaaggaagtatggaccatgacattttgaatttgaaaggaagtactttttactgctttcctctttttctgtcttatatctttgtcctaccactaagaagtgagtaaagttctagactcagttataggatatcttaataacaggccgtgaactgtgtcactgattaactgacctatctagtaagagttaggatttacttctgacattcatgtactttttgcagtaattcaggctattcacatcatagctttgcttttgtctgtttttcaagtaagaggctgaggcagaagaatcatttgaaccctgcaggcagaggttacagtgagctgagatcgcgccactgcactccagcctgggctacaaagcgagaccctgtctccaaaaaaatgaaaattaaaaataagtaaatgtgaatttcagataaatagtgatgacttttttggtctaagtataccctaaatgttgtctggataaaagacacttaggtgagtgctgtggccagaaaggtaagagggatggggggccaaccaactagagacaagggaaggtatcactaaggacacggcagtggagctgagtcctgaagtgatgcacgagcagttatttctcagggaggaaagtggtaaggggttttcaggggtaggaacagtaggagccaaagtgtgggtatgtgagagtgtgtgactatgtgtgcacgtaaaatggaaatgagatggagggatgggttggagcctggatttgaagaagcaggtatcggcgctggggtatttggcctgggacagtgaggcattattttacaggagagtggcctggtgggatgtgtgctttagagtgtggacacacagctgtggcacagaaggattgctggcaggggagggcgacaggaggctgccagagttgtccagctggacttcttccctgacacagacaggctggcataggattggtgtggtagtggggatgggaaggagggaatgccgcgaggtcaggaacttcttccagtcgccaagaggcgtcttgaccgtttaaaaatgtctctgaagatttagcacaccaaggccccctatagtcccagggtataggccacccttgagattagaaagaaacccctgggagctgtggtggggtggatgtggctgttggaggtgcccctattcagactcctgctctaccatttgctttgggatcaccttttacagtggatctgatattataatacccacttcttatgatgaaaaggaactgaatgagtgtggaatccctaggaccccgctggaatataatgggccctcggggtttagtttctttccttcttgccggtgaggtttgagagggactggagaacagtggatttcgaccatccatttggggttgtcagtctgtgccaggccagctggagactacaaaaaggaggtacaggtaagcaatgaggccctgtggttcattctcagatttcattccgggagatcagagagagcccttcctggaactgtatcctttcctggggaatatgggtggaaatccaagggccctgtgcatagattttcccttctctttcagctctgccagctgccagaactgtggctttctcagcagattgtctgtacacatgagaccttttttacggaacgatttacagaaagacaaacccttccttccaagtttaaccagtccccttataccaaggtttcccagccttgactgtattgatattttaggctgtataattctttgtcgtggggggctgtccagtgtgttgtagggagtttactaggattcctggcctcttacacactcactgtctgtagcaccttgcctcccacccagttgtgacaacgaaaaatgtgtacaggaagtgccaaatatcccctagggtacaaaattgtcccctacccctcattaagtaccactgctttatactcactagacacagggaaaaagaacttcttagcattttttattaatttctttttaacctaaccagtgaaatgcttgttgaaaaaaagacttagtttttactacactgaatttgaattctattttaacttatttagtttagaaagacttctcaaatccaaaattttaagctttttttttttttttttttttttttttttggacatatccttgctctgttgcccaggctggagtgcaatggcgtgatcttggctcactgcaacttctgcctcctgggttcaagcgattctcctgcctcagcttcctcagtagctggaattacaggtgtctgccaccacacttggctaatttttgtacttttagtagagacgggttttcaccatgttggtcaggctggtcttgaactcctgaccttgtgatccgcctgccttggcctcccaaagtgctgggattacaggcgtgagccattgctcccagccaattataagctttttagaaaggattttttacattgttatatttgaaccattaatgaagtgcaaaatgaaatgtttcatttagtatttcacatcagaggttgttataaatgtacaaatagattgatgttttgaattaaaactatggctgacagttaattttatcgataccaaattgtgcaagtttaaactgcctgccaagagtctgagcataaagctgtggtttgaaaggatcctgaataaacgttttctttttgtaaatattcagaaactttggctaaggaggtagtggccagaggagacgcaaaattttttgcattctggcagtttgaactttgggaacgaatgtgttttggactaaatctggaaaaatcacttatgtactgttgccagacattcttttaggctgtccttttccaggcttgtcacttgtctggaatgttaagtgttgtcagtagtttaacgtcctttccagcagcttgcattaaagtgagagaagatctccagaaatggatctgaagaggtcttggcataagattaggacttttatttcattattttttaaaaagtagaaagaaggagaagacttacatggttctaagtttaaaaaaatccaggaagcttctaatcgtttctaattattttcttgggttaagcctcatagaataatagaaatcataagttagtgtgagtgagcttttcgttggccaaaacaagtgggaatacagttgtgctgtttagtggccatttgagttggtattactgataactacctcctttttttttttttttagcatcctatgtgtagttgtggttggtctagcatcctatatgtagttgtgcttgctttcctctctaaccaaagtttgtttttcctttctgtccacgtggggttattatgagaatcagtgccctagtatttgtgcagtgtgggctttccacattgtctggctggtgctttccaggcagcttactttcatagttaaacgacaatggcaacatcaacaaagtgtctctgcctcctcattacccccggctctctccccttcacacatttttgagatgttctttatccttttctttcctactcagctttttattccactccactgcagcatgacttggcctccatccctccactggggattcattggccctgctcaccatcacctccttatcttgattaaagtggccactcaggcgtgactgagcagtctttctcctgtggattcaccttgagactttcttaactggttggacaggcagaaaggagggaattgtgagaagaactgggttaaagcagaaaggagctgcattttccttccgtggccatgaggctgtttaagggggagtgcctacctggagtggggagaggacatagagtacagtttctttcgtcctggagttggaggtagaaacaggggaggtagatctggatgccatctttcctcataagtcataaccgatatcgttgattcctggaaatgggaaactaccctgttaaatgtactacatgttacaattttaggcatagtataaaatctgtctttaaaaattaagaaagtactgtcttataaaaacaagcatttaaaagttgtgcctcagtcagtaagcattgaagttttttgagcagtactggacttctgtctggattcagactgagcagagaatcacatatctgaaggcatcttacccctgcttctctctccctcctgtctgtttcatgcaccttgaatatatgccaacttgcacatgtgcagttttttgacatgacaaggctcagactttccctcttagtagtccttgactttttcagtggagtctcactccaagtctttaaaatgtgtacataaaatgcacctttctgaatgtgtgtcataattcaccataagaaaggttatgtatatgttgaagaatataggatcaatccattacattatgatttatttgatttaaacacttcttactgggtttcttttgaaagttttgattggcttttggtaagacacatgttttatcaaatcgattgttgattttgcttcatttagcagcattcactttctgactctgaagtggccctttccctgagttatagtttcccttgactgtgtgattctttcttctcagtgttttaagtctgttcttaatttacaattttaatatgatctctacattttgaaaatgaagtttgtgaaataagagagataaatatatttagattgcttaggttaaaaaccctttttggattttcagtgggtattgataggcataaaaagtcataattaataagcagttcctcttaaattgtttgattccgtgttctgaaagtacagattatgaaatgaaattttcgaacttctgaaagctactaatccactctcctttataaacaaggctcacagagtgtgggtgacttgcacaaggtcacatagatggtgccagacctgggactgcaatccaggtctcttgatttttgttccagtgtactccatactatgtattttcataatatgtaattttcagtgggaaaaacccataagctaatgttgtttgttgacatctgtgggccatggtatataatctaatataagtagtaggtaaaaacaatctttagtcattccttataaagggtttcttttacaaagtgtcttttgaattgctgcttttattttaataaggcagtagtcatacatggggcatgcaatatattcttctgtaaattatgatagctcatgttatctggtctttactgtgggctgccagcctgctaaccactttaggctcattatttcattgaatcctctcaacatccttataaggaaggtacatagtattaccagcccccttttaaaatgaagaaacagatttcagagaggttaacttacccagggatatagaaggatacagatttgatcatacgtggttgggcagtctcctggatagtagtgttttctttttgttgttgttgttgtttttgaataagcacagagaattattaattaaataggaaatttaaatggttttaaatagcagtacattttggaaacatttgaggggaaaagattctaatggaggtgaataggaggaactgaaagaagaaagtagtgacagcaatcaagatcctggtgtaactacagaatggagagattggggactgtccctgtagttgccaagaggggttcccgtcccaccctgtgccagggctgaaggtgcttctcagccagggaacggccttggagctctcttgtggtatccaggacaatttgtgttgtcctctaatcagggtggatccttctggatgcagtatgacaataagataaatttacaatgtccttttggtatatttctgaaacttgattggtgtgtttttcatgggtggatggttggtgagggtggggtttctgaaccactgaaataagttgctgtccctaaccttggactgttacaccatttttcctttgacctttgatctgtgatgaagtaacttctggaagtgggatatcaggagttatgttcttgttggtttacacatgttattttttacaagaactctataaactagattttatcagttcttttttataggagaagaaacagatttgcagatacataaagtgattaagtgatttgtccagagtcacacaacttggatggcagaactggagcttgaactcaggtctcttgacctttaagttcagttctctactcactgtatgggagacccggaaggagattcttttggtgtgtcacatagccttaccattgctttgtcctatgtaacgtcatcaattatgtgaattatctgacattacaagagtcagaaggtgtcgtagagatgccttagagtccaacttcctttttattgtagatgagaatactgggtggccaagtgacttagattgaagacagcacttgttagaaggaagactaatgggtttcaagtcaaagtcagaatttaaaagtatcctaaaggctggaaccttgggctgatttaccaaataaaaattttaacagataaaggtttagattttttagaatacagattacacagcaatgaagaggaaacgctgggcatggtgatgtgctcctgtaatgccagcaacttgggaggctgaggcggagctcaggctgtagtgtgctatgatagagaaaaaaaattaagaagaaaaggaaagaagtgggatgttgcttactgtacagttttttcaacatttctgcatgtttgtaaaatttcataataaaacattaggggaggctgggcacagtggctcatgcctgtaatctcagcattttgggaggctgaggcagtgggatcacaagatcaggagatcgagactatcctggccaacatagttaaacccgtctctactacaagtgcaaaaattaacggggcgtggtggtacgcacctgtagtcccagctactcgggaggctgaggcaggagaattgcttgaacccgggaggcggaggttgcagtgagccgaggtcgtgccactgtactccagcctggcgacagagcgagactccatctccaaaacaaaaataaaagggggaaaaaagagaacagtagcttagcagcagtttgtgtggtaaaagacttgaaaatattagataaccatgaacttatcatgagcctctggaagctcctagaaaagcagatttttttttcttagattaaggtaggagcagctcagtttctagatcgagggaaataatagtcttgctgagctctgtgcttgccagaccagatctgtcttgtatctgtgcccacttccgaggtgcctgtcatactttgatgccagtggacacagggtactgaaatctggaggagtggatggggaatgtgtggtgctgacttggaaggagggccaatttagggaatcgccatggtggtcttcagatactgggggagttgtggagtgagagtggtacttttattttgaacataaagcttagattaagggagagcaaagacattacagggaattagatgcccattctgttttcctcatccctgaccctcccattctgtatcttcagtacagcagcgcaggttagtctttgggaactgcaagtcaggttataggactgcacggcttttattcaccgtcctgtgtcacatgaagcccagggcttgactggtcttctggcccttgccgacaagtcctcattttgacatttctgtattctagccatactgtattctagccaagtcattagagttcttcagttgaacctgtgtttactctcataccttcgaggtgtacctcctactttgttgcccaaagtaaggcagaattggggatctttctgcttccattgtatcctgtacatatacttgccctgttttttgttttttaaagtaggttcataaaggatggggacctattttgttcatttacatgtcctgtttattcctgtagactgtgaactccttgaaagtaggtatttttgtcctagtcctttttttttttttttgagatggagtctcactttgttgcccaggctggagtgcagcggcacgatatcggctcattgcaacctctgcctcccgggttcaagcgattcttctgcctcagcctcccaattagctgggattacaggcacgcaccaccacacccagctaattttttatatttttggtagagacagggtttcaccatgttggctaggctggtctcaaacttctgacctcacttgatccacctgcctcggcctcccaaagtgctgggattagaggcatgagccactggggccggcctgtcctagtctttatatgcccatatatttgagtcctccttgactaggttcccagagaattggtgcttggcttgcctggacatggaataaacgtttattgataaataaatgttgtgcccacaatgacttgcctcataactttttagtagtcaggatcctcccacagtagactcttgtaactacaagaatatttttttgtcgatgttgcacgtagagtttcctgtaaaatggcttccaagatatttttcatttctagtaaagagtctatgagttgagttttaaatagtattatgtctaccttatgtggtaggtaagagatagccctttgttttcctcaggaggttttaattatatgatctccttgtagaagtaaaggaaactctggagcttcctgtgtggctgtgaatgtgtaattagctttgggcagggctcccagagctgtgaaccctgtcctgaggagcactgggacattctagtgagcgttcaggccacccagattgcagccttgtaaatgaagggtttatttctctaatgagagtggtttgtgtcttcacccaaataatattttaatattaaattatggcaaatattttaaatttaaaagtagatatatataaattagtatgatttttaaaataatttcaataattgttttaaaaagtaattttaatacatgtcaataatttattttagactcaaggggtacacgcacaggtttgttgcatgggtatgttgcacgatgctgaggtttggggtacggatcccgtcacccaggtagtgagcatagtttttcaactcatgcccatccctcattcccttcttccaattagtatgattacaactaagaattttacttttacagctctaatttaatacatattgatctagacctggcaataaatattctgctctaagaaaggttttatgttaaataacatggtagttagtcccttcaaaataaaaaatgttgattaagaataccagcacgggcccggcgcggtggctcacgcttgtaatctcagcactttgggaggccgagggcggatcacctgaggtcaggagttcgagactagcctggccaacatggtgaaacctgtctctagtaaaaatacaaaaattagccaagcgtggtggcaggcgcccataatcccacctactcgggaggctgagggaggagaatcacttgaacccgggaggcagaggttgcagtgagccaagatcgtgccgtcgcactccagactgggggagaagagcaagacttcatctcaaaaacaaaaagtataccagcactgatgacaacattggacaagtagacagatctagaaggggcaggttgagctgtgtagttttagtgttgtcacggtttgtttatatgttgtgaaatattcattgagatcaaaatctggcattcctaacttgtgttatgtgtatattggaggccatatggagtggcagaagtgaagtggggtttgaattcagaccgttgttcctcaagaatgaattgacctggagagaattacttgcaatctctgatccttagttccttcatctagacatacccacctgggatcatgtgaggatccagtgaactgtacaaggtaccgcacaggacatggtgcttgctgcctgggagaggctcaaggccttcagtgcctttccctgttattttgggagcagtgcatctattttggtgtttttaagaaacactgtttgacaaatacatgaggcatacttcatggactattgtttcagattattcttagaacacagaggcaggatccacaatgtttttatgaggagagctactttttattcccccaaaccttgactttcctggactagaggtctcagtgatgtgtgctgatgtgacacccttgagcaaagttggagaagagagagtggtaatttccaccacttccccttctccaagacactggaagtgctgtgaactgtgctccttcgctcctctgctctgtaatctctgcctgggggggctctagaggggctctagggaggagtgtcagccagtgatttctccatctcgaccaggtagggacccaggaccttctggtgaattctaatttgtttttttatgagcctgagggtcatttaaggaatttgtggaagcatttgtgattgtctcagtggttggtgggtgctataggcatttatttaataggtagggcccatggaattcaaggcttagtgtggtgacagttctgtaaaatagaacttttcctatgatctgcacagctttagaatatcttttttttttttttctgagaccaaatcttactctgtcacccaggacagagtgtagtggtgtgatcccagctcactgcaacccgggttcaagcgattgtcctgcctcagcctcccaagtagctggaattaagagatgtgccaccacgctcggctaatttttgtatttttagtagaggcggagttttaccatgttgaccaggctgttctcgaactcctgacctcaggggatccatccacggcctcccaaagtgctgggattacaagcatgagccactgcgcctggcctagaatatcttgatgaataatttatgtagatagaaaaaaactgtttaaggccgaacctataactgaattccattttacataaagggtttttttaaatgtaattttagtagaaatggaaatttcaggaaatggaattagtctagactttgaagggaaattatctcattttgttcttagttttattaagtgtattactagtcttggttctctcaagaaacagaaccgatagcatatatatatatctctccagtaggacagagagcgagatgtttatatatatagtatatttaactatatttaaccaatatatatgattgtgtcatgcgcatcctattggttctgtttctctggagaaaatataagtattcaccagttgccctttatctatggttttgctttccatgctttgagtacctcatggtcaaccaaggtctgaaaatattgaatggaaaaattcctgaaacaaacagttggtacgttttaaattgtggactgttctgaatgacatgatgaaatcttgtgcggtctcattgtcacacctggaagatgagtcctcactttgtccgatgtatccatgctgtgtgtgctgcctgcccattagtcccttagtcttggttatcagattaactgtctggtatcacagtgcttgtaacccttatttcacttaataatggacccacagtgcaggagtagtgatgctagcatattgtattattgcttactttattattagttattgttgttaatctcctactgtgcctaatttatcaacttaactttatcataggtggtatgtatacatggtccccaacttactgtggttcgacctaagatttttcaactttatgatggcatgaaactgtcacatttttaatgtaatgtataatattcaataaattacatgaggtgttcaatactttattataaaataggcttcatgttagatgatttttgtccacctataggttaatgtaagtggtctgagcatgtttaagataggctaggctaagctatgacgttcagtaggtaaagtgtattaaatgcatttttgattcatgatattttcaacttacgatatttttattccatcataagttgagcagcgtctttatgtataggcaaaaacatagtatatatggagttgggcaatatctgcatttttaggcatccgtaggggttcttgaaacatatccccctcggataaaggggaagcattctatatataacaagatccttattaaaggaattggctcatgcaattatggaggctgagaagtcccaagatctgcagttggccagctagagatccaggaaagctgatggtgtcattctgatctggctctgaaggcctgaaaaccaggagagccaccgatgtaagtttctgtctgaaatccagcaggctttagacccaaggaaaaccaatgtttgtttcagtttgagtcagacggcaagcagagatgtcccagctcagcagtcaggtgggaggggctccctcttacttagcctttttgttttattcaggtctacagttgatgagatgaggcccacccacattagggaagttaatctgctttagacagtccactgaataaaacgttaatttcatccagaaacaccctcacagaaacacgcagaataatatttgaccaaatgtctgggcaccccatgatgcagtcagattgacacataaattaaccatcacactgagagtgattcacctttttaggtaaatgaagaatcaatcacattattgatagcattcatgataggtagggtgatatctgagttgccaaaatgacatacccaaatgaagagtatttgtagctgtgaaattcagtgattcaacttagagatgtggatttctgaccattttagtcctaatatagtcctgcctgaaaatttacatattgaaatttatatttattttattaaaaattgtttttatattatagttgctgtgttaagtagatatttttggaatatatatgtaataagttatttctgaattttatttcaggatagtaaaggtatattttcaatagtttttaaagaacgggggtgaggcatggtggttcacacttgtaatcccagctattcgggaggctgaggtggcaggatccattgagcttggaaggtcaagactgcagtgagccgtgactgcaccactgcactccagcatgggtgacagagtaagaccctgtctcaaaaaaacggtgaacagggggtatttgggtctgatatggctaagaaccagccggtctaagtgatctcaagctgccagcctccttgaacagtctgcatctcagcatctttaaaggtttgactgtgtttcttttctcctcttggacctctgcaaaaccataatctttctctttatcacatattttacagcattggcatatattttccagaagtccttgttcgacttacaatgtttttatttcatcataagtttaggaaaaacttatggttttttttttaattttagctctattgatatgtaatttatatgtcatacaatgcacttatttaaagtgtaaaacttagtggttttcaatatattcacagtattgtgcaactatcaccgtgatctaatgttagaactttgcatgtctacaaaaagaaaccctgtatccattagtagccagcctctatactccctaccccaacccctggcaatcacttatattctttttatctctatagatttgtttctgctagataatttatataaatggaatcatataatacatggtcctttgtggccttccagtttttttgttctttatttaaaaaagaaaacaagatacatgtgcagaacatgcaggtttgttacataggtatacatgtgccatggtggtttgctgcacctattgacccatcctctaagttctctcccctcgttccccaccccacaacaggccctggtgtgtgttgttcccttctctgtgtccttgtattctcatttttcacctccacttatgagcaagaacatgcagtgtttggttttctgttcctgtgtttgctgaggatgatggcttccagcttcatccatgtccctccaaaggacatgatctcattccttcttatggctgcatagtattccatggtgtatatgtaccacattttcttcatccagtgtatcattgatgggcatttgggttggttccatgtctttgctattgtaaacagtgctgcaataaacataccgtgtgcttgtatctttatagtggaacgatttgtattcctttgagtatatacgcaataatgggattgctggggtatttctggttctggatccttgaggaatcaccatactgtcttccacaatggttgaagtaatttacatttccaccaacagtgtaaaagcattcctatttctccacaaccttgccagcatctgctgtttcttgactttttaatcattgcaattctgactggcatgagatgttatctcattgtggttttgatttgcatttctcagatgatcagtgatgttgatatacagactaatagaacagaacagtgatgttgatatatagaccaatggaacagaacagagacctcagaaataacaccacacacctacaaccagctgatcttcgacaaacctgacaaaaataagcaatagggaaaggatgttgtattcattaaatggtactgggaaaactgggtagctgtatgcagaaaactgaaactggaccccttccttacaccttataaaaaattaactcaagctggattaaagacttaaatgtaaaacccaaaaccataaaaatcctagaagaaaacctaggcaataccattcaggacataggcatgggcaaagacttccatgacagaaacaccaaaagcaattgcaacaaaaaccaaaattgacaaatgggatctaagtaaactaaagagcttctgcacagcaaaagaaactatcatcagagcaaagaggcaacctacagaatgggagaaacttttgcaatctccccatctaacaaaggtctaatatccagaatttacaagtaacttaaacaaatttacaagaagaaaacaaccccatcaaaaattgggcaaaggatatgaacagacacttctcaaaagaagacatttacgtggtcttcttttatttggtacagatgctcctttatttaacgtggggttacatcctataaacccctcgtaagttgacaatgtcatgagttgaaaatacgtttattatacctaacatactgaacatcgtagcttagcctaacctaccttaaacatggtcggaacacttaaattagtctacagttagacagaatcatctaacacaaagcctattttgtaataaagtgttgaatatcttatgtaatttattgagtacagtactgacagtgaaaaacagaatggttgtatgggtactctaatgtatggtttctaaaggtttattgctttcacatcattgtaaagttgaaacattgtaaagtttaaaaatagtaagtcaggggtcatctgtgtattgttttcaaggttcacccatattataatatatatcagagccaggcacggtgctcacgcctgtaatcccagcactttgagaggctgaggcgagtggatcacgaggtcaggagatcgagaccatcctggctaacacggtgaaaccctgtctctactaaaaatacaaaaaattagccgggcgtggtggtgggtgcctgtagtcccaactactcggaaggctgaggcaggagaatggtgtgaacccgggaggcggagcttgcagtgagccgagatagtgccactgcactccagcctgggtgacagagcgagactccgtctcaaaaaaaaaaaaaaattttttttcaacttttctgtagtgacatctagctttcaaacagttttatcacatggtaaaattcttcgaaaacaaatttctaaagcgcttccttccagttatgttctcagtgtaatgccatttttttcccacagatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaaggtattcatgtgatgtttgaatacatgatgggtttttggaggactgaatttaaatatgatgtttaatatattaaatgagcattcttaggggtgtgccctcttctggtgctgggaacacttggcctttgaagagagcttacagtggggtggacctaattgctgtttttggtctgtctttttgaatgaaaccagacaataggcttgttcatgaaacaataattgagcacctgccttgtgcaggatgctgtgattgtgtgagctggaggtacagtctgccttcagggagcttgtggaggaaagggtggaggcaaggcacaaacatgaataatgaaaatacccagggagaatgtcagataccctgggagagcagtaaagcattgtgaacagtttcaggtaagtaaatattgtttcaagcctgggaaggttttatgaaaaggtcatgtgagccaagtctggcagtcctgtgacccctagacaggtgtttttatctgcctgtctccctcactgtcaccaccacaaattgctgttcttctggcagctggtccacgatgatgatgatgatgatgattataccattttttaaaaaagagatgagatattattcttattattactattaccatttttttttaaatagatgagatctatgttgcccaggctggtctcctgggttcagtggatcctcctgcctcagcctctcgagtagctggactagaggtgtgcgtatgcatgcacaactggaaacatgatctgttcattccaggcagggccctgatagatcatggcttaattattttaagaaggaactcaggaacagccgatgaggaacttccttatatgtgtagaaagatctaacaggaaatgctggtttttctattctaaggttgttggaactgaacccaggcttattcccttggctcggagatgcacacagattttctcctagctgtggccctgaggaattgttaggtatcattctgtgacctggaggatggtgccaggaatagacccttgcccagcttccattgtctcagtgaacacactgaatcattttgttggtggcagtgctgctgctttttggtgtaagacaggtggcattttctgacctaactggttattcagttgctggggctctctttggcgtggagtgcctgtgtgactaggtgacctgttatttatgtgactggaagaacaggttgaaatgttggcattagatgtgcactgctgccttccttctgtggcctcttcgtcagaggcaggcagtgtctttggaggtttactatggaatgtgcactgagcaggcatgttacaccttctgagtcttggatctggagttgctgggaatttggtcttgaacagtgagtacttttccactgtaaagcaaaactgtacacttactcttgccagcacatgccagctgtccatagctttggctctgctgcattaacaagtttaaatagggtgtgtgtgtgtgtgtgtgtgtgtgtgtgtgtgtgtagcaggaaggtcaggacagaggtaaaactatttggcaacacttttcctggagtggagcaattgccttcacttaagagaggggaaggaaaaagtcattaaatggagattaaagtaaaaacagagaaggaaagaagaaaatagtgggaaaaaaatggaaaacattgaagggctttgagaccccacagtgttattttatttttctaacttttttttttcctgtgcttctctggcacctagatacttcctacaatttgaattcctttaactgtcatggagcattgatgattaaccagatgaatgaagtgtttggcttaattattgagacagcatgtgcacacacccattcatttatggacacccacacctgtgtgtctgtcactgcacaatattctcatgactctcttcttgtagtgacaggatacaggatatgcatttcttcacctctcatttcaagtattgtttgaggctagatgtagttgagggttaaggggaaggactcttttgatccaggacacttcactgctggttggagcttttgtaaatacaaaacactactgctgctcacagtgagttttggagacattattcccacttctgtcaggagctgtgtcattgggcttgcagcctttgtatgcttaattctccttggtcacagtcagtggagaggattattttccatgtagagagggtttcctgcatgcctacgctttgcagggttcacttactgttcaggtgttcatgattagttcttttgaagtaatatacttttccattatactgatgataattttttctaaaaattacagacatgaattaataagcttcagttagaatctataattgatatttctccatgattatttgtggtcatacagtgtaaacatttgttaattgtatgaacaatcctcctcggaaacttgaaaggtaaaatttgataacaaatcttcaaatttgagagaaagatgcatgtgaaacttgggcttgacttagagaagtatacgtacctggttgtagtatttcattatttgtgtccggaatgcttgtaccaaattatttgcattttgcatcagttacaaagagtaggctgaacatttattccttcatccatttcatgtttttagacttactgatggggggtgtttatgtgtgagaatgcacatgcctttacagaattttgtagcaaaaattaaaagaaatagggaaaaatagcagagagcctgctagtagcttagggtaaaaggtaagttggaaaatgcagagttgtgttttgttttgttttgactttttttgttgaagtaaagcatacgtacagcaaagtccacaaaacacaggtgttgagtttagtgaatcatcacaaaatgaaacatgtccttcagtcaccacctagttcaagaaacagaacatatgtgcccctcagaagcttccaccgtgcctctgcttaatcattgcccttcctgtcctcccccaaagtaactaccattctaacttctagcaccagagatgatttttgccagtttttgatctttacaggaacgtagtcacacactatgttctttttatgtgtgtctggtttcttatctgtactgttgcatctagcagcggtcacttccttttcattgttggttagtaatccatgggatgaatataccacagtttgttcatctcttctgctattggcagacttttactactattggcagacttttggagtttcttctctgtggttatgagtattattgttatgaacattcttatatgtgtgtattaatacacatgtgcacccatttgtgttggttctagaatgaggagtgaaattactggaccgtagagtatacctatgttcagctttaatgttatagatagaagaaaatcatttctcaaggtggttaccagtttacactcctggttacttcacattttctcctgtacttaaattgttactcctttcatgttaagcactcacggatgtataaaggaatggagcagtggcattaatttgcatcgttaccagtaagattgaataccttttcatacaatcttttttttttttttgagatggagtttcactcttgttgcccaggctggagtgcaatggcgccatctccgcctcccgggttcaagcgattctcctgcctcagcctcccgagtagctgggattacaggcatgtgccaccacgcctggctaattttttgtatttttagtagagacggggtttctccatgttggtcaggctggtcttgaactcccgacctcaggtcatccacccacctcggcctcccaaagtgctggaattacaggcatgagccactgcacccggccttatacattctttttatgtgctcagtggacatttagaccctcttctatgaagtgcctgttcaagtcacttgcccatttttccgttgtcttttttttttccaaacttttttttttattgtggaaaaatacatacaacattcatcactttggccttttaatttttaattttaattttttaatttttttaagagatggagtcttactctgttgcctgcccaggctggagtacaatggcgtgatcctagctcactgcagccttgaactcctgggctcaagcggtcttcaggcttcagcctcctgagtagctggaattacagatgtgtgtcacatacccagctaatcaaaacaaaattttttttagagacagggtctcacttttttaccctggctggtctctaactccttggcttcaagtaattctcctgtgacggtgggattttaggtgtgagccactgtgcccaaccatcttaacaatttttaagtgtgcagttcagttctgttaaatacattcacattgttgtgcaaccatcatcaccatccatctccagaacttgtcatcttgctaaactgaatctctgtacccattatataatgactccacattccctcttctctccagcgcctgacaaccaccattctactttctgtctctatgaatttcactgctctagctaccttatataagtggaatcatataccacttgttttgtgtctggcttatttaacttagcatcatgtcctcaaggttcatccatgttgcagcatgtgtcagaattccttccgtttttaaggctcaatagtgttcattgtatgtatatgctatattttgtttatccattcatctctcagtgaacacttgggttgcttccaccttttggctactgtggatagtgctgctatgaatatgggtgtacaaagatctcttcaaggccctgctttcaattttggggggggtatatacccgtaggtggaattgctacatcatatggcaagtccatttttaattctttaaggaactgcctattgtttctcgctgctagcagctacaccatttgcagtacataagggttccaattttttcgcgtcctctgcaatagttgttattttgttttttgatagtatccattctattgggtgtgagagggtacagtgtctttttgcactgatttgtggttctttacctcttctagatgtgagccctttatcatttatacatgctgcatgtatattcccccactctgccttgctttcgctctcttctctcccctcccctccacttcataaaggtatgatacctttaaaggtatcttcatgaacagcagttatttattttaatgtagctcaatttattaatcttttctttatggggtatgtgtgtctgtgtgtgtatgtgagtgtgtgtgtgtgtgtatgtatgtacgtacgtgtatgtgtatgtgtttttgtttaagaaatcttaacccatccctaggtcaaatgaaatagttgcctatatttttttctttttctttttgtagaaacaaggtctcactatgttgcccaggcttgtctcaatctcctgattgcaggagatccttctgcctcaccctcccaaagccttgggattacaggtgtgagccaccatgcctggcccctatttttttttttctaaaagtgtttttctaaatttcatatttagatcctcaatctgtctggaaataatcatgtaaaatctttttattttgaaataattttagacttacagaaaagctgaaggactagtactaagaattccagtatactctatcaagattcctcatatgttaacctgtcatgattatcacttccctgtatataccatgtatacacacatagtttttttgggggtgggggggctgtttcagcatgaactatagacataatgctcctttactgctgaatatttcagtgtgtatttccagaaaaacaaggacattcttttttataaccatagtaataacattgataggatgctagtatctaatgtataacctttcattaaattttgccagttgtgctaatttcagatatagcaaaagagaaaaaaaaatctgttttctggcccagtatccaatccaggattatgtattgcatttagttgttatgctcctcatcctatttaaattcggaatagtttctcactctgtcttttatcaccttgacatttctaaggagcgaaaggcagttatttgataggctgccctccagatttgggtttggtaatatttccttgtgataagatttgggttatgcattttaggcaggaataccacagaagtgtatggaaacagatggcttccatgttttccattgtgggggatgttaacttcctttggctaggtttctccactgtcaggttactgtgttcgctcttgtaattaataagtagcttgtcagagatactttgaaactttgtacatatatctatccttttttttactagacttttcaccctggttttagcattttttttggatagttctttcccaaatcagttagtattgtgatttttgccacatggtaattttctaattctgtcattccttctacatgtgttagttggcattctgctacaaggaagagtttttactttcccttggtttatatattcatttatattattgtaaattcatagattcttagtggagtataaattattaggatcatttagttttatgcctagattatccctgatttgtccactgggagcccatcaggctggttcctgtgtccttttgacatgttcctattactctttgagcacttccttcatttctgacgtagtaagttttgtaccttttcggtcccagccctagaatcagccatttcttcaaggaggccttgttctttttagtggaggatagtacttaaaaaccaagacctggaggttagatgtgttcattgcttttgggacacacacacacacacgcacatatctatgtcaatttctgtatctgtatctattaaaatgtgtgagttcacactgatatttccaattccattgacttaaaaggttcataatagcctttccacatcctataattgtaatccatttatccaacactgaaatacctggcttctacagcctatatttacttattttctctccaccctagaatgtatagaaaatagttttagaattatctgtacaactgtgaaaaacagtttatcaactgaagttcaatttttttttctttttgagagtctagctctgtcgccaggctggagtacagtggcgagatctcggctcactgcaacgtccgtctcccgggttcaagtgattctcctgcctcaggctcctgagtagctggggttacaggcacatgctgccacacccagctaatttttgtatttttagtagagacggggtttcaccatgttggccaggctggtcttgaactcctgacctcgtgatctacccacctcgtcctcccaaagtgctggaattacaggcgtgagccactgcaaccggcctgaagttcaatatttgcatacttttgtctttggcttgagagtttgaggatttatggtcaaaatactaccgtggtgaaaaaatacttgggttgtgttgttcatttgaaatacagttagtctgtttgttcctatcctattccattttaggtttttcctatctttatttaaattttatttatttgtttattttcagcatatgaaacactaacatggctccacgagtcagaactatatgagaagatatgttcagaaaagtgcccctctcctcccctgttccctcttacgcagttcccacccatcccagaggttaacaggcaatttagtttttgtttattcttctcatgtttctttttgcataaatgagcaaatacacattttttatttccttttttacacaaaaggtggcaaaatatattcttttgcactctgttaatcttttcacttaatgtactctagaaatctctctccataccaattggtagcagtctttcttattttttgttgctgtttaatacctcattgtattcactaaagtgtacttcatatgctttcctgtgtatatataggcatttaaggcgtaccagtattttgcaataaaaaacaatgctgcagtgaataattagccatgtgcatatgtatttttgtattattggaggtgtatcttcaggttaaattcctagaagtgaagttgctggagagaaggtaaatacatgtgtaactttgttagatattgcatgattcctttcataaggcttatgtcaaggtgcatcccatcagcaactaaggagagtgcctgtttccccatattctttccaaaagagcatgtttaccaatctgttaagtgacaagtgctgcttaatttgcatttctctcattatgagttaggttgatcatcattttctctgtgtgtgtgtgtgtttgtaaactgattgtgtgattcattcattttgttcatttttctgtctttttttttggtctttttcccctcaattttaaagcattctgtgttagggaccttaaccatttgtttgtgagatattgcaaatatactttcccagttttttatgttttaaaattctatttatgatggttttttggttgtacaaaacattttaactttttttaattaaaaggattttttatttttaagattttaatttttatgtagtcacatcgatcaagtctttgttttataattttagatttaaaatcgtagttagaaaacgttggactttatgtttgatatggtgtgaaataggtctcagcatttatttttgcccccttggtgtatacacttgacctagcaccattttctggaaaactcttgttttctcccttgctgccttggttataaatcaagtgtctataaatatgcagtttctttatggactctgtttcactagtttattcttgttccagtgctgtactgtcttaatcattataagtgcaaagtttatgatttggtgccgttatgtgtatttaactttgtcattagccaaaggcaaattgtaaccagagaagtgtgatgagtagtccactttgacatgacaatgtagggtggttttcaatgtaattattatcaaatggaagaatttaacttacggaggaagaaagattagttcaaagataattttacttttattagcaggatacaaaagaagattgaaaatataagaatgtgttgagtttacttactggctatttactggctaagagaggagggacaaattggcaggaaagtggtatgactttcattgtgtgacttcggcatcatagttgatggccagtttttgtgaacagaaacaagtcttaaaagtatgaacagaccaggcatggtagctcacacttgtaatcccagcagtttgggaggccaaggtgggcagatcacttgatgccaggagttcgagaccagcctggccaacgtgggaataccccatctctactaagaatataaaaattagctaagcatggtggcgcatgcctgtagtcctagctacttaggaggctgaggtgggagaatcacttgtacccggaaggtggagattgcagtgagccgagatcatgccagtgcactccagcctcggtgacagagtgagactttgtctcaaaaaaaaaaaaaaaaaaaaaaaagaatatgaacagtccttgaaattaatgcagtgtttccctctctttttatgtattctagatttcataatgtaacagcccttaattactagagttgaattctgtttaattcattgaaaatatttatccctttttctgcctctttttttggggggcgggtggggacagggtctcactctgttgcctaggctggagtacggtggcgtgatcacagctcagtgcagctttgacctcccgggctcaagcgatcctctcacttcaaccttcccaataactaggactacaggcatgtgccactttgcccaggtaattagttttcaaattttttgtagaaacggaatctccctatgttgcccaggctggtgttgaactcctgggctcaagtgatccacctcggcctcccaaaatgctaagattacaggcatgagccactgtgcccagccttttctgcctctttttaacctaatggtactgtattagaactttgataattgaataacagaaatatgcttcatatggactcactgacatttagaactggaagagactttagagattagttacttatgaactatcttaccttgtagaaatgaattcagtatgattatctgagagagggcatggttccagatagaagatagtgtaaatcagttggctaactcatgccaaagagagaaaacttttgggttcttttgttaaaaagtagtttttctctttttttcccccacatatctttaactgctctgtgttcccttcatttctaggagaagtaaaaacgtttcttcactactttttagaataataaatttacagccaatttattatccatagtgttttttaaggctcatgttttttaaattgcctttataaaatataaatattgcagatggtctttctcaagtaataacgatcatttagacagcagaaccctttctcaaactgtaaagcctctagttttttattaatatattatgcatgttttagaaaatacctcctttcaattgtgactaaaatttgattactacagaattataaggtaaaaaagataaatttcagaataaattcttttagatactggcctcatcatggaatcactttagagcagtgaagattatttgactctcaaggatatttctttctagaaattgcaagatgacacttcctgtggcattataggactttcccaagatatcatgtgctatcccccatcatctgaatctggcatatgtggacacatagcaggcttccataaagtctttgattacatgtacgagtttattattttaaaaagaagtacgtgattgtttataaacctataaagaagttctgtttctgtaggacagtatggtgtgctgcttactacctgtcagatagttttggtaatagggctcttgaacttagtataaaagtcatgagctttgttgagtctcaaaatatctaatcttgcttgatctagtaaatttgtttttattttctgttgcttctagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggtaacggtgacattcagtctgagacttcaactgcttttttgtttgaatgggcatgatgcattggtgtttacagtgttccatctaattataggaaattttagacatacaaaagtagatggattgatatttcagcccaatacgctcatcaccattatcaactcatagccagttgtaactcctgatacccacccttccctcttattattttgaagcagattctggacatcatatcatttcatccataaatactttattatcttggaaagagaaggattcttttttttttttttttttgagacagagtcttagtcacgcaggctgaagtgcaatggtgccatcttggctcaccacaaccttcgcctcccaggttcaagcgattctcctgcctcagcctcctgagtagctgggattacaggcatgcgccaccatgcctggctaatttttgtatttttagtagagatggggtttcaccatgttggtcaggctggtctcgaactcctgaccttgtgatctgcctgccttggcctcccaaagtgttgggattacaggcatgagccactacacctggccaaggagaaggatttttctttttttttgagatggagtttcgctctgtcacccagactggagtgcaatggcatgatctcagctaactgcaagcttcgcctcctgggttgatgccattctcctgcctcagcctcccgagcagctaggactacaggcgcccaccaccaagcccagctagttttgttttttgtatttttagtagagacagagtttcaccgtgttagccaggatggtcttgatctcctgacctcgtgatctgcccgcctcggcctcccaaagtgctggtattacaggcgtgagccaccacgcccgaccagagaaggattcttttaaaaatataatcataataccattatcagtccttgaaataactgataatcattccttaaatcataacttattcaatgagtatttaaatttccaacagtcttataaatatttttgttttatttactgtctatttttatatttggatcaggactcatgtaggtccatatataattggctgatgtgtctcttaaatcttcttttttaaaatccatgggtttatcctgattcttgcagtttaatttttgtggaagctggtcatatgacctatagagtttctgagcatgtggatttttatatcgtaatacccccatgatgtttttgcccatcaccctttattgtctgtatttattgtaaatggcattggagccttatgggacagattcaggtcccctgtccccccattttgaaaacaaaacaaccaaaatacaagactccttcataggtggtggtgtgtccacccatcaggaaacacatagtttttgattgtccctctttaaatgatgttagaagcctctgatgatcagtgcctagatccattcattctaattctgccatctttcttcattcagtaacaggtatttgtttttagatttgatggagttgataaattatcctacagtccaaggagtaatgctctcatattttacttcttacgtttatagaaaaagaactttaaaacttctagtaaacataagatcaagtgtttgtaataaagcttatgaaggcaaattgtaaaaattacatcagatccttttctgtcatcgtaatttaggctcttagcccctcttgtgtgtattagactctcctagcccaggattacctactgtcttcatttttgctttggctttatgcagattcttccttccatttcagattgggcctccctgttaatgataataggtgcgattaacaggaaggaatattgaagtccttgctttctgatttacaggcatgatttcattttatcctcacctgtagtcctgtgagaactagtatcctcattttagagatgagaaagcttaagtgtcttggccaaggccatgcattcatttgctcagtaaatatttattggggatctgttttgacaaggccacaaggctggtggtgaggcaaggtcttttactcccaagcctggggtcatcaccacatttaacattgtagcttatgtggtaggaaggaaattaaatactcttgccatttgcatgtcttcctgtttcctgcctttagaattgtactgggagagattccatgtgtttgtatacttagtttcttactgactgatgctacctgacctcaggattcagttatcacctctctggattagctgccccagtatggctttgtacgtttattttattttgctggggatgtcataacaaaataccacagactggatggcttaagccacagaaatttattttctcaaatctggaagccagaagtctgaaatgagggtgttagcagatttactttctcctgagatctcttttttgtcttgcagatggctgccttctctgtgtcttccctctgtgtgtgtgtcctcatctcctcctcttacaagaacgccagtcatgttggattagggcccaccctaatgacttcatcttacgttaattacctctttaacttcattatcctgtctccaggtgcagtcacatttgaggttttggggttagggcttcaacatattaattttgtgtgttttgtgcgggcacagttcagcctataacaacatccttattcttcagttcatctgctctacctttacctcctccagtgactttcctaagactgtttgatttccatgtatcaattcacttgtctttacctcagattattctgtctactcattacagtaatccagagaagaatttttcttcttttatctttcaaacatgaacagattttctttttatttatttatttatttatttatttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactctgaacgagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaattaaaagtctcccatgtctacctctttctacacagacacggcaaccatccgatttctcaatcttttccccacctttcccccctttctattccacaaaaccaccattgtcatcatggcccattctcaatgagctgttgggtacacctcccagacggggtggtggccgggcagaggggctcctcacttcccagtaggggcggcgggcagaggcgccctcacctcctggatggggcggctggcgggcggggggctgacccccaacctccctcccagacggggcggctgggcgggcgaggagctcctcacttcccagtaggggcggccgggcagaggcgcccctcacctcctggacggggcggctggcgggcggggggctgacccccacctccctctcggagggtgtgctggccgggtggtggggctgatctcccacctccctcctggacggggcggctggctgggcggggggctgactcctatcctcactctcgaacagggcgggctggctgggcagaggggctcctcacttcccagtaggggcggccgggcagaggcgccctcacctcccagatggggcgctggcgggcggggggctgaccccccaacctcccggacggggcggctggctgggcagggggctgacccccccacctccctcccggacggggcggctggccaggcagaggggctcctcacttcccagtaggggcggccgggcagaggcgcccctcgcctcccggacggggcggctggccgggcggggggctgatccccccacctccctcccggacggggcggctggccaggcggggggctgacccccccatctccctcctggacggggtggctgcccggcagagatgctcctcacttcccagacggggtggctgccgggcggaggggctcctcacttctcagacggggcggctgctgggcggaggggctcctcacttctcagacagggcggttgccaggcagagggtctcctcacttctcagatggtgcggccgggcagagacgctcctcacatcccggacggggcgacagggcagaggcgctccccacatctcagatgatgggcggccgggcagagacgctcctcacttcctagatgggatggcggccgggaagaggcgctcctcacttcctagatgggatggcggctgggcagagacgctcctcactttccagactgggcagccaggcagaggggctcctcacatcccagacgatgggcggccaggcagagacgctcctcacttcccagacggggtggggccgggcagaggctgcaatctcggcactttgggaggccaaggcaggctgctgggaggtggatgttgtagcaagtcgagatcacgccactgcactccagcctgggcaccattgagcaatgagtgaaggagactccgtctgcaatcccggcacctcgggaggccgaggctggcagatcactcgcggttaggagctggagaccagcccggccaacacagcgaaaccccgtctccacccaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagaccgtggaaagaggggagaggggagagggagagccagattttcttttttataaggatttttgatttagataaggatgtggtaccacttgcagaactagggaaaggaattaatgttggggaaaaaagttaccccagccaggtgcgatggtgcacgcctgtaatcccagcactttaggaggccaaggtgggcagatcacttgagcctaggagttcaagaccagcttgggcaacatgcccaatgtggtgaaaccccgtctctacaaaaaatacaaaaattagctgggtatggtggcgtgtgcttgtagtcctagctactcgggtggctgaggtgggaggatcacctgagcctgggaggtagagttgccgtgagctgtgatggcacaactgcactctagcctgggtgacagagcctcaaaaaaaaaaaaaaagttatgccatctttttccatttttggcctccgtatacagttgtttatcccagtctggttactcttgcctttgatatctgtcacagatttcttgcctcttctctgttcttactgccgcccctgaatgtgggacctcttttacctcattggtctacctgcccacattcctcctctgctgctctgctttcttccttatgtattccacttagaatctgtattagtccattctcatgctgctgtaaagaactgccccagactgagtaattcataaagaaaagaggtttaatttactcacaggtccacagagatggggaggcctctggaaacttagaattatggtggaaggggtagcaggcacattcttctccacatagtggcaggaaggaggagaatgagagccaagcaaaggggaagccccttaccatcggctgtcatgagaactcactatcacgagaacagcgtgagggtaactgcttccatgattaaattacctcccaacaggtccctcccgaaacacatagggattatgggaactacagttcaagatgagatttgggtggggacacagccaaaccatatcagtatcctctagattaattttcataaaatgtacttttccttacatttctttcctactcaggatcatttattgacttagtgtgactcactgaattctgcctatcttttgggactctatatgaacattccccagcagcttccgttaactgtgtgactgtacttttcctttctgtgtgccatgttcacttctgcttcctttcgttgtctgtctttttgccagcctgaattccgcatcctcctgtatacctgttctgttagtggctatctccctctatctgtggagatcatttgctccctgttacctctacagcctggatcccaccacctaatgaaccagcagggtctttaaaaatacttattgattagatgtggatcttattttttaacataaaaatttgttatttcttaagtatttacaggtatttaaacatattcctggccaggtgcggtggctcacgcctgtaagtgcggtggctcacgcctgtaaattcagtggctcacgcctgtaatcccagcacgctgggagaccgacgcgggcagatcatttgaggtcaggagtttgagaccagcctggccaacatggtgaaaccctatctctactaaaaatacaaaaaaattagccaggcatggtggcacgctcctgtaatcccagctacttgggaggcctaggaaggagaatcgcttgaacctgggagtcagaggttgcagtgagccgaaatcgctccactgcactatagcctgggtgatggtcaagagagactccatctcaaaaaaaaccaaaaaaacgaacaaaaaaaacttcctgttctttttgtattaaacaaatgattgtgtcagttttcacaggtttaaaattttagtagttaagtaatcatgtgattcacgtagatttgattgacgcatcatcattatttaacattagtgcttcgttgttttttacatttagagagacagtataacatactggttaaggtgcaaaatctggaaccagactgcctgggtttcaattttggctcatctatttattacctgtgacatgttggcaaattatttaacatctgtgtctgagtttcttcatctgtaaaacaaggtgataatagcacctacctcacgtctttaatgaggcttatataagttaatgtatgtgaagtgttaatgtatttgtataaccaagtgctaggtatgtgttagctattgttataattgttattatttatgtggcattttatggtgttaaaactattttgcatttactttggtcagagtaaaatttttgtgtttctagtaggtagcttagatttttggttttcccagagactgcttttcccttcttgcccacctatgatctcccttcactatctgtgtacagttagtttaccaccgactggctaatcctggagtcatcttcacctgtcttgccctagaatattatgcctctggccaactggttaaaaccccacttctggattcaagttaatgtatatcatttaaataacagctttgtagaaatgtaattcacattccataaaatttactcttttaaaaacatgtaaaacaaagtgtataacttatttctccttgataattaaaagatgaatgatcttctggttttgaagaaattgaactttaacagactctaaggcaagattattgtagatctaaatcattgtgtagatcctggatttcatctcattacacctggggcaggaactgtgtattctatgtagccttttattgctgacatttttgccttacattttttgtattaaacacataggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacactggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtattgtttaaatagattaaaatgttccggacagcattaggcagctgccatgcacagtgtttactgagaacctgggttactggtttggtttggtgtgttattagcttttttttaaaactgatatttttaaaacttgggaatggtttccttttattggaatagtgtgaaaagtattcttaagataatgtcactttctctcacttgtattttgtttctgttttcctgcctgtgagaggatatggctggtattacagctaaaaccagaatttgtccctagttctgagtattcctatggagcgggtcatgaaattttacctccccccgcctcatctcgaatctgttttggtgtaataggtggagagtcagtattccagtctgtagcatcagcagtgcatgtttcctcttatcttgctatagtaatagtttttcaaatagagatctgttgatagttaaaaaatatttttggcatatagaggctcctgtttctcagaggcctgtgatttattgctggcagggaccttagcaattatcagtccagacccttgttgtacatgcctccagcataatagtgaggactcagttggaactgctacccagggccactggcattctggccagggatctatctataccccatgtggttgctgatgaactgtttatttccatgagttattctagttatactagttattctagcttacattttatttatttgttattttagtgcaatgattttaaaataaattttcatatatctttggctaaaatttgagtaatttagattttagggtgtttttagtgatcacttttaaagttacagtttaggagatttgtattagttcttggcacatacatgttgagaggctactgtgaactaatacttttgtaaaaacactatttgagaattgttttccctttttcagtttgatactggaaccgtcacaaatatgacatcatttttgttaggacaacatgttaatcattaaacaaacgtacatgctttcagtccaaagttaggagaaacgaaaatttccaaagtttccttgtaaataatcaggttaagttcaatgatacatcaatataatttcagtcagtgttacagcaacagtttaagtgtattagataaaatcttaccatggagtgctttttcatactttttaacagttattacacaggttgttttagtttatccatagtgcctcatacttagctccccttggaaactgtgtgtacctcaattctggaacgtaccttagaacaactcttaacttttctaaatctgcatcgtcaattttacgtaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagagtaagtgataagaacttttcattcttttttgtcctactcttttaaacatgcggggataatttgcatttagtaataaaatagggctgggcacggtggctcatgcctgtaattccagcactttgggagttcaaaaccgaaccaggctgggcacagtggctcacacctgtaatcccagcaccttgggaggccaaggcaggcagatcacttgagttgaggagtttgagaccagcctggccaacatggtaaaaccccgtatctactaaaaatacaaaaattagctgggtgtggtgccaggtgcctgtaatcccagctacttggaaggctgaggtgggaggatcgcttgaacccaggagacggaggctgcagtgagctgagattgtgccagtgcagtcaagcctgggtgacagagtgagactttatttcaaaacagaaaagaaaaagtcacagattgatcctgtgtccatggtaactgcctggcaatatcagcatgattgatggagatataaccagagcgagaatggattattttttgtcagagaataatggggttcataatcaataatgggactcaaaagttatgaacccattattaaatgagtagggcagtgcccagagttgttcagaacaaagttggtctaataacattgagaacagcagtttgcctgatctctagaataaaaataacattgtaaaaattgagttataatttgtaatttaaaaataggaagatcatagtagtagttcttttccttggtcgacttgaatgttgcttttgagttgaagacagtagatggcagtgtccctcacagtaggaacactgaagaggaaggaaactgctgttagaggttcgagagttgaagagtaatgctgctttcttgtgtgaccacaaatcgtgctagatggcagttttgcaaactagtcttcacaacaagaacttaagcacaaattcctttgtttccaggaaaaaaaaatacattccatttcagagtaaaaacgtagtcatgactgtagagattgtaaagtttaaatcaaatccctacagacacttttagtgcattttattctgtctgagtatttccactggctgccactttcccttttacttaaatggatttatttatttatttatttatttatttatttatttatttataagaggtgacagtaataaaaatgtagtgccgggggcagaaaaacaccttttaaagaacagtgattatgtgaattctgtggccatgaatgaaaaaaggtcaataaagagaaaaagagcaaaggaatgaatgcaacttgagaatttatgatcagtctaagatgaccaggtagcttaaaatgtcacctgagaatcaaaatgccaaatgttaaaagtgagctgtcctgagatttgctgtcatttgtcatgtgtgtattatgtttaacagtaagtagatgtgtcatgtcctttgtgacaagaaaaagaaaacaattttcagcaaatttcaagagaaattacactcctaacattttttgtttgcttgcctgttttttgctgtttgtttgcttttttgggatggagtttcattcttggtgcccaggctagagtgcagtggtaccatcttggctcactgcaacctctgccccccgggttcaagcgattctcctgcttcagcctcctgtgtagctggaattacaggcgcccactaccacacccggctaattttttatttttagtagagacagggtttcaccacgttggccaggctggtctcgaactcctgacctcaggtgatcagcagatattacaggcctgtgccaccacgcctgaccgcctgttttgattatgaaatatttcttgcatataaattgatacaatgtaaatgaaaggtgtaactcccagtgttttcaacattagaaatttttcagcttctgtccttactcctcgtcttatgtccaaaaccctgaatttgtctatgtgtgaggtcgcaaggaaccaagttcccttgctgattccagagccatccttgcctccagagataaggatcagggcattagactcgtctactcagcttggtgtctgctttacccaaaccagattagatggcctgtttgactcttcgtttgcaggttgagtctgaagtaccttatgtgtgagacaggctttaaagtttaatcttttgcttatgaagtcatctacccttgttgtctcaacacaagactagcctttctgtctctaagaggatgaagattatatctttcctttcctttacatcttaagcacttagaaaaaagcctggtacaaagttggtacatatgacacatttatcaaattaaagagtaaattttgaacctttttatttcacaggacctgactttgttacacagttttggggcagtgaatgagagcaagttaactactgcctaccagaattgcccctgccgccaacgttttatcccatttatttctgatccagctttagaaaatacagcattattatttatttgtaataattattattccacatataattgttgtaaatattctaggctctatgttgttaaagtgaattcatgccatttaaaaataccagaacactggctgggtgcagtggctcatgcttgtaatcctagcactttgggaggccgaggcgggtggatcatgaggtcaggagttcaagaccagcctggccaacatggtgaaaccccgtctgtactaaaaatacaaaaattagctggacgtggtggcaggcgcctataatcccatctccacaggaggctgaggcaggagaatcgcttgaacccagggggcagaggttgcagtgagctgaaatcatgccactgcactccagcctgggcaacagattgagactccgtctcaaaaaaaaaaaaaaaaaaaaaaaaacatcagaacacacatataccaacatcaaatgtaaagcataatggcaaaaaaattttagaagagaaggttctagtggaacaggggtaaagaagatgatgagccatctaagaaagaaagaacatcagcatactcatactttagggtcctaattaaaagccaataaagtgttagctagaggaagaattttttgattacatgtgtcattgcaagcaggtgttcactatgcctgaattcctgctactaagtataaggaatgggagagaatgttatttacccagaaacactaatgtctatagttatgttttccctaatgataaatcgttaagttctgtcaataggatacttattaaaaaaaaaacaaaaacctaggtaacgatttcagcattactttttattactgctaccattagctggcacatttataaatttattccattttaaagataccatattccaactactgagtctgtgaggtcatcacatggcttcttctgcctttgaagtgtttttagtctagtggtcgagacagatgtgtcgagatgtggtaatattggcggcaacatggtacaaggctgtgtaagacacacttggaacacacacaacagccagggatctactggggtggggctgtaggtaaatcagggtaaaggatttgccaccagttgtgtaagtaccctttcttgcccttaaccaaaaagtgattggttcctgagctgtcaaagtaacacagccgtaagcggtttacttagtggcagctatcagcatagcaccctcctaagtcatttatctcttatgcatggattttagagtagaacctccaaagagaaggtgacttccctttacgtttctggttccagggagactagcctgtgctacactttcatccttgtatcctcactctatctagaatggtactttgcatcttattggtggtgctcattgaatgtttttagagtgaatgaaattgttctaagaaaattcacattatcggataaataatttgaggaattattgatttactttataaatatattctttattttttaaaaagatttttatagaattaattgaaacagcagctaccctgagtattatattttttactaattttgattttactaattcacttcttttctggaatttattccagtgtgtaaggaaagctatgcttatataaatactgcagattaataatacttgtgattaaaagttcatattgtagtcacagtcaatattgttttgattggttatgtaccaacaaagtgaatttctaacggttttactttttgtttcaaaattaagatactgtggaaggaagtgatttagaaattgtgatttttaacttgatattttccaaagaaagtaatatttgttattacttgaatttaacattttttctgttaaagttttgtattaaaattttttatagtctttggacaggataacttttttcgaatgtcatatttaagtatcccttttctttgtattattactctgaagattgttgtgagaatagatatttaaactttggtgatcttttcagatacagttaaaaaactccaggaccaaaagcacgacatggaaagagaaataaagacactccacagaagacttcgggtaggataaatcttcatgtattgtcttgttagaaaacggttttctgaaatctgaggtgtagtcattgaccatgttatcattcatcttaagttttggatacagtgataatactggccccattgggctttgggcagaaagcaaatgctatcatttcaaattgggattggtgctagattttgggtagaagaatgtactataggttgagtacccctaaccagacattctgaaatctaaaatattccaaaatttgcaactcttggagtgatggcatgatactcaaaggaaatgcttattggagcattttggatttcggattttcagatttgggatgcttagctgttaagtatagtgcaaatattccaaaatccaaagaatcttaaatctgaaatgcttttggataagtgatactcgacctgtagaaatttatgggtagtaattttagaaagatagatttggggaaaaagtgtaagaaaggttattagcttttggttataaggtgccccaaactagtctgttttcatacaagttttcttcattttgtggccatgatccatcttgccaacagcaatgcagccatgctgcagggagtagggagaaagctactcagtcgtttgggtcataccacagttgctcaggctgctttcatggtgtaagaaaattgctttaggggtgtagggggcgtggggctcaggcatgccccagctatggctctgatggaggtgagtcccagggagacttccccacccggccacacccgcatcctccatgactgtgggaagcaacagaccacgtagttccttaccgcctctttgtataattttgcctgcctatattgagtttagtgtttttcttctggcttcctcttcctcttccttttcttttgatttttttttttcctgttagattttgatgtcaggctatttatagtttttcactgtatggttcacataccatttatatacctttttgtgcttttcagaggtaaacatccataaattctggatgatgtttattttcataagacttgctttgaaacttgcatgaagaagggaagcttgacattattatcattaatatctgttgagcactctgagtacttgatgcctcagtaggcagatcagctggaaaatcttttccttattaagaacaagttcactaataatagttgcattgcctgttagaaatagatactagcaattctctgggattaaaaaaattaatcatcatttggaagcattagtgcattatagcaatccaatcataaacaaattttattgcttttaaataaatcttgattgctctcttttggaaataaaaagttagttttttaatataggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagtaagttctgagaaacctgttgtgtacttatgtttcagtagagaacacttaaatcccaatttttgatgtggtgctatggaaaaaatgtggagtttgatacttactgagtttggatctgatggaagttactcagcttttctgggcctcattttatggcacatgtaaactagtaccatctatgtggatctttcagagttgtcagtatcagtgatccccaactctggagggagccaggatggtctctcacatgattctcctttcccccagacccacagtccagccctgttaattttctttagattgtagcctcatgattaaggatgtggactctggagacagatattcttggctcgtgtccagctctgcctcttactagctgtaatcttggtcaggaatcttgacttccctgagcctcagttttctcatctttaaaatgacacaatactacctgccttacagtgttgtcataaggattaaataagataatgcctgccaagtgctcagggcaatgatcagtatactttagctggtatttttggagacccaagtaaagaatgcaaagtgagtttctctctatcacttacttgaggaattttcacttgttttatcttataattgcatgaatctccacagtaggttttttttccccatgtaacatagacatcattggaaactgatgaaaattattagatgaaatgacagttgtgacatgtgagctccacactgagactccatctaagagtaggggatagtatttttgtgtttgaggttattactaagaatttgattattccttagtttgagtaattattaagtgggcataggaagaaatttagaaaactaacagtatatctttaaaaaatggtcttatcattgccttgctctagtaaatggctcagagaaaagtattgctaagcatttttcattggattccttaagcagaacatggaatgagacagattattgtttctctactagtataaaacatgtattacattacttttttctctttattattaaacgaataacatatcagaaatgcttcattctatagttatcctgagtgaatgaaattctactgttaaagtttcattcctttggatctcaaaaattcataagactttgagacacatgtttttaaaatgctttctgaaagaggtagcatcttgtaggacagtggttctcagagtgaggcctgcagattcctgggtgtccctaaggccctttaaggactctgtgaggtcatactgtcttcataataccatcacattgtttgcccttttcactgtgttgacttctaaactgttagtgaaaagcaagtgtaaactgttgatgaaccaaggtcttggcaataaattgcactcatagtcattatactcttcaccaccacatacttgatttttttttaatgtaggtttcacttaaagatgtccttggtaaaacattcaattattaattttactaaatcccagtccttgagtacactctttagcattttgtgtgacaaaatgggaagtacagaaaaagcacttctgctttatgtgctatactcaagactatactgaagagtgaggtcacgttgaggaaagtgctgtgattagtttgagctgctttcttttttcatggaatgccatttttttacttgagaatgacagacaaactgtgcatcattcagactttggtattatttggtgggtattttgtgaaaacagttaagacagcctatcacttaaaggaaaacaactgacagtattcgttgccagtgataaaatgtgggctttgaagtgaatgttaggattttggaaaatttgttatttaccattggtgagtttggcagcttcccataaagtgtcttctgatgagatcattgcgacttaaaaaaaatgtataatgacagaatttagaaaatctgtctaattcagtgaaccagtattttccttacagccagtctgtgatgttaaacaagattgaccagtggattttaatgggcagaataggaaaagttcacttatatggtttcagattccacattggagctaacttttaagttactacttgttgcattttagtgcagttatcaaagaagaacagctacagttatctaaaaggcctattaaaatcttcccttttccacctgccttatctatgtaagacttgctttttttatatcaaaataggttgaatacagaagaaatgagagtttagctgtttactcttaagccagacattaaagagatgatttaaaaatgcaaagccctgttactcttcttactaatttttttttttggttttggaaaacttagttatttttcataaaaatatattagccctgtatttatttttatttttagatgattaaatatttgtatatattcttagttttaatgtaatggaagacagctcttataaacaaaagctttttggggtccttactcatttttaggagtagaaaggggctctaagaccaaaaagtttgatagtcactgttata

SEQ ID NO: 1655 - DNA, 2223 bp, Homo sapiens
gccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacactggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtat

SEQ ID NO: 1656 - protein, 676 aa, Homo sapiens
  VARIANT (1)...(676): Xaa = Any Amino Acid
VPEAVRWGYFIPEQSQFACKCITKRQPRMKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVX

SEQ ID NO: 1657 - DNA, 25891 bp, Mus musculus
  misc_feature (1)...(25891): n = A,T,C or G
ttaattagtggtcaactagagagggcatggcgcattgtgtgggtggtgccattcctgggatggtggttctgggttctataagaaaccaggatgaagccgggcgtggtggcgcacacctttaatcccagcactcgggaggcagagacaggcggatttctgagttcgaggccagcctggtctaaactttttcctttttttaatatttattaatttattttatgtatatgagtacactgtagctgtctccagatacaccagaagagggcatcatatctcattacagatggttgtgagccatcatgtggttgctgggatttgaactcaggacctctggaagagtagttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttccaggacagccagggctatacagagaaaccctgtctcgaaaaaacaaaacaaaacaaaacaaaacaaaacaaaacaaacaaacaaacaaaaaaccaggatgagcaagaaagcaaaccagtaagcagcaagcacccttctgtggactctgcatcagtgccttcctccaggagcctgccctgtttgaattcctgacctgacttcttctataaagaacagcaatgtggaagtgtcagacaaataaaccctttcccccagacttgctttttttggttatgccgttttgttgcagcaatagaaaccttaaccaaagcacagcactagagcccaggcaggttccctcacccaacacaacacctatctggggctgtagagatggttcagccaagagagcttgctgctttttcagagaccctaggtttggttctcagtactcaggaatgtctcacaatcacctgaaactttagcttcaaggattaacaccctcttctggcttctttggcctatattcatgtggcacacacaaaaagaaataaaaacagattttttttttttttaattgcaccttttcagatcccttgtcggggccaaaggtgtattgggttctgggctctgttaaggtctatacagtcactaccttgggagatggtatataagatctgcttgagatctggagtaggtcatcagagacttagggcaaggaggagaagagagagagagagagagagagagagagagagagagagagagagagagagagagtcatagctgccaaacctatccaaggtaaactggagggaagccatacttccaggagcccaagtgtccagatgtccagatgcacttggcgaaggcaggagtctcaggaagacattcaaactattgcacagatgagagcacaggaccagactctaggaaggtccagagagaaagaggaaggtcccctctttctctgctgagcagtgcctaatattacgtcacatccccacagtcagattgaacaaatctgcaggaagaaaatgacatcactgcacagactaagtcttagggcatgctttcttcatgtcaaatatgtatgtgcttaacctgtgcagcagcccaatgagataggtcttagcatgcctgttttataggtagggaaactaaggcacagaggggtgactaccctgttccaaatcctgcatcaacaaagtgacggaaatgaggctctttcacgacaaaagcaaaaccgatggttactgagaatttctctgaggtttaagacacacatcttctgactctatgcagaagcaccagctatgacagagcaccagctcacatatgggtataacaatgatgtgggcatggtaacacacctttaattccagcactggggagagagaggcaggcagatttctgtgagtctaaggccagtacggtctacacagagttccagttcacccaggaccatgtaggaagatcttgcttaaaaaaaagtaaattttacggccaggcgtggtggcacaagcctttaatcccagcacttggtaggcagaggcagacggatttctgagttccaagccagcctggtctacaaagtgagttccaggacagccagggctatacagagaaaccctgtctcgaaaaaccaaaagataaaataaataaataaaatttaaaaattggtcgggcagtggtggtgcatgcctttagtcccagcacttgggaggcagaggcaggaggatttctgagttcaagaccagcctgttctacagagtgagttccaggacagccagggctatacagagaaaccctgtctagaaaaaccaaaaaccaaacaaacaaaaaaaccccaaaaccaaaaaccaaacaaacaaaacaacaaaaattgttatttaggggctggagagatggctcagtggttaagagcactgactgttcttccagaggtcctgagttcaattcccagcaaccacatgggggctcacaaccatctgtaatggaatacgatgccctcttctggtgtgtctgaagacagctacagtgtactcacatacataaaataagtaaataaatctttaaaaaaataaaaactgctatttatctgaagatgactttaatnnnnnnnnnnnnnnnnnnnnctcctcctcctcctcctcctcctcctccttctcttcttcttcttcttcttcttcttcttcttcttcttcttcttcttcttcttcttcttcttcttcttcttcttcttcgtgtgttttggtttctttgaggcagggtttctctgtgtggtcttggctgtcctggaactccctctgtagaccaagctggccttgaactcagagatccacccgcctctgcctctcccagtgctaggatttaaaggcttgcgcctccgcacctggtgcctttgaacttctcacccttctgcctctatctcctgaattctggaattacaggcatgtgccagcatgtgggttacttatggggtactggggtcaaatgctgccaaactttgtacacactagacaaatgctgtggtagctgagctccagtaccctcacattctatcttctcctctcctgcctcttctccataaagagcttttcctggtcacctgggatggagccacaactctgtccacagaggcaggcaaattattctactgcattgttctgtttgtggctggcaagtggcccttaaggttggtcctaggtccttttgataagactcaggagcctgagggtttgtggggaaaatagatgccacagagtgttgcattttctctagaccagccagccccggctgggactcagggactctgacagagctcctgtgtgcttcccacccgacaccctctgggggacagttcctgttctatggatcttgctgtgtgacaggagtcattttcttttccctttttgagtcagacactttgttacaacagtggagaactggattctaccttcccatgagggtgtgatatccaagtcttcctgcggctagtaactgcctccctcccatgtagccaggagcctctgaagtagggataccacactggacaatgagtctgtgtgacacctgggggccggtgacctgtggtcctgttaggagtcttggagggggctattttccagcccaccctgggtgccaggacccaatctcctgactggactcattagaccttggggtcaaagttccttctcagggagaagggtttgtgctggcttttaacaagatcagctcagacgctactgaatttgatacattttgtcttcgttttaagtttagttttactttgtgtcaaagtttacctagtttaattccagagtagtggcccacgaggaaaaggcaggtggatttctgtgagttgaaggccatcctagtctacacagtgagttctaggtctgccagggccacacagagaaatcttgtctcaaacaaacaaacaaacaaacaaacaaacaaaacggataaaatatttctgtaaggctaaggtttcctgtgaaaaaataacagaccttctcggtccttttcatccagtcttccgtctcagcacctgttttcagttatctgcttctgtgtctctgaataacttcccctgtaatgtcttctgattttttacattgtagacagaaattttctggatagctttttgtttctttgtttctttatttttgtccccgactcccaccccaggcagtgtgttgagtcatctctccagccctattgacactttcttgagtgacttccagtcaggcattttgtcacagccaggatttctctgtccagccctggctgtcctggaactcaagattcacctacctactcagagattcaccttttgagtgctgggtttccatggtggctctaaatcccgtcaaaatgacaagattaatcattaacactttatgtgcattgctgctttgcctgcatgtatgtctgaatgaggtgtctgatcccctaaaactgcaattaaagctgtgagctgccatgtggttgctgggaattgaacccaggtcctcttaactgctgagccatctctccagctctattaacactttcttgagttacttccatcaggcattttgtcacagtgttgggaagctaatatacactctgtgatgatttgtttccgtgaagattttagaatggaaattatttttcccataggatttgaaggcatcattcccttatctgtgtttccagagtcataattaagaagccttaaggcattttgatgtcagaatctttgtgtatgccttatttcatctttctgaaaattcacagaatattcttagtctttacttttctggaacttcataccttagtgtgaaatagtaataatagctgttattattattattatttattatcattattattttgttttgtcgagaatttctctgtgtagccttgggtatcctgaagctcactctgtagatcaggttggcctcaacctcagagatcttcctgcttctgcctctggagtgctgggatcaaaggcatatgctaccaccacctgtctgtgaaattattatttttttaatcttgttcttggtactcactgggtcctttcagtttggaaatttaagttattgacttctgggaattgtattgaattacatcactggtaatttacctccctctattttctctgttctctgtttttagaactctggcatatgactgttggccttcctagattggtcattaattttttttttaatcttttccctctgatttttttttctttcatccttctcaactactttcctggaaattggggggggtggtccatttgattgttgattaatacatacctttcaaaaaagttttatttatttactttatgtatatggagtgttttgtctgcatatctatgaatcatgtgcacacgtggtgccccagagaccagaagagggtgtcaaatcccctgggattggaattacagagttgtggttacaagttgttgtgagttgtgagccattatgtgggtgcagggaatttgaacctaggtttttctgggaaagcagcaagtgctcttaaccattgagccatnnnnnnnnnnnnnnnnnnnntcccccttcccctccctctcctttctctctcaccagaattcagagctccttcctgcctctgtctctctggagtgctgggactaaaggtgtgtgacaccacacccagtttctatgtttttttttttaagatttatttatttattattatatctaagtacactgtagctgtcttcagatgcaccagaagagggcgtctgatctcattacggatggttgtgagccaccatgtggttgctgggatttgaactcaggaccttcggaagagcagtcagtgctcttaactactgagccatctctccagccccagtttctatttttaatgtctcaagagttcttcttcattcttcaacacagtcacacatgtttgcatcctctttgtgactctagacacagctccatcctttccggcactgggaaagttagggaatttatttcttccttgtgttttctccacttgactgtttttgcctgctccctttaatggtaacacatgttcgtttggatgttttatgacccttggctttctgaactggagtctgtggcccatgagtacggctcggctgggtcagtgagggcctgcacagggttatctggctgggctgtccctctggagaacagttccagattcctcagatgttgtccctgtgatggtcgtgatctccaaagaagttgctttctgtgtgcggcctggaggaagaaggcctaacatctggtattctgccacaagagaagatagatgcttagaatgggtttgtgcctttctctgtcaggggttaggctgttatataggagggctgagtcagtcacttttgggtcactgtgactaaatacgcaatagaaacaacttgtggaagggaagatttcttttggttgatggtcaaagagttgtagtccatcctaacaggagaggtgagacatagtgagtggctcaggcatggcagtgggataggaggcaatgcctgtttacattggactaggaagcagagcgagcaggcacagttaggggtacaccccctagtattctactactgccagacagaccccaatttctaaaggttccacaaccttcagggaccaagcactcaaacagagagcctatgggaaacaatttagattcaaaaggtgtctttgttattgttgttgttgctgttgttttgaaacagtgtttctctgtgtatccttagctatgctagaatttactctacagaccaggttagcctacttctgctccaggagtgctgggattaaaggcatgagccaccactgcttggctgtgtcttaattaccgttcaattgctgtgaagaaacatcataaccaagaaaactctaaagaaagtatgtagccgagtgtggtggcacacgcctttaatcccagcactcgggaggcagaggcaggaggatttctgagttcgaggcccgcctggtctacaaagtgagttccaggacagccagggctatacagagaaaccctctctcgaaaaaccaaaaaaaaaaaaataaaaaataaataaataaataaaaaaaagaaagaaagaaagaaagtatgtattgtaggcttgcttacagatttagagggttggtccatgagcatcatggcaagaagcagagagtgaaagtgtgttagtgctggagcagcagctgagggctttatatagatatatttttttaagatttacttatttattttatgtatatgagtacactgaagctctcagacacaccagaagagggcattggatcccattacagatggttgtaagctaccatgtagctgctgagaattgaactcaggacctctagaagagcagtcagtgctcttaatcactgagccatctctccagcccccagggctttatatcttaatctgaagacagcaggcagagagagagacagagacagagacagagagacagagacagagagaatggacttggtgtgggtctttgaaacttcaaagctcatacccagtgaatacctactccaacaaagtcacaccccctaatccttctcaaacagttctactgtctggtaactaagcattcaaatatatgagtctatgggcacaggccattctcattcaaaccatctcagctcatacaaggggaacgcagggaaacactctgcttaccactttatcctaaaagagccacatgcagaggtaagcggtacatgacctgaggtatgtgaaataggcctctggcgcaggaacttctgttgtagtgttggccgtgctgcactcttgaagtatgaaagatattcagaccctgtccgctggggtttttatagaagttctgtatatgaaaatatgattaagttactatgtaatgtgattatgctcaatcttcgtctctttcccctgaaaagagttccagtcctcatcctctcatcaaatggtcggtcgttctggcaacacgcctccatcctaatttacatataacaatatcctctgggctgtgggggggtgtagatcagttggtagagtatttgtctatcacatcatgaaggaagccctgggttcagttgttgtagggaactttgtgaaataagcactctgataccaatgagagtggaagagagatgatgtcaccagtggaacagagatgatgtcaccagtggaccaaagccagtacagctcttcaaagcctttgatactgggtccagtttgtgttctctcattttatgctctttggttacacaatcacaggattttggactggtgagatggctcagtgggtaagagcacccgactgctcttccgaaggtccggagttcaaatcccagcaaccacatggtggctcacaaccatctgtaacaagatctgactccctcttctggagtgtctgaagacagctacagtgtacttacatataataaataaataaatcttaaaaaaaaagacaggatttcttttttttctttcttttgttgttgagatatatatatgtgtgtgtgtgtgtgtgtgtatgtatatatactgtagctgtcttcagacataccagaagaggacattggattccattccagatggttgtgagccaccatgtggttgctgggaattgaactcatgtctatcctggaattcattctgtagaccaggctggtcttgaactcacatagattctccagggattaaagcaccaccagctggctcttattttatgctcttgaaccacaaggtgcgttgggaagcaaacaaacaagattttacagaagtgcacatggcagtgagcaggttgttagggagcgaataggcagtataaacagtgttttacataaatcaataaataagtcaataaattaatatctaataataataataattggcctttctatcttattctattcacagtccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagtgcctgcttctagaaccgtccaaagagcctgatgaatccagaagtctgcctagaaacaagtgatgatagccctggccagccaatgggatcatgcaggcctttctacctgtttagggaactcccccttcatcctgcccagggaggcagctttgagtgagtggggaatttccagatttgtggctttcagttccacatcttaccatgtgggcggagtgacctgctgtgggcgaatcagattccttccagtatcagctttaagaggtgatcttggggctcaagggtcccagacacacagcagcagcagcagcagcagcagcagcaacagcagcagcagcagcagcgcctgtgggaaaaactagaggctagagccatggatgaccaacgcgacctcatctctaaccatgaacagttgcccatactgggcaaccgccctagagagccagaaaggtatgtgtgaataccagcagagagcccttacctctggaggacacagaatgcaggcctggggagggacacagagctctgttgcaggaaggttgccttgagtgaccttgagcgctgattttctgagtgaattttatttatttatttatttatttatttatttatttatttattttgagatagggtttctctatatcaaaatatagagaatgccggggattctacataatgaaacataatgaaactcattttatagaccaggctggccttgaactacctgcctcttcctcccaagagctgggatcagaggcaagtgttaccacatttggctctgagtaatcttgccctcctcccctccaacctgccaagggtactgacttcccctctgtaaaccaagggcctcctttaggacttgtgttaagagagccctggatttgagtttcaccatacaagtaagggctttcacagatcctctgaagctgggccataactctaggtcagaagacttaagaccatagtgttcccccttgaatctgttctcccttgtcttcagtaagtctgtttgatttcctagcctctaatctggaaaagggttcccatgccaacagcctcagaacccatttctgaggacagtagaagtgactcctcattgtcttccttaactgctagaagacgtgtatgagcccaggcaagcagggcctcaccagaccggagtccacacctgacacggggatgagcctttctgtatgtgtgtaggggaagagagctgcctgccatcccaaaagctgctcacagagatggagttcctggtccatgtgttacatggttgccacagccatccagatagccctgggctcctctcccggtccctaaatgacctcagccttacactcccaacccccccccccaaaaaaaaaccaaacagggttagaatttgcttgccttcttgccttgttcccccaacccccaagctgcctatttgcttgcctatggggaactaaaaccagatgtgacgtcagcagtctccaggcagaaagggattttgaaagagactctgggagattgaccacgaatggcattctagcaagaaggtaaccagatatggattcttagagcaatggggaattctgaagtaacttttactgctgtcatgggtgaccacagaaaaaccacagcctcttttttgggtcccactgcttaacagcaatggctataagaactgttcatctattgggttccttccaccggtcctcagacgacactgattatcacggtaatgataaacaaactacagattctatcttaattcctacagttactgtagctaggagttgggcatttttgttatctccctctgcctgtgcctttttttaaaggctggttttactatgtagttgggctggaattcacggagtagaccaagctacttggccttgagctaagagaaacttaacttctcctgagtgttgggattaaaagtgtgttccactatggctggcattattattacacagaaggaatttgagctcatctagtaagtaacttccaggttatctcagctgctgagtgttgggcatagcatttgagtcaggaccagtctgagtcctgtctgggtcctgtagaggcctcatttgtgaagcgaggaggtaggagctctctgacctcaggcctctcagtgagggctgtgtattcaacaaatccatgacaaacttcactttacttcagttactgcttccaagactgaccaggccttaaggtccagggccattccctacaggtttgatttggggcatttttgtgaacacttctgcctggcaacatgtgcgtcatgattcctgacggctctggttggtttctgacttaagtcaatttttttttttttaaacacaaggaggaagtacaaaggaggaagtaaaaccaggaggtggcaagagttggcactcaatcagaaccaagacccagccaacctagaggcagtaagaggctgggtgtggttgtgtatgcctagaatccagcatttgggaggtggaggcaggaggatcaggggttcaaggccagactcatctacatgagaccatctcagaaaaacaaaataatattaaattgaataaaagtggaaggagagatgatgctgggcttgacatccagcctcctggagggcagcattgttatggatagtgaccttcctgagagcagtattactggtagaggaaatgtgtgtccggtgtggggccaagtgtttcatctcttcgttatttatgtttcatctcttcgttatttaacaaccgctcattccaagccctaacctggtccacacgcagaagtgtcttgttcctggccccagagttaggcaagccaggatgccagttatggctactgttcacatcttcaatacaaacctgtgttcactggccttctgaaaggttgaagttcgaaaggagagggacgtggctaccccaagctcatgtggtagcaggtagagctgggactagatctgaatatggggtggtagaggggttcgggggttccatgagtcaccaaagtagatgaagcagaagaccttgagcccaggttccatcttccttcagaaggccaagaaatttaaacctattctccctcctgtctgatctcctttctccagcccttggcttaggaaatacagagggttggcaagccaatgagaattagctgtgtctgtgatgtcataagttaccaggcagacaggttttctggagtttcctaaattacccttcctggttgctggagtaggcaagatgcaaacttatcacgaggatttccaatgtagttcgtcttacttagtctgagtatgtgttactataatagaaagccacagactgggtcgtttatataaataataataataataataataataataataataaaaatctggagatttatttcccatagttacgaaggctgagaatcccaagatcaaggcgctggcatctaatgatgagtttcttttttttaaaaaaatatttatttatttatttttacatgtaagtacactgtagctgtcttcagacactccagaagagggcatcagatttcgttatggatggttgtgagccaccatgtggttgctgggatttgaactcaggacctttggaagaacagtcagcgcttttaaccgctgagccatctctccagcccctaatgatgagtttcttgctgtgttgtaaatagaaaggcagtgaaaaggcaggagactcactcccctgttaagccttcctacaacggtgcctaactccatccatccacttgaatcttttaccttgtttttttttgtttgtttttcttttggtctttttgttattttgtcttttttttttttttttttttttttttccagagctgaggaccgaacccagggccttgcgcttgctaggcaagcactctaccactgagctaaatccccaaccccaacacttgaatcttaaaggggatgtgtgcaaataacattactgatagttctccctacccaagggtgagtggggaagactggacaggaaatctcagggtgcccagtcagggtccttgtgttccatattgtaacatgtgcatgcaccccaacacagcccaaaaaagcccccaaactgtaaggagtcactgaagtctgagagtctggctgtccaagagcatgaagcctaggtacctgtgttgctcttgaactttcccagttggagatcactacaagatgcttctaggccatannnnnnnnnnnnnnnnnnnncacatacacatgcacagcacacatgagtatacacgcacacacacacttgttggaggacagccaaattttaacactgtgggtttgagggttgctcacatgacatatgagagagctgggagactggggaagaagatctattcaaatttccagggactctgggacagacggactctggagcaggggtgggggtgagggggttgtcttggagatgtgtgtgtgtgtgtgtgtgcacgcacacgtgcctggcactgcttcagcctgacaatgttcctcccgctccacatgtaaaaactctaggccccacttctccttttcaggtataaatccggcttttgctgtcccctaccgcacttccttcccttttctctttaaacctgacgtcaccgtggggattggggacggcacagtagatgaaaacccttcttcctcttacatagtaaactcacctatctttttctgccagcaaaaacaagatcaaatccccctccccacttccgaggggggcttagctcctcagatctctagggtagaggggactcggaaggaggaaggactttaccctgtcactacacagaggagacaccaaagcccagaggaggcaaggaacgtggctcatccttcccattgagcttgggccccaggtggatcttcctgggaaggacactggggggcggcaggagcagatgtcctcactattgggagggtttgagtctgagagggcgtgggtccgggcttacgtccccacttccagtcagcgtccagctctggatcatgctcttactccatcccaacaggtgcagccgtggagctctgtacaccggtgtttctgtcctggtggctctgctcttggctgggcaggccaccactgcttacttcctgtaccagcaacagggccgcctagacaagctgaccatcacctcccagaacctgcaactggagagccttcgcatgaagcttccgaaatgtgcgtgctccacctgtccctcacctcacagacatcatttctccatttagcccctcccgatctcccttcctcccccgcaccgggtttcaaatcttaacccctgggttccttactcccttggacctggactcatactgtcctccctgccccacagctgccaaacctgtgagccagatgcggatggctactcccttgctgatgcgtccaatgtccatggataacatgctccttggggtaaggaaggcggcaggaaggaaatggtagctggtgtttgccaaggggaggggccgaaggataacagttgtcaaggaatctgggcactaactactggcgaggagcagggcacacctcagagaggcttgcccaaggtgactgaggaggccagaactcttagggctcccctggtggggaaagggcaagtcccacagcttgcaaagtgcttcttcacctcagcatcctatagtccctcagttcctccaagtctttggctgcaaaaatgctgttactcataggattactattggtaccttatccagggcagagcacatcaatcgaacggtgccaaatggtcagtcctgaaaacatacataagttagcatgatacagacggggcaggtttaattaggactagtggtgtatatatatagacatataatatatgcaagcaatgacaatgaatgaaaaaagaggccatgaatttgaagtgaagcaggaaggaacatatgggagggcttgggaggaggaagcaaactctgctattgggaaggctctgacaagcttctgcccgcctgaccagagagggcatagaggcaggaagggcgtgaggggctggcacttccatgttaggaggtggcagatttgagctgttgagtgcaagcacctgactcgtactagactatagctgctgatccctgcaatgctggtaaccctgttcccttccccacagcctgtgaagaacgttaccaagtacggcaacatgacccaggaccatgtgatgcatctgctcacggtgagtatcagagccagcgggtagtctcctgggtcacgtgggaccccggccctcactcatgggttaggctcactataaactcaacacatgcttagtccaaggaatacaaggtggtccttaactgttgcgtacagtccatcccctacccaccttgagataagagtctatgtagtcctggaaccgactatgtagaacaggttggctttgaactcacaatttgcctgcctctggctcccagtgctaggattaaaggcgtgcatcactaggccaggttccagccacctcacttttgaggagttaaaaattatggtccattgagactggagagatggctcagaggttaagagcaccacctactcttccagaggtcctgagttcaattcccaaccacctcatggtggctcgcaaccatctgtaatggggatccgatgtcctcttctggtgtgtctgaagacagagacagtgtgctcgcatacatgaaataaataaataaatcttttaaaaaaatcaaattaaggtccaatggattgacttggccacaataccatgttctccttcccaaattaatattgcacatgcttgcttcgtgtcaggcacagtgcatggcacatggctcttggcctacagcagggaacactggttgtgtgaggacaggcagaggacccagacagagggaaaaaactggaggtgctggttcagctcctgaccctgactggagttccatagctgggtgcccctcaccgctgctctccaacatgggggaccaggggccaggcttggtgtggctaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgttggggtaaaaataacagtgagcctgatgcttcccttgcagagccactggacatggaagacctatcttctggcctgggagtgaccaggcaggaactgggtcaaggtaaggggggggatcacagagggggccacccacatgcagactctggtgacactgggacattcatcactatcactgggatggtttttctagaatgggatggtggctgggagcacagtactacctgagcttagcagggggacagactgatctgcagttccaagatgttgggcagaggaggcagggacaacaaactggtggcccagctgtatcaacctgtgcttctcttcccagtcaccctgtgaagacagaggccagctctgcacagcagcagcgccccctgctctcctgtgcctcagcccttcttatgttccctgatgtcacaccccacttcccgtctccctgcaccctggggcttgagactggtgtctgtttcatcgtcccaggacacggcaaatgaagtcagaacagaaggaggacgctggagggccttgctggctaccgctatctaaagggaacccccatttctgacccattagtagtcttgaatgtggggctctgagataaaggcccgcagacagggacaagggatgccctacccttaacctaggctggacacatttgctgccttctcctcaaggaagaagaacccaagcccctcctcccagtaacccctcctcacatcctgccaccccccctcaagccccaccccctttcaggttccttgctcagccaagcttgtcagcagcctgtaggatcatggttcaagtgacaataaaggaagaaagtagaacactcttgcttccgcctcttcagttgggatccagttagtttaccccaaggccgaggacaaccttaaatctaatcctctacgtacatggactggggagatgggtcccagacacacgtggtgtctacttaacagtcagaaagaaacagactcctgctcggttttaaaatcacatctcatcacgtcctagcttccattcctcccgtccccaattccatttctggactaaggacagcgtaagtgtgatgacagatggcagtggacacagggacctagtgtcaggaatggatgcaggtgggggctgccagtggctgtctgtctgggcaggacctgtgtcttgtcagctttagcccactgtcacaggaaaagggagcggatccctcaccaccagggactccgagatgaacgttaaggacgctgttccattttgtaggtttaaatacttctgcgagtcagccgagccaaggagaggctctctgtattctgatctagacctacatcccacactctgatccacacttgagaatggatggaatggctgactgttgggtatggcgtgcccgtcccaaggctctgagcacagggtccccgagacttgcacctgctccttctctgtactggttttttgttttgttgaggtgaatgttcagtgattattccaacatacttcagctctgcccacttcttactgtcaccagcacagaactgttccccagacagagggtgactcaaggcctagctcactgggtcttccccgcttctcatgccagccaccactgttcgccactgcctccctccacatcgtaacttgtttccaaaggccccctggtcacttgagccatctacctggcgtctgacccaccttcagctccttttaagcttataggccacttcctacggggagccgtccctgcatcaactccctccctggggagcttcactgagccttcctctttagcaaactgtcctactcacagtacctagggccttggcttgaagtcaggaaggagccctgagtactgacctgtgcatgtccagggtcactacactgtctgtcctaagtagccagtaacagtccgagtcccagatgcatggggaaggcaaacctttatatttaaagtcttttattctgagttctttaaaaaacaaaaccaaaatagctggaaaaattgatggggcaaggcttcaggctgcgccaggggtccagggtgtgggatgaaccacacgcgggaccttgctggctctgcagataacatggagggaggtccggaggcctctgggcacggtggatttgaagggagagaggcaagtcgcttaaaaaaatagatatactatacacatgtcacgtagcactcagagggggtgtgtgtcccacctcgcttcctcctggtactgcagcttccctgcgggttcactggtttggccagcacgcgccagccatcatcttctgctgagggagggaaagttaaaaagtccaggcccaattcacgctggccagaggtcagaggcctggggatggatggtcacactctgccaagattctaggagaagaaaacaaaccaggctttggtcagctttgccgacctttatctccacaaaagggaacaaaaccaagggagggatgggcggcagctagcttaggcaccagactccctcagggtggaccctctgcatgctgcagcagctgctgtccaaccaacctgaggaaagaagtctctctctctctctctctctctctctctctctctctctctctctctctctctctccctccctccctccctccctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcaagctatcagttctgtggcttctcctcaccaccgctgtcccacaggtccaggacagaactcccttcgaaggatccacggccccccataggtgtaaggatcgagacccactgataccagccctgggcagaactgccttctgatcccaggaagcggctggctggctgtttcttcagtgggctccccgctggccagccaacctgaaagctgaccattgtcccgcctgtggaggtctctcccatcacccctcccctgctcctcctcacaaggtccattagattaagggactggaaaggtggcatgggcctggtctaggtgttagaaggggaagggtttgaattcctagccctgagacccctcaggaactcaatctaccttcttctttttcttcttctggatcggcgaggcagagtctttggccagggacttttttcctttcttcttttcctttttctccttgtcttttttttctgtgggaagaaagcgagcttcctgagcaatagattttgacactgatgggtcagcgtcaggaggcccacggcagctcgcggctcttaacatcaggccctgatagggccaggataccatccatgtgccaggctccactcttactgactgtggactacacaatctggcctcagaactatgcaagtctatctatctaatcttgagtgtgagggaagggacaagaacctgggagagatcaggtgacacatctcctgccacagaatggcagtgctcaggacttccatgctgggcgtggtagagtacccttttaatcccagcacccaggaggcagaggcaggtggattgctgtaagtttgagaacagcctgttctacacagaaagttccaggccggtcaaggctacattgtgaggccctgtcttaagacaaaactaaagcagggactgcctagcgccagtggtctttccttctcagagcctgctttccccttagaaaaggaaaacaacactgcccgaggcccagggctggtgagtgactcagaagtcctgctgggtgcaggttcccgcatggagggcaacgaatggctgttttcaccaaagaactgaattctagagtaaagatgggctctggatgagaacccaggggacagtccacaccccagggactggccgtggactctgctggagcagagagctccctgttgtgaagccggggttgagtttgttttccaaaccctgaggctaaatactgggcattgtaaggggccgtgggggcaggggacgcaggccagctctacagtctccttttgcctttgccaccagacacttgttaaactctggacaaaccacttcccaggctcttgttctctgtggaaagaatgagataaagagccggggcagggccctgccacccaggttgcaccggcagcgcgtactggaaagcagtcacttactcttgagggatttcttctttttcgacttgctcttcgggtcgctctgctcgccactctcaagctttatccccagcaactcgccgtcgggcttctccttggctccttgggggccaggagaccccttccccttgccaccagcactccctttgtcaagctttgattttgccttggaagtcatgggagccttttctggggaaacagcgcttgccctgggcactggctgctccttcttcttcttgttctttggggccccagcttctaggtcccctgataacttccgcttctggctcttcttcccactctccttgatggcctctgtggccttcagccgttcctgctccagaagctctgtcaggaccttcaccacagaggcctgcacctgcgcctcgctcaggggccaggcctgctccaggaggcgctgggtgatgctgttcggcagtgtctgtgtgggggccggcgagcttgaggtgctcttcttgagcttcttgggcttctgaggcgtggagcccgaggaggcctctttcctacctgtagatcacaggtcttggaggtcacaagtctggaaagctgagggtgagatcttgcacaatgcatgacaactgagggggtgtactttacaactgcataaatgggaaactgagatccaggggtcactctgctctatctgtctcctatgcttagctatgtttgtggatcgacagagatcccagaatgctaaggagaggacctgaagtctgctaatgagacggagggcacagtaggtgggacatgggtgacactggttctaggactgcctttatcaacttagtgtagggctttggccaggtcacagtccctcaaggcgtcacagtccctcaaggctgtttcccaccttagaggaagaagctagacatacaatgatgtcttctgccatgaactgtgggttataacacacgagggggtcctacagaccaatgctcagctcccgtctgtagacacaccatgggtccttagcccatcaaggctggggcgacaggcagattggggggcactcctgagtatgctgtgtatgcatgcagtggctgactaagcaggtttactgcctgccagagtggcttctggtgcagcctttgtttagaattttctacgcctctgcttgcctttgataattgtgtgctgactacacgtgtaaaaaaaaaaaaaaaaaccttccacagccccctcgaaaatgtctccttgtcgctcgcacccgcctctcacatagacaagaacactggcgaagaaagtgagcaacagctccgcctctgacccagcgctgggaagctgaagttaccagcccccagagcctgggcccagaacccccgctggcctcccaggtcacctgtgcagcaaggaatgcctacatgctgggcacaggggctgaaccctagcagtgagtgcggttaaggagaagcggacaggagtgggacgggatgcttcatgttatataagtcagggatgtgggcactcccaacagtcccttcccctgggtccctccaaatgtcatgtgacagttttctttatgctctgcttttgaccctgcacgatggcattgctcttaccttgtgtgattaagacacagggtcaggagcttgtcaaggctacagcagtgtgagccagagcagcccccggaggcctgtcccttatccagggtctcctctaggtattgaattctctaaacaaggctgctggcctagtctgagtcattctgggtccctatacccaggacccttgtccactgactgagaagtcagtagggacggacggagagccaaggcctcctccacaagctttaaagaaatagcttcaaatggctggctatatctgttcccagactgcccagagctggcaacctggtcctgggcgccagctgcatttaagggtacctctagttcccagaggaccccacaggctcgaatatgagactcttggaagggacacagacaaatgctgcccataacaagcagggaccagcagccctgcttctccatgtcttgctgtccccactcaccggttttagggagtgcggtgtctgctgcgtgttgggattttgacttctgcttgccatccgggttgtctttggtggccggggcagaagaagctaaggagttggagtctggcctaggagtagcttttgaagcctgggaattagccacagtcaagccgggagtcatgtaacctgagaggagagactgaagaagtccagtgtgaaagacgcatcgagcccctagccgtatcccagaggcaaggctcaagggaatcagtcggtgaccccggatcaggccaacccagccaagcatgagcgggcggcactgagcccacgggggacataggccttcagcttgtgccttctaagctatgtgaattaacgcatatgtaaggcacattaaaaggggactttcttattgccaatggactagtaccatcacagaagatggttaacgttttttgggctggcaagatggctcagagggtagaggcactgacacgagtcgagcctgacagcttgagtacaatccagtaaccttcgtgaaagtggaaggagaggactgaccccaacacgcacccactccccacacgtgagaaagtcactggagtctgtcctgtataggaagagccttaagagagacctaa

SEQ ID NO: 1658 - DNA, 477 bp, Mus musculus
ccagacacacagcagcagcagcagcagcagcagcagcaacagcagcagcagcagcagcgcctgtgggaaaaactagaggctagagccatggatgaccaacgcgacctcatctctaaccatgaacagttgcccatactgggcaaccgccctagagagccagaaaggtgcagccgtggagctctgtacaccggtgtttctgtcctggtggctctgctcttggctgggcaggccaccactgcttacttcctgtaccagcaacagggccgcctagacaagctgaccatcacctcccagaacctgcaactggagagccttcgcatgaagcttccgaaatctgccaaacctgtgagccagatgcggatggctactcccttgctgatgcgtccaatgtccatggataacatgctccttgggcctgtgaagaacgttaccaagtacggcaacatgacccaggaccatgtgatgcatctgctcacg

SEQ ID NO: 1659 - protein, 159 aa, Mus musculus
PDTQQQQQQQQQQQQQQQQRLWEKLEARAMDDQRDLISNHEQLPILGNRPREPERCSRGALYTGVSVLVALLLAGQATTAYFLYQQQGRLDKLTITSQNLQLESLRMKLPKSAKPVSQMRMATPLLMRPMSMDNMLLGPVKNVTKYGNMTQDHVMHLLT

SEQ ID NO: 1660 - DNA, 31116 bp, Homo sapiens
cctgaagtgctggaattacaggtatgaaccaccaggcctggccaaattattcttattgaggctggcattgttccgtatctggctggcggtgccccttcaagttggctcctgggtccttctttcaagccccaggagtctttgagaacttcttggctttctggaaagaaaaaaacagagatgtctcagcatcacctgcattcccccatctccagccctgaaaccagccatttggaagctgggatgtggccccaggcagtctgcctcaagttcttttgtttttcacactcatgcaaactgcagaacagttccagttctggggaccttgctgtgtgaccttgggccagttcctttcccctctctaagtcatactttctctgtatgaaactctgtggagctgggttccaccttactccatctccccatcagggtgtggcatccaagctccactgcttcctgttactctgtctccctcctcctgtggtcaggggtaggtgggacaaggctccttccctgggcggtggagcctgtgtgacaagtgagaaactgggacttcttaccctgtaaggaaagatgcagggagccattgtccacgccctctgggaaactcagtcttgggaccctccctcttggctggcatcagtctctaacctccaagggcacgggcaggatgaccgtgggatttccctcagctgtgtcctgaaactgctgcacagagaaaagagttcggactgccattctatcaccattggtttagaatctagtgactgtgatgcattattccctttattttaaatttaggctgggcgcggtggctcacgcctataatcgcagcactttgagaggccgaggtgggcaggtcatttgaggtcaggagttggagaccagcctgaccaacatcgtgaaaccccgtctctatgaaaatacaaaaattagccgggcatggtggtaggcacctgtaatcccacctactcaggaggctgaggcaagagaatcgcttgaactcaggaggcagaggttgcagggagctgagatcacgccactgcactccagcctggtgacacagtgagactccgtcacacacacacacacacacacacacacacacacacaccccaaaacaaaaaaaactataaatttagttttaccttgtattgaagttgtaaattcacatagtctaaagaatcaggccgggtgcagtagctcacgcctgtaatcccagcacattgggaggctgaggcgggcagatcacctgaggtcaggagttcaagaccagcctggtcaacatggtgaaaccctgtctctattataaacacaaaaaaattagcctggcatggtagcacgagcctgtagtcccagctactaaggaggctgaggcaggagaatcacttcaacccaggaggcagaggctgcagtgagccgagatcgctccactgcactccagcctgggctatagagtgagactccgcctcaaacaagcaaacaagaatcaaatagttctacaagatttgctgtaaaatgagtagcagatcttcaccatcctctttacatcagtttcaaacttaaaaaaaatttttttttccatctccgtccccaaaccgcctacccaatttaactgggcatggttgctcacgcctgtaatcccagcactttgggaggccaaggcaggtggatcatctgaagtcaggagtttgagaccagcctggccaacattgtgaaaccccatctctactaaaaaaaaaaatacaaaacttcgccagtggtggtggtgggtgcctgtaatcccagctacttgggaggctgaggcaggagaatcacctgaacatgggaggcagaggttgcagtgagctgagattgcgccactgtattccagccttgggtacagagcaagactccatctcaaaaaaagaaagaaagagagagagaaaaaaagaaagaactctaaagtcattctgattcctaatcttctgattcctaatcctttatatctgtcttgatttttcctttctggaaatttgcagaatcttctctttgttcttattttgctgaaacttcacaacagcatcccttgctgtgaaattgctttcacaccttgtcctcagtgctcactgggcctcttcagtttggaaatttatgtccttgagttctggaaaatgtattgacttatttcactgatgatttcttcccctctatattttctgttctctatttctggaacttggtatttggctgttgggcctcctggactggtgtttaattctcttatcttttctgtctgatttttaaatttatctttgtggtccacactttgggagattttaaaaaaacactttatcttccatctattgactgtttaatatctgccctcatattttaaatcttcaagagctatgctttgttcttctatactacttatacttttatagcatcctattcttgtttcatgggtgcagtatcctcctttttctccctagggctattaatgacagttcatttcctccatagtgcttttttttttttttctgtgtggttgttttgttcactctcttttatgttaaaggctttctttagatgtcccaggattctggattatctaaaaaacctgattgtctaagacagctgtgacccatgagtaggacttatccaccaagggcttcctatagggtattctggttgagttgtttcatcaggaaattcccagtgtcagagtcctgaggcctttttttcctgggatggtcatgctccacagagaagcttcctccaggctgtggcttgggtgaaggcctggctttcacactgtgggtaggggagaacactgggcctctcagcttcagtaccaggctcacgttctttatttgtctgggaaagacacttgcaattgtccctcaaggagggggacgggtggccctcggggagggagagggcgtgggtatctcactgcctcagaaacagacttccaaactaccttcctctttttagccccacctctactcaccacccaggtacccgacacaccagttcctgagtctgttctgccacctaactacgtggcttctcagcttttctagccgcaggtttaggatgcagtttttttggggtctactaagggacttaacacttgctcacctgctttcctgcttctcaaattctattgttttctcatctcctgttctctttgttcttgtagatttacacttaaaacaacctatggtcattttagtgacaaaagcaaagtgagagaggaagcaaaagtaaatgtgtgctctatccatcattacaatcttcaaaaaatgagacctaattcatgtaccataacattcaccctttaaaaactgtataaaattcaatggttttttgtacatccacaaagttgtgcaaccatcatatctattctagaatattttcattacccaaaagggagccccatacctgttagcaaccactccccctcctttcttccccacagccccccagcaacccctaatctatattttgtctctgtggatttgcctattttgggcacttctcataaatggaatcatacaatgtatggccttttgtgtctggcttttttcacttagcataatgttttcaagggtcatctatgtcgtggtatgaatcagtacttcattattttttaaagtaacagttttattgagtattcattcctctttatgacagagtactatttcattgtatggatacaccacattttgtttacctattcatcagttgaatatttgggttgtttctacttttttgatattatgaataatggccctatgaacattcatttgtgggcaaatttttgtgtggatataggataccatttgtcttgactacacagaaaatagcttaataaatatttgagctgggcacagtggctcacgcctgtaatcccagcactttgggaggccaaggcgggtggatcacttgaggtcaggagttcgagaccagcctggccaatgtggtgaaaccccatctctactaaaaatacaaaaaaattagccaggcatggtggcgcacagctgtagtcccagctactcaggaggcttaagcatgagaatcgctcgaacctgggaggtggaggctgcagtgagccgagatcacatcactgcactccagcctgggtgacagagcaagactctgtcttaattaaataaataaataaataaatatttgaacagtacagtttcactttttttttttttggtgggggtaatatccatcatctcaaacttttatcatttctttgtgttgggaacattcaatatcctttttccagctgttattgaacctagcgaggttctgctcacatggcatcataaggccaaatatttatatcgaggtttgtagtggaataaaagagggtatttatttgtagacgaccaagtaaaagaattgggcatctcatgcttaagagctgaccttggttgggtgcaacagctcatgcctataatcccagcacactgtggggccaaggcaggaggatcacttgagtccaggagtttgagaccagcctgggcaatatagtgagacacatggtctctacagaaaaattagctgagtgtggtggtgtgtacctgtatccccagctactcggaggctgaggtgggaggatcccttgagcctgggaagttcaggctgcagtgagccatgattgcatcactgcacttcttcaagggggacagagtgagaccctgtctcaaaaaacaaaacgaaacaaagaaacccatctccaatgagtggcttataagcaaggatttttttttttttttttttttttttgagacagagtctcgctctgtcacccaggctggagtgcagtggcgtgatcttggctcactgcaagctccgcctcccgggttcacgccattctcctgcctcagcctccagagtatctgggactacaggcgcctaccaccacgcccggttaattttttgtatttttttagtagagatggggttttgccgtgttagccaggatggtctcgatctcctgacctcgtgatccgcccgcctcggcctcccaaagtgctgggattacaggcgtgagccactgcccccagccataagctaggattttaaaggcaggggtaaatctgaggaaagcagaagttataggcaaaattctaaatcaatacatgaaggttatatattggtttgacctaaaaaggtgggacatcttgaagtgggggtccacaggtcatgggtggatttaaagattttctcatttgtcattggttaaggacacgaacgtttgtctaaaaatctggggtcagaaaaaaggaatgttagctctggcctgtgggcatgacctcctccaggcccctcagaaagaaatttatttatttttaatgtttaaaatgtattatttattgagacaggggctcgctctgtcacccagactggagtttagtgggacaatcagtgctcactgtagcctcaaactcctgggctcaagtgatccttctgcctcagcctcccatctagctgggactacagatatgtgctgccacacctggctaattaaattttgttttgttttgttttgtttttgtagaaatggggggggtcttgctttgttgcccaggctggtcttgaacttctggcctcaagcagtccttccaccttggcgtcccaaagtgctgagattacaggtgtgaaaggaagaaatttagagcaaagattggtggttagagtttagtcctctgctcccccttgtctgagatctatgagccagtggatctgtttggtgggggtctgggtttatgaaaagcaatgcagggacataagttaagatgttatctttagtttttatagggagccaaataccccatgattctaacttttttggctattgtcttaagttattactatatttttgtttatcagcttgctcatttacttctcaaggctagctaggtgcctgaaatacttttgaagaaacgtaagtttctttttcttttcttttcttttttctctttagagatggtcttactctgtcacccaagctgcagtacagtggcatcatcacagctcactgcagcctggacactcaagcctccggggatcctcctgcctcagcctcctgagtagctgggactacaggcacgtgccaccacgcctggctaattttagaaaaatttttgtggagacgggggtctcactgtgttgcccaggctggtctcgaactcctggcctcaagcgatcctcccaccttggacctgctaaagtgttggaattacaggtgtgagccaccatttctggcctagatttttctctctttttatgttggtggggtgctcagctggcccctaagaagggtccctgctctgtctcacagctatttgaaactgtatgttattgttaactatagtcatcccacaggggtatagaaaatgagaacttagtcctatctaggtgcaattttgtatccttttgcatccccgtccctcccttccccctacccttcccagcctctagtatcctctgttctacttttcacttctatgagttgaactttttttagcttccacatatgagttagaacattctgtgtttaactttctgttcctggcttatttcacttacaaaatgtctccagttccatccagtttcatatcttcagcatcttctatggtgcgaggctctggctaaatgcttatttagtctaacagctctgcaaggctagtattaccatccctgcattacaaagcagaaagcaaaatcagaaaggttgaggggccaggcgtggtggctcacgcctgtaatcccagcactttgggaggccaaggcaggcggatcacgaggtcaggagatcgagaccatcctggctaacacagtgaaacaccatctctactaaaaaaatacaaaaaattagctgggtgtggtggcgggcacctgtagtcccagctacttgggaggctgaggcaggagaatggcatgaacctgggaggcggagcttgcagtgagccgagatcgtgccactgcactccagcctgggcaacagagcaagactctgtctcaaaaaaaaaaaaaaaaaaaagaaaagaaaggttgagggactggttcagggactcacatgcctaggatgtttctgacttgggatttgaactcaggtctggccacatcaaaggccatgtctgctcttcgctctcctcccaaaatacatgtactatctcatttgactcttgaaatccaaaactcattgaaccttcgaaccacaagtctaaatttattaaaaaaaatttattaatgcaaattgtaaagcacacacaatacataaagattaataaaacaaatatggtatataaaaggaaacttgtttttttacactcacagcacttctgacaccaaatgtgtggattttttctacaccaacaacaaatgttctaactctctggacaccaactgggcatcctacaattcaattctgttcagacactatctacctggggttagcatctgaacccataggttgagggctcagtcagacaagactcatccacttcagatgccaatcctaagtcccgggactccagtacttctgatgagttggctacaaattgggagttcccacgactccctcttcatacttgacaaatagctacaatggcccacagaactgagaagcactttacttactattaccagtttattataaaggatacagatgagcagctgatgaagaggtctatagcgtacggcatgtgggaggggtcctgaacacagcagcctctgtccctgtccttgtggagttggggtgcaccaccctcctggcacatggatgtgttcgtctactcgaaagctctccaaacctagttgtttgggatttttatgcaagttccattatgtagacatggttggttaaatcactgattgaactcaacctccaacccctctctcctctctggaagtcggggtggggcgggtgggggtgaggtctgaaagtcccgaccctctcctcacatggcacccagcctccatctgaagctctctaggggctttcagccaccagcatttcctgaatatataaaaaaagacattcttctcactctggagatacttttttttttgagatggagtctcactctgttgcccaggctgaagtgcagtggtgcgatctcgcacctccgcctccagggttcaagcgattttcctgcctcagcctctcgagtagctgcgattacaggcacacgtcaacatgtccggctaatttttgtgtttttagtagcggggtttcactatgttggtcaggcttgtctcaaactcctgacctcatgatacacccacctcgacctcccaaagtgctgggattacaagcgtgagccaccgtgcctggtctttttttcttttttttcttgtttttttttttttagacagagtcttgctctgtcacccaggctggagtgcagtggtgcgttcttggctcactgcagcctctgcctcctgggttcaagcaattcccctgcctcagactcccaagtagctgggattacaagtgtgtgccaccatgcctggctaatttttaaattttttgtagagacagggtttcaccatgttggccaggcaagtctcgaactcctgacctcaactgatcctcccgcctcagcctcccaaagtgctggaattacaggtctgagccaccacacccaggcttactctggagactctttggttcttagtggtccttgtgtcaggaaccagggacagagaccagagacgtttttcactatgtcacagcacaggagccttgccaacacagtcccatcctcccaggcaccctttcccaggctgtcctcttccctcccagcacaggcccccattctcctggatctgaaccacacaaggaggcagaggggtagagtggttaaaaatgcaggcgctactactttctggaggtgtgatcctggacaagagcccctgtgtccctatctgtaaatggagatgataaaacactcctcaaagggcctccgtaaagatcacaggaaacaaagcatggacaacgtgcctggcacgaaggagagcttggtaagtggaggcaagtctgagtgccagagccttaaaaccatggactcttaggtttgaaggaaatcaaaatattcctctctaaaaacctgcggattttagttaaaggtaaaaggttaaaacccaggggcaccctctgccccttctctctgtcttgatcagctcagaagcagagctcagaggatcctggatcagacttgactgttcccatacattcaccttcccacatttccagccctttggaaccctgaagatatcctcttctctgtcctgtcactctatgggacttacggctctttgttaaaatactatttaagcaaggcccctaagccactgccttgagagagaaatacttctcaactgaggcctctactgcataatgggtacagcatgtgttaatcaactttggctgatttttcttttgttaagttgacttttgtttccaggggagcgtgtcaactaagaacctaaacagggaaagaaaagaaatgttttcacccctgcacgtcgtccaaacttcctcctgcgtgtttgagacgacataacggaggccagagaagaggacttgtctgagctcaccaagggtgcacagcccctttctgcacccactcatctgtggatgagaaggggagacaaacaaaggtgtcttctgtttcaaagtgctttcctgtctagggagtggacatttgcctttttcttgaaacattcaaagagccttatgaatccaaaggcctgcccagaaacaagtgatgagggccctgggcagccaatgggatcgtgctggcctttctacctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaaggccttggaacaggctgtgcctggtggctcccgcctgtaatcccagcactttgggaggctgaggcgggcagatcagctgaggccaggagttcgagaccagcctggccaacatgttgaaaccccatctctactaaaaatacaaaaattagccagatgtggtggtgtacacctgtaatcccacctacttgggaggttgagacatgagaatcacttcaacctgggaggcagaggttgcagtgagccaagattgtgcaactgtaccccaccctgggtgacacagtgacactctgtctcaaaaaaaataaataaataaataaagaccttgcaccagattttgaaaatgttcaagatcccagtggagaaagagtttctaaaagaggatggtagaagcagttcttcacagaggagttccctcctaattaccacggatcaagggaatgatagttgcaggtgtctgtagagtagatggagacatctgccatcacaggagggattgtgagatgttgggggcaggcaagaaaggagggacaggctctggttaaatttctggagggggctcagggttgacgggggtcatgtccttgcctgtgcccctctcccttgcagccagaggccagcacagccatccaggggacaccaggcccccacttcccagccccaaaatagcctcacccatgtgtttccctcaaaaagggctagaaggctattaccccaatgcccctgctacccccagtctccaaaaagtaatttgcgatctacagggacttacagctaggtgtgatgtcagctgttgccaggcagaaaggggtttgggagaaccctgcagagatgttatgacaagctatgttctggggaacaaggtaacctgctgcagaccattagagctgtggcctgtgaaaaccccagggaatcccatggcaaggagggagactgttttgtgaggaatggattcaggtctaggccacgcgtgaccttggataaatcactgcctctccctgagtctcagtaataatataatagccataatagttctcatccactgtgtacctgtcaccaggcctcagccactgttagttagtactgtgattatttacatacgtaaaggctaaactcaattttaattcttacagtcaccctatgaatcaggtacttttgttgtccctttttacagaagaggaaattgaggtcatattggtaagtgacttacccaagtaatcatagctagtgagtggttggaggcagaatttgaaccaggactagtctgacatcaaagtgttagctcactccaccatttggccccctttcagaggtgcattttgtgggaaggggaggtgagacccctctgagctcagaccactcagtgatttacagacccaggtgggctcagtgttcagagtgcatgtccccttgtctaatccttgtctagttttccctttattcagttactgcttctaaagctggctatgtgtgcttaggccattccagactggagcctgttttggaggcttttgtgaatgcttctgcctggcaacatctgtgtcacgattcctgctagctctggttggctcctgactttggcttttttttttttttttttaattgcagaagaaggtagtgtaaatgaggaaataaagaggggggtgacaagagttggcactctaccagaaccaggggacaggcgttcaagatgcataaagaggaagaaaagcagatgctaaacttaactacgaactcccctgagaattgcactgagtgtaatttatttatagagtgctaacaatgtgctaggtgtggagccaagagctttaccctcatcatcttatttaatgtaacagcccttggagcagatgttttacccgattttactcacacagagggttaatcaacttagatggtcccagaactaaccgactccagagccaggattccaatccaggttatgtggtctcgtcttcagggtgaatctctaggttcttaggcctcctgaggaactgtggtgcagagaggggaaggtactgtcccatgtcgtgtgtgggaggtagagctggggctagaattgggtgtggggttgcagaagcactgaacaggtggaggatgaggctggagagcctgaacacaggctaggccacccgtgttccttgagaaggccaagaagtagaatttgttttcccttcctgtctggtctccccacttcccccccgccccccgcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacacccagaaatttatttctcacagttctggaggggctttcttgttttttttttttttttttgttatgttttttgagacagagtctcactctatcccccaggatggaatgcagtggtgtgatcttggctcacagcaacctctgcctcccaggttcaagtgattctcctgcctcagcctcctgagtagctgggactacaggtgcccaccactacgcccggctaattttttcttttttttttgagatggagcctcactctgttgcccaggctggagtgcaatggcatgatctcagctcactgcaacctccaccttccaggttcaagggattctcctgcctcagcctcccgagtagctgggattacaggtgctcgccaccacgtccggctaatttttgcatttttagtagagacagggtttcaccacgttggccaggctggtctcgaactcctgacctcaggtgatctacctgtcttggcttcctaaagtgctgggattacaggtgtgagccaccgcgcccggcctagcttgctttcttttttttttctgagacagtctccttctgtcacccaggctggagtgcagtgacgtgatctcggctcactgcaacctccgcctcccgggttcaagtgattctcccacctcagcctcccaagtagctgggactagaggtgcacgccaccatgcctggctaagttttttgtatttttttgtagagacggggtttcgccatgttggccagactggtctcgaactcctggcctcaagtgatccacctgccttggcctcccaaagtgctgggattacaggcgtgagtcaccacacccagcctggtgaggggcttccttgatgtgtcctcatatggtggaaggcagaagggcaagagagaaccaactccttccatcaagccgtcttacagggcacctaatcccattcgtgagggagaaggccttgtggcccgatcacctcccaacaccttcacattggcaacacctggactagggtcttagtagtcccacccctggggtcgtcaaagaacagatcagaaactcctggggtgtaggggcaggatccttacatcccctgtactgtaacatatgcatgcaccccccagtcgcatccaagtcccacagatacaagggcttgctgaggtccgagggtctggatggtgagtccagggagcatgagaaattcatccaggccacacaggctcaggcacctatactcctgcccaccccctgcaggatggatattaccatttgaaatactttggcgcttgcagtgagatcttgcttaaaagaagaaacccaccaaattctagaatcgcagaggtgggggcacctatgtgacaaatgagggaacagaggcacagagattggcagggacatgctcaaagacatggagagcctgggcagaggatggccccagagtgggtggtgcctggccctgcttcagcctgacattgtccaagcctcccccagcccactcctaaaatggccaggccccacttcttcccaggtgggctacattttctgctgtcccggtcccacttccttaccttttctccttaaatctgatttcactgtgagggtgggaggttgggcagaggggtgaaaaccctcttccccttacttggtaagcacatacaattttttttggttttgtcaattaaaaaaaataacatacctggttgatcctgccagcagaaaaaaaaaacaaaacaaaaggctgggcgcggtgactcacgcttgtaatcccagcactttgggaggctgaggtgggtggatcacgagatcaggagatcgagaccacggtgaaaccccgtctctatcaaaaatacaaaataattagccaggcgtggtggcgggtgcctgtagtcccagctactcggagaggctgaggaaggagaatggcataaacccaggaggtggaggttgcagtgagccgagatcgcgccactgcactccagcctgggcgacagagcaagactccgtctcaaaaaacaaaacaaaacaaaacaaaacaaaaaccaaacctgttccccttgagggcagccctgatcatcaggagatccgcacggcaaagggagcctgggaagacccccccacctcaacccctcatcgcacaggcaggaccctaaggtccagagaggacaaagagcatgcctctttgctcttctctgttcaactcaggcccgtggcagctgcagggtctctgccagggaagacttcaggcacatcgatggttggaaggaggggtggggtgaggtcttcaagctgtgtttccatagccagcttactgtttgtgcttcaaatgcattgtttattaggggtggcttaggggtctaatggagatgggggtatacatttccccattcctagccagcccttggggcagccaccactgtggatcctcctctgacctatcctccccacctcccacagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaaggtacagggagtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctgacccacccccatcttgtctaagggttcctaagggcccacagaggcctgtcaccacagggtacaggtgacctctctcatagaggatggtacagcacagggtgcctggggtagaacctgcccgaaacactgcagaaaggaatccttgtaatgaccttgccccagtgctgcccgcaatccagtgagggcgccaaggtcacagctgctgccaagagagccttgggcgtttcccacctcatggacaatgcagactaggatgtttttagacccaaagacagagtgctgtttctatcccggtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcccaaagtgctaagattacaggcatgagccactgtgcctggcccaaaactgtaatgggctttgagtgtcagaagaaaccatcaacttctgaggtgaattggacacatggccattcacttcctttttgatctcagaccttgttggtctaggcctcagttttcccatccgtgtgatggctggagtgagtaaagccacttgggaagaaggcattaagcccacagcagtggtgtgtgggtctttagctctgctcagaccctggttcagagctcactcactcactgtgtcctcatcatgcctgtcgcttcagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtggtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacactctggctcctggctcttctgttgagatccagttcatttatcctaaagaggtaactaaagacgctaaatccagtcactgaggtgggagaacgcagcccaagtaacccacagagatgcctgcggggccaggcaggcctgggggggggcttgtagtctttggacacagacatacttgattacatgtttaacacacacgaacactctacttccaaaaagaaataggctcttgcctagtttaagcacaagctcttcttggtacagctttcattttcctatgtccccaatttcatttctatactaagaacagtgtgaatgtgatgacagatggcaaccgacatagggcctccgtgtcaggatggacaggaagtaggggactgtggagaactgggtgcccatgccttacctaaggggctgactgctactcagctctatctggttgctgccaggaggaagcacagcccccgttgccagatgttatctttttaagaggagccagaaatcaagaactgcagtgaaatcaccccatttttaagtttaaagtcttgctgtgggtcaacaaggcccaatgaggacactactctgtagttctgttctagagcaacatgcttgagaggagagaggccagatggtggagggtctggccccgggccccgagtcaagggtgcagctggatgccaacctgggtctccgacacctccagccatgcattccttttctgcactgcctctggctgtttccagcatgaggctaaaagctctggagaccatctccaggacccctggtgttccacatggctctgggcccagggaagtgggcttctgcatttccaggctggagcagcagaccacctcctttgctatccctcccctccctcagtccacacccaagacatcatcctgtctttcatgttcatccacttcttgccctcaccaccacagaaccatggtgagctcgatttgaggggcaactcacttccgattttcctagacctgctgtgcctgccacagctgttcaccaggcacctccagggagcctgcccctagctcgaggcctaactcgaggattctcagccccttccatttcttgtctttgggtatttacatgacttactctggcaacaggaaatcaaccatgaccatcctttagttccatcctttagtttagatgccacctcatccaggaagccttccccaccaattcggcactcaggcacttcactgctcactgcctgtcccactaaccacggtcacccatagcctcaacatgcaggcaagagggaatcccgagtgtcggcgagacagtcccttccaagaaacatgtgccccagatgcactgggagcttgcacccttcctccaagtcttttattttttttttgagttattaaaaaaaaaacaaaaaacacaaccaaaagaactgacgagaggaagacaaagcctcgggatcagccagagaccgagcggcacgggatgaggcacaggtcaggcctagctggatctgtggagcaaggtggtgggaagtcccgaggcctttgggcatgtggggtctgtggaaggagaggaggtcacttaaaaaaatacatatactgtacacatctatatgaagcgtcctgtgttgggggagtggggtgaggtcatgggagctggtccactttctccttggaccagcctccccgcaggctcactggcttggccagcacagggacccctgaagctggctgtcttcttctgtggagcgagggaaggtaacagtttagttccaacccatggtgggcagaggtcggtggaggtcagaggcatggggatggccactgctcggctaggaaatccctaggggaaggaaacacatgcagatgtcaaatttcctgacccttttcccctgcaaggaaaatgaaatctggcatctccaatgcaggggggaggcattaaccacagtggacattttttagcacttggaatgttctgagaactgggctgagtcctttagtgtttagtttagcttcacataagcctcaccactggcccaggaggcgggctctgcatcacccccatttacaggaggctgggtgaccacagggccagcagagccaggtggagcagctaactgtcaccaccacttggcagggcctgtcctccatagggaagcatagatccatggtgatagctcatcttgagtaaaccatcttccttcccaaaaggaaatgcccccaagttacaggatcatgaggaaaatgaaccgctcacaagtgaaggaggaaccaagctgtatccgacctcacctacaaacaggctccatcccagggcacaccccctaaagcatgcacaacccctgcacccaggtgcactcggtgtcaccactgccattactgttctggatccttctgatgctgcagtgccagctcctgatgtcaccccagtggccccatggacccttggcaacagaacctctttccccagcctcctttccccttagagcccacctatcaggtctgcctggctctctgggaccacaggggacaccagagctgtcctcccaccctgaatgctcaggaatgattgggaagcgtacctgtgcctggtgctggtgctcgtcatacagtctgctctgctgtcttcttctgtgaggagggaagtacgagaggctctcagacctgcagcttttccccacccactgctgcccccacctcctgaggactagtgaattcccctagaatagatactgggtctgcagcgacctccaagggcagaggcaaacagatgttcagctctcctaaatacagctgaggccctgctggccaaggtgagaacttcatctgtgtctgaggtgctaaggccccgggccgtgaggacagctgttgttcagggctagcctgccagctggggcacacgcagcccaggcaacgtttcctttcacctggaaacctgccacagtctacctggtttccctgtgctggggggagtctctccttccttccccaacacccttctacctccggcaggccacttctacggcttccatgtgctcagggaacatgccctgccagcctcttccctggtgtgtcacaacccctgacgcccccgactgggccccgaaaatgggaagggggcaggaaccaggtctgggtgtgtaggagggggcttgggtttgggtctgttttctggcctgagacaccccaggaactctctacctttttcttctttttcttctgggacggtgactcagaatctttggttgaggccttttttgctttcttcttcttttcttttttttctttgtctttttttcctaagggaagtaaagtaaagttcctgaacaacagatggtaatcctaagtgctggggtcaatgttgggaggtgcacagggcagggctcccagctttccccacaccaccagaagccatcacaacaggccagcagggcggggcgtggaggttcattcctgcaatcccagcactttgggaggctgaggcgggtggattgcttaagcccaggagttcaagaccagcttgggcaacatagtgagacctgtctctacaaaaaatacaaaaattagctggggatggtggtgcacgcctgtggtcccagctatttggggggctgaagcaagaggatcgcttgagcttgggaggctgagcctgcagtgagctgcgttcctgacactgaactccagcctgggtgacagagcaagaccctgtctcaaaaaataaaaataaaacaggctggcagctgtggtgatcacccagcagggccagttcacctgccccctggaggccagctcatgatttctgtcccatccatggaccacctggatgactaccatttttctttagctcaactcactttttaaaactcccgcaaatttattttaaatggacactatctatccctactgtaaatggaaatctagcacagttctgagcaccaaggggctgcaagtcctgctctgagggtgcccgacttttgttccagaacgagctggctcttcgggcgtcactggcaacccaccgtccagggcgatgctcgagagtgctgcctaggtttgactctggctccacctagcaaaactctgtggccctgaacagcatctctacttctccgagcccgagccgcagttttctacctgctgagtctcatttctacctaaatgaggtcctgctgcatgcggagtctagaacagcactcagtaaagggccagtgttactatggagggaaaactgaggtctagagacaagatggggtttgggatgaggattctgacagtctggttcctggtccattctgcacccaggagctggctggagaagcaggttcctccaagatctgctgcactgggcttggggaaagaggacatgactcctcgtccttctggagcattcctggcagtgctgactcaagtgctctggaatcgagttcgggctttgccacaagctgcccctgtgactctggacaaaccacttctcagccttttttttttttttttttttttttgacagtcttgctctgtcacccaggctggagtgcaatgcgtgatctcggctcactgcaagctctgcctcccgggttcaaacaattctcctgcctcagcctcccatgtagctgagattacaggtgcccgccaccacatccagctaattttttgtatttttagtagagacggggttttgccatgttggccaggctggtctcagcctctcttttctacatgggaggaatgagaccaggtgctggctgagggtccctcccgcccccgtggggtgcccagcagcccttggggtgggctgggagaagcggtcactcactcttgtcggatttcttcttctccttcttgctctttgggttgctttgatctccaccttcaaccgtccccatccccttctgaagctcctcttctggctcgtccttggccccttgggagccaagagaccccttccctttcttctccttgacatcaccacttgctttgtctctctttgctttccccttggaagtcgtggaggtcttttctggggaaacagaggcctccccaccttccccggcccccagcttcttcttcttcttgctcctgggggtcctggcagctggctggtctcccgatagcttccgcttgcggctctcccagcccttcctgctgctctccttggtggtgtccaccaccttctttctttcctgttccagcagctcagtcaggaccttcaccactgaggcctgcacctgggcctcattcaggggccagggttggcccaggaggcactgggtgatgttgctttgcagcgccagggttgaggcttgggggttcccagcccctttcttgggcttccgggacttctgaggtgtggtgcctgaagcagcctcttttccacctatggagagagaatgtggggtcacagatctgggagagttgggggacagatcttatggtacctaagagcgaagagggtgcagggagtgactccatcttttcttacaatggcacagatggggagagcaaggcttggcggtcactctgccccagctggtctcctaagctcacacctttccaccaatttcacaccctgacttcatttctaacttacagcttttccctgtctctttatactaaaaactccagttagggtgggggacagaaaatgactccagaatgttaatgaaagggcctgaaatctatcaatggaatgaaaattcagaaaggagggagatggagtctggagctgggaggaaggagacctgggttctaggtctgactttcccacccactttcagtgtgattctggccaggacccatctcctcccagggccttggtttccctgtctataacgtgaggggtggatgaacagtaaggcttcctatgatacattgtagatttataataaaagtgggggccatgcagacattcaactgatgattacccacactcggcccttcctggtcagggggtccaggcaaggtggggagctctgggtgcagtgtatatacacgtggtggctgactaagcaggtttactgcctgccagagagacttctggtgcagcctttgtttagaattttccacgcctctgcttgcctttgataattgtgtgctgactacacgtgtaaaaaaaaaaaaaccttccacagccccctctaaaatgtctccttgtcgcaccgcctctcacagagaatgttggggaagaaagtgagcagcaattcctcttccgacccagcctggggcaagctgcagctgaaagccccatgactgggtctcctcaccggctctaacttccaagtgacttggaggtctctgccccattctgggtctcatgggcacaacactcctgcatgctgggctctgaaaggtggcttggtggtttggtcctggaggtgtttgcctggaggaaggcccaggtggatactccatgtcacactctatgtggtactcatgtcacactgaggctagggctgccccctgcagcatgcagtgagcttggcccctcagccccaaccaggatttctggcgacttttggctctagagctgcggtgggctgggggaggtggactgggcagggcaggccaggttaggcagaggggcccccgggacggctggaggcccaattccatcctctggggattcttcaagatggcaggagccaatggagagggaagctggggagggcagttagccccggaaacctctctccccagagcctacgtttctgctgctgccttttttttttttttttttttttttgagacagagttttgctctgttgcccaggctggagtgcggtggtgcaatctcggctcactgcaacctctacctcccaggttcaagcgattctcctgcctcagcctcctgagttgctgggagtacaggcgcctgccatcatgctggctagttttttgtatttttagtagagacaaggtttcaccatgttggccaggctggtcttgaactcctgacctcaagtgagccactcgccctggcctcccaaagtgctgggattataggcacgagccactgcgccaggcccacttttctgctgcttatctgcaaacacccagaacaccaaggctggggaagccctggagctgtcccaagtgtgcccagctggtacatatttgacccttagctccagtagggtcagggagtgtggatgccccaggttaggtgaattgaataatccagtctgccctccaaatacaatgtgactattttctacatgtgccatgccttgacacagactggatacatcaactgctgttttgtatggttaagacacagaggtccagagtggccaggggatttccaaggctttacaatgagtcagaacagcctggggccagtctactgcctggggtctcctgcatgtgctgagtgtcctccaaacgtgactgtcagcctattgtctaagctatcctctgaggcccaaggcccacaccgtgagcctatttacagggaagaaaagttgatggtgatggttggagagagccaacacttgctccacaagccaaaagacgcagcttcctctgaggcaagggctatcctaccaggtgcatcagcaccacccagggctggatacacccccacttccaggctgtccagggccatgggagccagacacctgggcgtggggcccacctgtactttttttttgagacagggtctcactgtaccaccctggctggagtgtagtggcatgatcatggctcactatagcctcaacctcctggcttcaagtcattcttctgccttggcctctcaagtaattgggactacaagcgtgcaccatcacaccggctaattaaaataaattttagagatggggtctctctgtgttgcccaggctggccttgaactcctgggcttgagcaatctgcccacctcggcctcccaaagtgctgggattatgggcatgagccactgcacctggccccacctgcactttgatgagcatcttcaggtccaatgcaaggccacaaggtctcacttggagaggctctgggggcagacaggaccatgttgggaggactgttgctacaggagggcaagaaggggcccactgccctgtccctctgtgtcctgctatgtccctcctgcagaccttaacttacctgttttaggggacaacatgcctgctgcctgttggggctttgcctcctgcttgccatctgggtcatctttggcggccagagtagaggaaactgaggggctggagtctagcttgggagtggcttttgaggcctgggaattggctggggttagtccaggggtcatataacctgagaggagagactgaagaagcccattgtgaaagaggctgccaccaccccaccccactgccataacccagcccgagtcatggcctgctgtgaggaaagcagcctggggcctctaggatcaccctgccctatcagtgcagagtgggtggacaacaaggcacagagcagcacttcagcccttggcgtgtgcctcctgaactattttaattaatacactttctagacaggcacatttaaaaaggaaatttcttattaatacaaatggaaaattactagcttttgccacatacagatagtaaccttaaaataaatctgctaaagaatgtttttgtccggacatcacccagaatcaaggtcaatcccttctacagaccccaagggtcagctactcagggctctatgaggggacggaggcagcctggctgtggtctgctggctgggccacacgtggtgccttgcagacaggaccttgcccaaggcctctgtgaagagaggggacccagacccctgacctgagggatcgggtagacaggagcctggcctggggctccaccctaaggcctatgggctgccagtcctctcccttgcagttacctgggatggcgccaccacatcatcctcgctggactctgctgcggtctcctccaccagggtctctgtcctggagggggtgggacctactggagaagcacagtatcctgttggtagccccaggtggcccctgccagccgggaagggcagagcccttcaggaaggccctggtctctctgcaggtccctcacccccatcccctgccccgcctcaccacaagtcttcctactgcttcaacactccttgcacacttatcgctagtcacagcatgctaggtgcgacatttgaatgccaaagccttatttctaattcctgaggccccatttctatttccctgctttccactgttccagaaacatggccctggagtttttgggagccagtgaagggagtctgataccaaaaagctgagagtggtcaaacagcaaagtcaggtctctgaaatcatttggattgacttcctcatgaagttgtacaggtggggaaactgaggcccaggctcagccacaggtgcagaatgagtctgagatatggagctgaggccagagctatggctccaccaggccacacaacaccctcttcctggcccacccttgcctttcccctggcaccctcacccagcgtgtgggctgacttggccccctggggcccttcaccatcttcctcactccctgaagaactgtcgctgctgtcctcactgtcatctgagctctcaggggctttggtggcctgctggacctcaggaagcttaggttttctgagcttgttggtccctttggcctggacggaggtgctctggggacttgttgcagggagtgttcccacagcactgtcaacctaattcggtgaaaggagaaggaatggaaggaaaaattagggcaagtaagacctggtccttcctgaacacttcagtagggccaggaactgtgttagatggggcacacatgcagcctcatttgatccttccaactacgaaaggtactgtaattccttcttacagattaggccactgaggccgagggaggcaaaccaagtgcagaggtcatggggcagatgagtgctggtgccgcaatgcagggccacgcctgcaccttctacgctccgtgggcttgcttcccctggctccccaagctcaccccacttgaaggct

SEQ ID NO: 1661 - DNA, 1046 bp, Homo sapiens
cacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaacca

SEQ ID NO: 1662 - protein, 280 aa, Homo sapiens
MDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 1663 - DNA, 193853 bp, Mus musculus
  misc_feature (1)...(193853): n = A,T,C or G
tcccccataccctccccccaacttccctacccacccattcccatttttttggccctggcgttcccctgtactggggcatatacagtttgcgtgaccaatgggcctctctttccagtgatggccgactaggccatcttttgatacatatgcagctagagtcaagatctccgcggggtactggttagttcataatgttgttccacctatagggttgcagatccctttagctccttgggtactttctctagctcctccattgggagccctgtgatccatccattagttgactgtgagcatccacttctgtgtttgctaggccccggcatagtctcacaagagatagctacatctgggtcctttcgataaaatcttgctagtgtatgcaatggtcacatcacatttcataatttagaaaaggtataaggaacagtgggccccggaagttttggacgtttagcattggtctttgttgcccagtgaactgcactgtggggttatcagtggtctgccttctttcattagcacaggctgatgctggcaggggagggtcattttatgaggccaggtgggggttccaaagctgactgccacaccccatgaccctgcactgccaggtaaccaaccagggccctacactgccaggtaaccaaccagccacttgcactccattgcaaccttctggtggactcttatctatagtcaaacagcatccacgtagatctaggagcttctatctcttttagaatagtatttcattttgtgcccacaagccttctgggcacagcccattcagacctcccacgtcccgacctctggcattcacgaaattttctcttcttttctcccctgcgcatctccttgctgccttcatagctccgcctttcccggaatgtcacacttggagctgcacagacacagcctgctagattctgtcctttcacttagtgatgtttctctctcggtctctgtattctgttttcctatgcaatatagtttaggtcccatttacctatgaatcctggccgcttccaggatttttttttttttttttttttttttttttgggcaattacgaataaagctactgtaagccctcggatgctttgggtaaaaatcgagaagcagatgcagggtcatagggtaagagcagtttcgttttaaaagttgtttatacaagtttcacttgattaccatttgtccatgtgcctttcccttagtagtggggtcacttcgtcctcacagtgtcaacgtttctccctaaaattttacaaggacacaaatactaacaatatttcaagattaccctaattctctttatgttgtttatataacttggagattgctaatatcggtttagtaaaaattgttaactcccatctggaattaagtatgggttcataattttttatggacttgtttgccagtgtattaaaatgggcatattcttttctggtatacagtttggttagaacgaactctttgttttatttagcaataaatcgcagtatacagaacattctctgccagtcacggatatactaggctcatcttgatggtcactacccttaatgtagcatcagtgactttccaagaattcctgacctttgtagagagacaaatattgagcagatgtagagagagctctggatcccaccatctggtgaccaaccaggctcaaccctgcttctgagccagtgagactgggatgttcagggtagggtggcaggtgtcctgcatgttctctgtgaggataggaactgactttaaggaagcccagttaagaaactaagtcctaaagatttctggtgtcctgataggtttagactcttatgaaagagtctatgggagtgcccttggccctctaggagtgaaggtgcagcaagatagctcgagctttgaaacaagaatatgccaacctgtctgcagggaggagactagagccactggaggtacccacggggaggtccaagctgagaatcaaacccagtggagattggccgagcaggaataggggtggaaagatggaaactttctttaacacctggctttagggactggtaaagagcttgctatgccaacatggcacctgggttggattgcctgaacttatgtaaaaatgctagaccttgtgcacatgcttataatgccagcattggggatgtggagacagatggggggccttggtggttactggcctgtcacttggggaactctaggcctgtgacactgtctcaaaaaacaaaataaaacaaaaacaaagcaacaaaaacagaaaagtgagtggcacccgagaaacccctgagagtaacttcttgtgtacatacacaaacacacactacccaccacaaccacacacacacacaacacacacaccatatacatataagcatgcatgggcacacatacaccaatcacaagaaaacctcaaacctatttgaagcctcggctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttctccctggcttccggtctgcaaaatcttataggagcatttgtggatacacagaaaaggtaaaaacgtgtggacttattggaggaggtgtggccttgttggaggaactgtataggtgggctttaagctcttctatgctcaggttctgtccagtgtggatgaatattcctcctggctgcctttggatcagtatatagaactcttggctcctccagcaccatgtctgcctgcacaatgccatgcttctcaccatgatgataatggactgagcctttgaaagtataagccagtcctaattaaagatttgcctttataagagttgccttggtcatggtatctcttcacagcaataaaaccctaactaagacattattgtccatctgtctctgtctctgtctctgtctgtctttgtctctgtctcttctagactgttgtaggcataattctagtaaaagctctgataaacacaaacatgtcagtgttctggcttgggagtatgtgtctctctgaatttacacgaaatcttaattcccactgtgtcgatgataagaggaagagccattgcagaatctgttaggacgtgaggactttgttctcatgaatagtattactgtccttacagaaggctggagggagcgagccaatttcttctagccttctctattttgtgaagacaaagaaggtaggtgtcatttatgatgaacaggccatcagtagacatcaaatctgctggtgcctggatcttgaaccttcaacccttcagaactataagaaatatatttttatttatttatttttttttagtttataagctatgtaacctttgggatttttgatataatggtgttagtaaactatgatgctcagcctatatatacatatgagtaacactgagatattgtttgttggcactttctacttcacatttttatcctaactgacatattaactgatggccaacttataattcaaaattaaattaaacacatggttcttgagttttgtgtcataaagcagacacatcgtggaaaccctgagggcggagtctttgacacagaccttagacttacatgtctccatctttttaactgggaccaggtagaaggaaaattcaatgaagcttccaagggaactgcaaaggacaggttgagtaacatggtgttggcatggaccagaaaggagatttaacaccacgaggaaggcatagtattggcacatgagcttcacctattgtcagcaccagcattcattcacagcatacaaatgagtcaatacctcctttgtggcaagagggacaaggtgacagatatctggggctatagtagggtgcttgtggtagttttccatttctttgatgacaaagttgagaaaatcagttggaaaggaggttatttttacctccagggttcagagattcaggtccagttgctttacatgttgctttttgccttgctggcacagtgtaccccatggtagcatgtggtagacgtggcctggaagcaaagagcagtggttctcaaccttcctaactctgtgccccttcaacacagtttctcttgttgtggtgaaactccaactgtaaaattatttcattgctacttcgtaactgtaattttgctactgttacacattgtaatataaatatctgatatgcaggctatctgatgtgtgacaccccagagggatctggacacacaggctaagaaccatcggcagagagtgatcagaagaggccaaggactcaatatccctttccaggaggccagaagatggtgctggatcctccctgggaacagaggtgcaggctgttgtgaacctcggtgtggtgtgggtactgggaactgaactcaggtcctcggtaaggacagtgagtgctctaaccactgagccatctccccagtgttttaactcctatcaataactatcatctttttatactttggaacatcatctaaatcaaatcaattcacatgtattctgtttttgacccatcttctgtgagtcaagtaaatatttgggacatttatccgtgttgtgtctatcagtgctgcacttaatccttgattatatgaaagtgcctaaacctacttatccttcatgcacttaggacagtgggtcgttttcaggtttccttttgcattttaacaaactgactggtaaaacattccttgcttttgtcttttcttggtcctctgcatttgcttctcttgaactaccctgaaggaggagctgcctggtatgtacattctaatacatttatttaacatttaaaagggcaggttttctggtgtggtgggtccttgggagggctggtcagaaactgaccaatgcagatgtggatgcctggagccaaccatcagactgagctcagggaccctggtaaggaagctggcagaaggactagaggagcagagggggattgcaaccccattggaagaataacattggctggcctgaccacccagttctcccagagactagaccaccaaccaagaagtgtacctggagggacttcagatacatatgtaacagaggatggccttgcctgacagcaatggaaggggaggcccttgggaggtttgatgcaccactgtagggggctgctggaggggtggggtannnnnnnnnnnnnnnnnnnnnnnnnnnnnnnnnnnnnnnnnnnnnnnnnaaaagaaaggtcaggttttgaaaatttatctattatggtgagcatttttttttcacgagttccatgaacgttgggcatgttttcacatgcttattggccatttagaactctttactgttaagtctctgttacagtagctcaccatttttttttttaatcagacaccctcccttaaggagaactatccttagagaggcaggctctctccagtcttcagctaagacaggagataaacacacagcgacttaactctgtcataatttgatccgaaaagcagaacctttgtaaaagatggggactagatttactgagggaggtagaggctggctggtgggataaagttggaagtgaagttggtttggtggggggcatgcagtgtggagctacaaggagagacgaacctaggttgccttttgtccatttaacaggaatccaagccccgccccgtccccctttacgttgctcctcttttagctgggacctgagcggctgcgagccagaacagtgcctggtggagcaagctgccttggttgttgcctgggatgagctcaacagagctggatgtaaaagctgctgaaggtaggtggcagcatagtatgtggattcgacacccggtgctgatggggccggttagcaacgctaaacctttatctttggggatgggggcacatcaccaaatgtttcacagcctcaacatcatctgtagagtgaagaatggctcactgtttttgtgaggattaagtaaaagcaatctgtgagaaacgctcatcgcatgcttgtccattgtggcagttcacatgcaaacatgggtcgctatgatggctgagtagaactgaagacttaagaaaaactgaatgaagataatattccactagcggaaaggtcgatgataaattaactgcacgtttcaaaatattcatctctctggtatcataaaagtatgagctgggaatggtgtgtgtgttaaaaactgttacccttttaataatttccatctctgttaaaccaaacctgaaacttgggttcatgtatcttgacggtctgcagggaggataatttcggcggaggagaactcaactctctaattgtgttggctgcaataaaattggcagtggcagcaatctccatcaaacatggctgggtagaccagagtcagtgctcatacttccggagaaccgatgacctatttattgtctgcattcagtgtaggtcctgtccaggagttttgtagaacttggaggtctttcttcaagggcaaagggtcatagctccaggagaaaggatctactccactgtccagtccagacccatttccctagaagagggcgtgataccaggggagtccagaggattctttccagcctggaggagggggctccccagacgtttaacccttcccactaactgtcctgtggtcctactgtgtgcctgagaacagaggatcaagttctgctgcaggcaggcattcacagccagggaagcagtagatgcccacccactcctcaaacctccggtggcctaccctacccgcagcgagcgcttgtctcacgccccaattccaagctctttacagggctcagggtaccgggtgtgctgcgacctcccctctctcctcctgggagccccggacccgcagcctgggggtggggtgtgtgcacctgggcggggccgcatccccccggcggcgccccccgcccccgccgtctggccgcacgccgggtcctcgccgcagagccgggggaggagcggccgaggctgagttgagacagacccggcctctgcgcggtggcgggactcggggccccagcccgacagcaccggcgctctccctccctccttcccgtcagccggaggggatccccagctagccggggaggagctgcggccgccgccagacaggctgcaagtcccgagaaggcgaaaggggggcggggagctccgagagcccggtggcaggtccctcttaaagagctacgccgcgccgtgtcgcgccacccggagcgctgcccctcccccgcagcccactgggccggtggccgaactgcgcggtgggcggtcccgctcgcccatccaggggctgcggcaggtgagtgccgcccgccgcgatctccgcgtctggccggagttcacctctgagctggagcgggcgggggaggggtggcgggggacgggccgggatgcccgccagactgcgcgggcggccagtgctctccccgtccccgcgtccccgagacccacgctccaggtctgtgaggttgtgttgcgggtgggcgcggagggctgcctgggcgcctgcccatcctccgagagagcgttggctggctggagtcttgcccaccgaccgggacctggtgctctagagtgtcccgctgtatagtggcttcatcctgcagcacccagcgcccgggtgggctcaagggtgcttgtcccaagcggtggcacttctaggcctgcatgcaagctacggcagtcttggggggctggaagtcagcagcgagaaggcggcgcgggagcggccccaagtaggcaccgtaggctccccctgcaccttgcgcccgggctctcaggctccaggcttcccagacctcagaccgtctccccgggtcccccctccccgcccccccgcgctttgacgtcggccgcgggctgcccggggctcctggcattggctggcaaagtcgattgtctggggcggctgctgttacacttaggctgggtctccgggccgggaggaagcaggcgtgtgttgaatttctctttgaccctcacggtggaataaacaggaagcgaagagcacccagccgaagggccctacacttgcatttgttgtgggctctgcgatctacagactgaaggaggtttcccgggacccctgcccggtgtgccgtctgggcacggctgggggcgcgccctgtgagtacgctgcgggagacagcaggctctctgtgcgttaactagctgcggcgccacagagagcatttgcttgcttgtttttaaactttttttctttcttctttcattctttcttttcctttttcttttctttttcttttttttaaattggtgggttctcggtgagcagagaggatttaggaccaaagggacgcatggtgggtgggcgtcattccaagagcccgcaccaggcgcgtctgttccgggttacctggagaggcatctccttggccagtcaggacagtgagaaactcgttaaaacaagcgggacttcctagcttctgccccagcacgggagtgactgctgagtgtcagtggctacatcagtcaacatcatgttttgtttttccacagagactcttaatgagctagagcggattattttgattggctttttcttttccttggagtttgtttcctttgttttgttttctaatttttttttttttttgccatcttgacatccccgaactcctcactaaaagttagagttgattatgactgtgatatttattagtgaccttttctgcattgtggggtgtgaagggtagagattgtgaaccctactggatcttcaaagtagagttctgaggtggagagttagctttcagtggctttcctagcatgttgagacccctggctttccttcctagcatcagatacattaagtaagggcctgggctgggctagtactgccaggcccaccttagaatagctctttttattggtttttattgggtgaccccaaaccttaacccttgtctgtatctaccctgggccttcaggacagtgtattggatttcatagaaggttctatgaagtgaacacacaccaagcgagggcctcattttgtatggaagaagttacagtcttcctctatagtttaaattcagcttactggcatcatgaatctgcctttgcacattctttttggaatatagaatctgtgttcagtagagaaacagtaccaaacttgagtcattatgtggacaataatgggtctgaatattacctgtatatgaattttcttatttgctttctgccatcccagtgacagcttcattctttaacagattaactttgcaatgaacgtagaacacggataagaattagatagagctggaacctgtaaatgtcacagatttactgaatggtaggtaccgttcttgttaaaacagaaaaacctctctagtttcttagttgtccgctcttacccctggacgagatcgccgcccttgtctatggctccagttcctgtaagtttgcatttgtgttggaaagactcttgccagcaggtatttaaggccatctcttgaatcctcctgggtgcttggttttcatgaccatgatcctgcagtggagtccagccagggccagctgcttcttacgggattttgtggggatctgttggcacatcatttcaggttcaacagttttttttcttcactcttctcattagaatatatacatccacaggcaaatgttctttcttcacgccccccaacgttccccccccaccccccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtggtgaaaggagcatacatagcattgtaacctggtaaaacatcagatatatccaatgttgttcgtgtggacacatgtattacatgttaatggtggcaaacttgcagtgtccctctcttcccccctcctttcttggtcccccccccaccccatctctccttggcgtgctcattccttgcttcttcagcattcccttttgtagaaaaatctcccagaaggcactatttctctgatgtcaaagttacttaccgccaacatgggctgttagatgggaagtccatcttgacctatattatgagggcacaggagaagtgagttttaaaataagaaaatgggggcctgggaagatggctcagtcggtaagatgcttggtgtgctagtacagggacctgagtcaacatctctggtacccgtgtggaagccagtgttgaaggcacagagttgggcagatactcgggacttgctagccagccagtgtggctgaatcggtgaactctagattcagtgagagaccctgactcaaaacatacggtggagagagattgaaaaaagacctgatgttgatgcacatgtatatgtacacacacacacacatatacacacacacacacaatctcacccaacacaaataggaataggaatctgcatactatttgaattttataaccccagcacctgccacttttttggtgtgtgtgtgtgtgtgtgtgtgcacgtgctcatgtgtacatgtatgatgtactacttgtgtgcatgttggacaacaagaggaaactagcaactgcctgaactgttcccagatgtagttatattgggttcaaatttccaattaatagtgagtttcctctgttacaggaagactgagaataatgtttgtatttgttacatatccatttgatttaaagatagtttgcttttcattgaatttccactaaaaatggtactttgacctttttaggcttttttttttttttttgaggacttctctctccaccaagcttgttttccagttaggtcttggaaattatgaaggatgtagctgtaatttctcccttgattggcagccgagagctttcctggacaaaaataaggctcttctgtgccaaatggttgacttttctagaataaaaactctaaagggtctgcaaaaagtcttctggttaatatattggcattcccagaacccactaaaaccctgccagcctgccagcattcacttaatgagggcgcagaatgtctggctcaaattcccatgagtggaacgaggtgggggctggatgtccacaccctttattaatttttaatgactgtatttttgttttgcagagtttgcttcagtaccccagtagcctcacagctgaccccacatcacccccaccccattcatttacttacttgctataggaaaacagcgaagtgcttgagatggccggcagatcacatgtgactgcacaagttctttcgctgctgttttttttcttcttcttcttcttctctctctctcttccttagtttttggaaaaggaagagagagagagaaaaaagaaacaggaaagatgacaacttttaaagaggaacgatattttgttgtctgctgggaaaagagacgcctttatggaacttttaggtttgtcagacagtttataggacagtgcaagttggtgcctgccaagccccagacagattgttaatgttccatgacagggataaataaattactgctgtctgcaacacgcttgtgctgcaagcccactgagcagcccagctgcctgtgtgcttttcttgggggcctggtggaagtataactgcacagaaggcctcagcctgctgcctacaggactggacctggtttaaaggggaaaagggtgtgtctcacacttttattttgggctttatggtagaatccatttaccaaatatctgttccccacctcccttattatattattattattattatttatttttttttttaactagatccctggcgtctgtctccattttggtcttcttctggtccatacccacggtcctcctcctgggaaagggatacatttgtatctgctaagagcctgaggtcttctacagtggagctccgtttacactggtgttctctgtgcagtggctgagtgtgtgctgcccgggaggggggctgggtggcactccttgggcataatgtactttcaccatggcagtttggcaactcagctggcagagtgacaggtgtaatggttgctctagttagtggacacactgctcatattacaaagccacctcatctgcggagccctggccaagtgatttgcaattctccttgcagataggactctgggcctggcttattaagtgacattaaggtcaggaatcgggtgggtgtgagaaacatgtgtgtgcccttcgcctcgctgtttctaagtgccctgcagcgactgattcttcaaagccttccttggaaaaggaaataacccatcccatcccaccccctctggctggcccttccttctcatagggtgtggtgggggatcctttggtgtgtgtggacttcctgcccttggggtttgcagaatgttaggcttgctgccaactgtgctggttcctgtgtgcttgacggccactgctctccagatataggcagttgctgggacaggcacaactcagtattgtttttattgcctgtgccccggggactggtaacctgtgtgtagagttagggcagccatttctgtagtataagttcactgtctaaggccaaagcccgagggctccttgaacctggccagacctgcatggaccctggcacttggtcagatcgctatggccggaatttcacttatgggcatgtgttctctgctgggttctcttcttaagtgctgtgcatctatctataagctaatataatctccagagcagctctgtgacagacacagctgagttgtatggatgcaagtcaaaaagttatccaacgtcatataaagcagtggagacctgaacagcttggacccacggggctaagcgatctgtggctttgacactttggaaaagggctacccaggcaggcatgcattcgccagcagaggccataagagttggagaaggaatgccccgccatttctctgctggtctctgggtaggccaattgcagtgggattctcgattgctagcatgcccagggtcctcctgtccgctccccaacttccgtgttttcttagtagcctccttgttctgattctgctctctgctgctgtctgggctctcgagagtggctcagttctgagaacagggcaagcagcggctttgtgtttgctacattgtaacttcagttccttgacaggaaggcacaagccccctagctagtacttttttttatacccttcagaactatgtaccttcctctttccatagtggtctggaggaacttgactgcccacttagggataaaacaggctcacagaagggcaagtggggctaaggggaggctgtttatgtagaagtgtctatttatgtagaagaatcatggagtaccatacttttccctttggcttacatttgaagaaacttgcagtgaagattctggactgggcaccacagggcatcaatcaattagccacacacagagagatgtgtatacaccctgtaaatacttaagcttacaagggatgtgcatataaaattgggcctgattgaacagcccttgctgtgtttggaagcattctcatgaccacggaaaggacaggcgggctctaaggtcaatattcagcaggcgtttccttgagtctggtgcatggaatacgtgccagctcctatacgatgtgcaccttggcacccactcattgccatgcatgttggagcttctgtcgtgttggtccacaggctggtctcgaaggttccgggtggggagagagctctctcagtgactatcttggtctagcctccgtcttccttatatccgtaacactgtgagtacctagaacttgagcctgtcctagagtagctgaatctgtcagtatctgggtagaaataagatttttccctctcagttcatttgctcctgaaaatagaaaatacagaaaaagagaagaaaaataaaattggctgaaattgcctaccattctaccatctttagagttgaccagtataaacagtttagtcgattctgttcagtttattaacttagtataaacttatagagagagttttattgatcgattgcaaaaatcatatgtcaaatttgcatatccttttctttcaaaacattgtactcaatcaggaacatttaaaaatgtgatttaaatatcgtcccaaaatatttctgcatttttcatgagcattgtctatagtattcatctttatgaatctttagaaaattattattaatattgtatatgggtgtccgtgtgtgagtatgttcccatgtgtgcaggtacccttggaggctaaaagaaagttatagataattccttcaagatggagtgacaggaagttgtgagccaacccacttgggtgttggaaactgaactcaaggtctgttgcagaggagaaattgctcttacctgctgagccccacctctagccccttctctctggttttgttgttattttaaaagaactctgttagggcaccgagactgatactagtcttctccattataaataatattttactgaaaaactattaaaagaaaatctcagtagctcaggctggccttgaacttaactattgtaggccaggttgggcttagattcatggaaatcctcctgcctcagcctcctgagtgctgggattataggtacgagctactacagctgccttaaacatttctgtaatacatatagatgttgagtagttttctgaaggagagtcaatggataatgagacttttttcgagtcttccaaaagttggccagttggttctcagaaagggtggggcagctcacacccccaaagatgcaggagctacagggtgactgtgctatgttgacatcgaccatcagtgtcaacatctttggatgcttgttagtagaataatatgagtttaatgtttctattctttgttcttactgttaaagatcttggtttatatcatttgagttaaaggtggaaaaccgactatttattataattgtttttttgggggggttaaatttttttattaaactaataaaatttattttaaaatatataactcagtattgacatattttaagtcatcaaaataatttataatagttaaatgcctcttaaatatgcatgctatcttctgaagctaagagtaatatgcactcaaccacttttaaaaatctatttggaacattaaacatgatagaagtagaaaaaaatctcttataaagtcctctatgaaaggaaattgtaacaggttcctgattagacagaaactgttccatctccaagagagaatatgcagcataattgtggcttcataggatgaattgggtagtgttctttctgtttctattttgtggaatagtttgaagagtattggtattaggtcttctttgaaggtctgatagaactctgcactaaacctatctggtcctgggctttttttggttgggagatttttaatgactccttctatttatttaggggttatgggactgtttagatggtttatctgattctgatttaactttggtatttggtatctgtccagaaaattgtccatttcatcctaattttccagttttgttgaatataggcttctgtagtaggacctgatgatttttttgattctcctcagtttctgttgttatatcaccttttcatttccaattttgttaatttagatactgtctctgtgccttctggttagtctggctaagagtttatctagcttgttgatttttctcaaagatccagttgcctggttttgttgattctttgtatagttctttttgtttctacttggttgacttcagccctgagttttattatttcctgccatctactcctcttgggtgtattttcttctttttgttctagagctttcaggtgtgcttttaagctgctagcatatgctctctccagtttctttttggaggcactcagagatatgagttttcctcttagcattgatttcattgcgtcccataagtttgggtatgttgtgccttcattttcattaatttctaaaaagcctttaatttatttctttatttcttccttgaccaagttatcattgattagagcattgttcagcttccatgtgtatgcaggctttctgttgtttttgttgatattgaagaccagccttagtccatggtgatctgataggatgcatgggattatgtcattcttcttttatctgttaggcctgttttgtgactgattatatggtcagttttggagaaggtaccatgaggtgctgagaagaaggtatattcttttcttttaggatgaaatgttctatagatacctgttaaatccatttggttcataactggtgttagtttcaatgtgtctatgtttagtttgtgtttacatgatctgtctattgatgagagtggggtgttgaagtctcccactgttatagtgtgaggtgcaatgtgtgctttgagctttagtaaagtttcttttaggaatgtgggtgcctgtgcatttggagcatagatgtgcagaattgagagttctttttggtagattttttcctttgatgagtatgaagtgtcctttcttatcccttttaatcacttttggttgaaatttgattttattatatactagaatggctactccagcttgtttcttgggaccatttgcttggaaaattgttttccagccctttcctctgaggtagtgtctgtctttgacactgccgtacgtttcctgtatgcagtgaaatgctgggtcctgtttacatatctgatctgttattctatgtctttttattgggggaattgagttcattgatgttaagagatattaaagaatagtgattgttgcttcctgttatttttgatgttatttttatgtttgtgtggctatcttcttttgggtttgctgaaagaagattacttccttgctttttctaggatgtggtttccctccttgtgttggcgttttccatctattatcctttgtagggctggatttgttgaaagatattgtgtaaatttggttttgtcatggaatatcttgttttctccatctatggtgattgagagttttgctgggtatagtagcctgggctggcattgtgttttcttagggtctttatgaaacctgcccaggatcttctagctttcatagtgtctggtaagaagtctggtgtaattctgataggtctgcctttatatgttacttgatctttttcccttagtgcttttaatattctttctttgtttagtgcatttagtgttttgattattatgtgataggaggaatttctattctggtcccatcttatttggagttctgtaggcttcttgtatgttcatgggcatctctttcttaagtttgggacttttttttctataattttgttgaaggtatttactcatacctataattcctgatctctttcctgggttttctatctccagagttgtcttcctttgtgatttcttattgttcctatttccatttttagatcctggatggttttgttcagttattttacctgtttggttgtgttttcctgcaattctttaagggcttctagctgtttacctgtgttctcctgtatttcttgaagggagttatttatgtccttcttaaagtcctctatcatcatcatgagaagtgatttttaaatcagagtcttgcttttctggtgtgttggagtatccagggctcactgtggtgggaaaattgggtcctgatgataccaagtagccttggtttctgttgcttatgttcttgcccttgcctctagccatctgattatctctggtgttagatggtcttgctgtctctgactgtggcttgtccctcttgtgagcctgtgtgtcagtactcctaggagaccgattctctccaggatgaatttgggtatggagatctgtagcacagggtcagctctaggatggagacagaaaccggaaggatcctgccctcagctgttccttggttcctgtgtcctgatggctgtgggcaggtccctcttgggccaggaatttgagcagaagtggtggtcttactgtgctcacaggtgtgtcagctctcctgggagaccagttctctcttgaaggcttttttttggtatggagaactgtgggaaaggatccgctctgggtgtagaccttattataattgttaattgcaaatgtaatgatgttttaaatataaagttaattttacttagatagattaagggcatattaacagcctaataatttatatttgtccatctatttacctatctattatatatctcatctacctatctgtctgtctgtctgtctgtctgtctgtctgtctgcctgcctgcctgcctgcctgcctgcctgcctatctatctatctatctatctatctatctatctatctatctatctatctatctatctatctatctatcatctatcagtctttctattatttatatatcatctattaatctatcatctatctatcacatatcaatctatttatcttatctatcaactaactgatctatctatctatctatctatctatctatctatctacctacctatcgtgtacatatgtgaacaattataggatttcatggcagttgactgctcttggccttttcttattcattctctccccaccccctctgtctgtctctcagcatgcacttggagtaatggtaaagaaatgaaggccaggagagggcatggattcaacatctgactgctgccatagccatgcaatactttatacagtcagttgtctttgaccactttttgagagcagtaggtctagtgtgcttgtgtctccctctaaggatatagacttaagatctatccattgatgtgtgcttctcggggttcaatgtttgtgtcctctgccaagacacctcatgttcttcatacttgtactcaagtgttggacaaaggtctcaacccttccagacctgtaagctcaacaatgccttgtctctcaatctgctcctaaatcttgaaagaagtgaaagtcatttgagtgggttctgcttaatcaaagtcagccttcatcgagaggttggaacctagagtggccgactgtttcagtagctgtttcagtagctgaaggatacaggataggcaggaagacatcactatctcagggctgattgcaattagtgtggtgtagctgtcttcctaggcacctgcacagtgtaaagcagtcatctgttctgtgggtgtgtgctggggcatgactcagtgtgccctgatgcctggtagacagtgggcaggctccatgggactgagtaagcagtttctgtttcatgtgaagccttcccagaagtgttcaagagagtacagacatggtaaggacagactgcaatccagctagagtgactggctgctcctggaggtactctgccccatctgcctgagcgttggacattagggtgtgtttttctgtgtgtctggaggctcagtgagtgccaaatccttcctgtggtacatacttagtctcatgggtactgagtgtggttgctattgtacagatacagtgttctggctagttttaggtgaacttgacacaggctagagtcatttgaatggagagaacctcaactgaaaaaaaattaggttttttttgttttttttttttaagttaagatccagctcgagggcattttcttatttagtgattgataggggagggcccagcccatcgtggatggtgtcttaagctggtggtcctgggttctataagaaagcaggctcagcaagccatagggagcaagccattaagcaacacccctttgtggcctctgcatcagctcctgcctccaggttcctgcccggtttgagttcctgtcctgacttccttcagtgatgggctatgggtgtggaagcaaaagccaaataaacccctttctccctgagttgcttttggtcatggggtctcatcatagccttagtaaacgtaaccccaactagttataatagtatagttataatagtatagtataattataactctgtagttatagttagctttgaattagtatatttaatgcagaaaaattgtgttatttgtttttgataaaggtgagaaataaacttaggtggaattatttaatagggctttctgtgatttggtctgcagtgcaatttattatttaattactataataaaacatatgtatcccatttttaaagacctgggtacacttcgatcactgaggaattgatcactgtcttgatggatgaggctgtctctgcctgagccattgagaaagccgagctgtcacagggagttgagcattaagccctggggtagctgcccacagtgcgtgtggaggattaggcagatctgtgtccctgagatccccataggtcccacccctgggcttttcctgctgcatctctgaccatcctcctgagcatcctcctagggttcttgtcctgcttgggcaagcaagggcttggaggtttgatgactctagggagtctctaggctccgtgccttactttgtggttgtccaacataaccatttgcccatttcttacattttggaaggaccaactaagatagggcgtgtgcaaccagttgggagaggctcattacgtacatattgcttcctaaatggaagctattaagccaaatatgaagtgtttgtgaagtgcccgcccagagctggaatgtggtcagaggcccaattcctggtctttggggactgagagacgaagaagtaaatggaatatggtataagaattagctggcgactcagggcagttccatgagccagcttataatcaagtctagtctcagaaaagcactgcacatggatgagagcaagggccagagctggtgtgcgtgggtgcttcctcagtccgtcctcttttgccatcttcccatatttttctagaactcatattctgtccaagcactaggtaccaagagtgcaaatatcgctgtccccaaacgatagaagacagatgcgcacactgtagtgacagccccactacagcagaaagggaggctttggataatgccaggagaccttaagaggggctaaaggttgtgctctgactgtccctcttcactgtctcccaccaccctgttcacatgttgaagtataatccgcagtgtgatagtattgaaagccagaacttttatgacagtggtccttaaccttcccaatgctgcgaccctttaatatagttccttgtgttgtggtgacccccaaccataaaattatttttgttgctacttcctaactgtaactttgcttctgttatgaattgtaaagtaaatatctgacatgcagggtatctgttaggcgacccccatgaagaggtcattcgatccacaaacggttgtgatccacacaggttgagaaccattgtgttaggaggtcattaggccggcaatggggaagtgcagtaagaaagaactaaatgcacaggccaggaatatgtggcttgatgtagggaaagggtaatgtatgtgggtgtctcctgtgggcatcatagacatatatcagtgcttacagctcctgaaatgtaagagttgaagtttaaattattcaaattattattatttttaaaaagatttatttatttattatatatgagtacactgtagctgtcttcagacacaccagaagagggcatcagatcctattacagatggttgtgagccaccatgtgattgctgggaattgaacttgggacctctggaagagcagtcagtgctcttaactgccgagccagcctcaattatttaatttattaagttttgttttttctttgaggctctggagaacaaactcatggtctcaacgaagctccatcagcactgagctacacccccagctcccatgtctgtaacttttatgtgccaacaactcaaaatcatgtttcattgttttgccatatggacacttaaggccccccttcccaagttttgtttagagggacacaaggtgaccacagcttaggcaacatgaaaggctagcgctttgttgacccaaggaaatagtcatcaaaatatcgggattatttacctgtgcttggagcactgaccctgttttagcttgtaagaatggggtgttttagggtgtacattcagtccatatgttcaatgcaaggagcatagagagatgtttctttcactggcttcatggaatatgcctcatgggaaagatgcaagagaatgggacacttgtgggtattcacgctcaagacaagtgtggcgggagacagtctagtattggggatgttgaaggggcaaaatattcccgggatagaccaggcatggaggggtccatgcaggttttatagttgataaacaccacaggtgaaagatgggccaattctcaaaggcccacagggtgaggaattttgttggaagactaaccaaggacaaggggcatatgttcagtcaacatcaaccatagctggcaggccattgttcatattgtgtcatggtgcggggccacagaaacacaggactggctctgatgtggctcttccaatcgccccccacaccccgaaaaccatacatatcaagactgaccaaaaaaaaaaaaaaaaaaaaaaagagcctgttgtatacccacagtgctggctggctttctggactgtggcaaacctctgtgataactggcccataaagagaaaagaatcattttggcccggggctttggacattctagtctcattggtttggggtctggtggagaagcagagcatcatgggaagggatcatgtggtagaacaaagcagctcatgtcataaccagagagtgcaggcaaagaagaaaacgtgctctgaccattgcctttgagggaaagcccgccaagacctaaagacatccatgtgcagagtgcacctcccactgtgttccggtcctgcggctctgaagaccaagtctttgggaatagacatttgctgtggaagttactttggtcatacctccgtattcccactatgagctgagactatgacaactgtggttgtttaagacggtctatctgttcacattttctgaaatgattaaatttcataccccatacagttcacacaaggaagccagatcgatcactttcatgtggggaataatcatactttctatttgcaaaacattcgtaacttttagaagcttttcacagacaacatctaattttatgttccttggctttatggaacaaaataattcatgaagtgtacatagaagtgtaattaatagattcattccttctacagtgtaccttttagctgagagtagaattcagggtttttttttttttttaattttattttaatgtgcaaaaccatattggaagttaatctcttgttactgtccaagctacacaacaggctgtgtcctgagggccgtcaagtctgaggaactgcagttggtggcagagcagacacatagtctatgcaattttgagaggccaggagggtaaaaacaccagaaattggatttgaaagtatacgtggttaaaccagtgtgagcaaaggaaacaggctgtgaggccctctccaggacgcccatcaggaccagagctgccctctccaggatgcccatcaggaccagagctgccctctccaggaccagagctgcctctccaggatgcccatcaggaacagagacatccctggggcagatatgagtcagggccactgagtgaactcccctttcctttccacattaaacgagagctttctgggggcagggtgttggtagctctttaaagggccacagaaaacgtaggacaaacatgagttcctgctgatgctggctgtgaagtgggagctgggcagcaacaccaccttccttgggtttgcttcccactgacttccgtccacagtctagcctcttccgccgaccacccccaatcccctaacgtatttctggcttctgactgggtacagcgtgttcagctgtggagatacaagctgccttcagctctgtctctccccttttgacaaaaactgcttctgttctctgtccctgctgcctgctgtgtggccctggtccctggtccaggcctggaagagtttgcactgctagctgctgctgcatctttcccctgctcatcctgctgtgtaagatgcccttttcctcactgactgctgttgccaagtatcccagggcccttcctgggctgcaagcgtaagcctctcacactgctgttttgcagccacggttttctgcgctttcccctgaagccccaggagttgtcgcctctggtgaatgtgttcctgcaactgcacgaagctgctgctgaaggtttcagtgtcgggagggttacagcagactccatcctttctctcatgctgatgataaagtccgaaggctggcctgtgtgctggctttcctcgggtcagtccctccttgtttccaaggaggacagcaacgacaggttcttctgctgaagcgcttgaggtcactggtcaatagtttaggtggcaaatgaagtactttctgattgctggtaattagttcgtgtgatcaatatgtactgagtaacttctgcagagggcttttctcatagttacctatagagagtttggtgtagggcttgtaataaaaaaagagggggtgggggagactcccccgatgaaggggtctgccctgcaggacactgcagatgaaatgcactctgcatttgcttagaagctgggtatgggttgtctttataatagagaacttgttattttgtctactctttaaatatactgcccgtgatcggaagacatggcagcaactgtgatctgcaaggctcactttcttgtttactgttgctaggatatggtaagacatcaagggggcatttcttcttgctcctggaggtgttagagaaggatgtctcattaaagccaggaaagaattaagaactactcttgaaagcaggctggagagtttagcaccctctttctagaagcatattcattcaaggacctggttgtcactttgagtgtgtaggcaaagtgacctttgggtattgggtctctgacggcagcatggcaggccagtgaaccctgcctgtgaggtatcagtgtcaggaggagacaggggctccactttattcgtgtgtggagatatttctagacggaggcagagtcctttctttgtaacttggagtggttatgttttacataagcctgattttcaggctcagagctcttacctcggtatgcttgctgggtcgtttcatttccaagtatctcagccagtgggtacaaaaatgaactggagtggagtgtggctcagaggtaatgcactcgccacaaatgaacaaggcctgaagtctagtccgcagctccacaaagaaggaagaaaggaaagagggaagaaagaaggtagtggggaagggaagggaagggaagggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagttccttacaagtagttcctatcccagggcctctgtggtttccctgcctgaaaccttgatgtatccatattcctggccttcagacaggtgtcctaccttggcaaggtggcctctctaccgtgctttttcctgtctacggcatcctgtgatggaatgctggcggttacctcttcctagaaaacccttgagagcagacagatcactgccctgtctgttgtccagcagtaattcagtattgctagctacatggacaagagagagcatgggagttaggagcccttgcttggtaggagcacagagaaggtcctcaagactcccagggcttggtgaagctctggtgctgaggtagagccctttatggactcctgtctgtcttttgatgcctaggtggctgccaggggtgagtacacggctgtctcacctctgtcactgtggggtaggtcaggcctcaatgcaaacagtaagttctaatggaaggggtaaagtacagctgcagaggtgacagcgacagacttggggacatgccattcaatgctctcacccctgcttcctagggctaggtttagacttacattattttttccatccggggttggaattgaacttgggacttcatccacgctaagaagccccttccactgagctccactcccaacccctacatttaattcttattttccactttcctcctcaaagtaaactttttttctagagatcagaagaagcaactcttttctagattgactcttgccttccttttctactctctcagacttaaatctctgttatcaattatgggcgagttgaatattgtttatacgtttagagcaaatccatcaagccatgaaatataattagatttatgaatgttcgagaaatcaccttatggaggtatttttttttcctatagacatcctctgttggcaggaaaagttcaaagtggagatggttaaggtgtacgattctttgtttttctatcttttcaaaacagactaatcctttgactatttcctggatttctgactcactttctaagtgcgttgtgcttgtgttctggtatgacaggtgatttcctgagtgtgtttgtttgtttgtttgtttattgtgttgtgtttggtttaaaaatcaacagagagactgtgaaagtcaactacatagcaggacaaggggaagagggcccgagaagggtgagttctaaggagcctcaggttcgagccactgacgtgttttccagcccacgtgtactagaccatagcgctagccaggcttcccgaggagaaacatgaccacggacgagatgatttctttgtctgttcactcaggagacaatcttgcttggagtagagaaggtgtgaataaggctgagctgtccttaactttgctagaatctggtttgaattatacctcttcacccccactccacacacccagaagacagactgagaggaaatatacataaacactaaaaaatagatgcgtgaggcatcatccctgagtgaggtaactgctgtcacaaaagaactcacatgctatgtactcactgataagtggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcattggaaagagaggccccttggtcttgcaaactttatatgcctcagtacaggggaatgccagggccaagaagtgggagtgagtgagtaggggagtggaggggagggtatgggggacttttgggatagcattggaaatgtaaatgaagaaaatacctaattaaaaaatcataaaaaaaaataagaaccccagactaggcagtttagaacaaatgaaaaaaaaaaaaaaagactccggaaatgtaatgttaaggatgatctaaaaaaaaaaacaaaaaaacaaaaaaaaaacaaaaaaacctttaaaaaaaagatcttgtgtttctgtttttataatgagaacattcctggtacagggcgtggaaacaaaagtcagtttcttaaaaatcgtggaaaacaattagatgtgtatctttttaagtgttttggaggcagggatgaagttgctatgggggtagaaaggtttgctttccacagagcggttccatctggccctgccttgctcctggagccaagctgggcagccttgtgtgggatagaatttcttatgagatggggaaacagttacatgtcaaatcattattccatacttccctcgagattgctgtctagctttgatctagtaatagggaaaggttccaagttctttttcggggccaacccttctgtgtgccgtggttacctgtatgatctggtaggctagtctgccgtctggaagctctgtcccctgtctaagatggtccatgccgtatttcagggttagacttggaattgatatccatttgcacaagcactgataccgttttcttggaggtgatattttcatgcctcttcgctccttgaaatcatgaggtcatttcccttccttcagaccctggcttagaaccaatgtggtcaacttggagacatggttgtaatcgtctggccaggagcatattgattgtgcatgcctcagttaggctttatgtttaatagagatgggtacagagagatggcctgggaaacctggggaacatttcaagtggttcagagctagagactggcatggaatgcctgggtcatggctaggctgagtggcagacagcagggtgagagtggcatgaggggcagagctgggggtgagggtgcagacttggactgccaggcttcaggcattaaataagcagggggtggggggggggctctcagtctgtggctcttagggtattggaagaataactcatgtggtactaatgtcatagatatgggataaagggggcccccaaatgggtgggtcttctcagaaacccagggaaggcataccgacatgttgtgaaggattcatgtataggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacagtgggcccgtggagagtggctgccagtttcttattgccttggggacagaggggatgggtttgcttccatccctaaggccaaatggaagagaggtgatcctgtttaatgagaaaagcagttagaagacacacgaggaacgtggcctctagtttcttgctctatccccatgcaggatgaacaaccttgtgctagataccgtgggcacacaagctgtctgacttcagtttccccactgagaatcccctccacacttccattgctatctatttccatgtgttatttactttgattgattggattactttattggaagtattatgttcgctcttatttttcaaatggagaagtaaggtctagagggttttttcaattggcccgaggtcacttgctgttaagatcttgtgtgtgcaatgacaggctgggtagagcctggtggctccttgggctcccccttgagttaaatgattgtgtcttcaaggatcacattctgtgaggctgattgcaaaggaaaccgtgcgataaggactatactcagaccatccctgcctggtatgtgcttgctctgaggagttgtgtagcactccaggaatcactaggagcttcaacttctaacaacgtggtccagatggtctacccttgttcaggccaggacatgtcaggtcagacatgaaatgcttgggattctcttttgttttctgggatagaagttaactatcatgaaaggaggcagaagagagtctcaaaaatatgtcattgttggatttatgctctttatatatgatgggcagttggtgtttccatacttagctcagccagaacagtgttggagtctcccatgctgtgcggggattttgttttgtttttgtttgtttctccaaatctgaagtgctcttggatggaacaaaagcagtattaaagggaaacctctattttactttgctgactgcctattataagctgagctgtttttttttcttttttttttaactttagaaaaagggtgaacaggtgagaggatgtggaataagatatatcccagctctgaaagatagtatcagagaggaaataatttaaactctatccacttggcctcatatttctgtaaaatctttggtcaaaggtgtattacctgtaaggagccaagagaaattccacataatgatggcctgggagaggcctgcataggacaactgcaccatgaatgatggccacactagtatgttagttaccagcatggtagtacatgttgataaaactgacccctgggcgagtgtgttgagacacattctgaccagagcctataggcagcctctgctttggctgtgaggcttgcagaatctctcatcagaacgttggcttgaagatggctgcttgcaactgtggtgagacatttgttctccagacgtaggcaggcactgctgctggtgacccagtgttggtgttaagtcacaaccggaaatgttaacccagcgagattagcctccttagtgtgcggatttgaaaaacgagcattgaaggggccacttagaagtttaaacagacttactctccattttcatctaaatattttataggaatttcattagctctaaatgagtttccctgaatggcaacggtaccctttaaattctaattagctagcaaattagctagtattggttctgattaatcagaataacttacaggtactaacgattactatatttaagcaaatggaagtcctggttatctggcctggagagactttcagtggtttaagaaaggctctctgccttcttcttcttcttcttcttcttcttcttcttcttcttcttcttcttcttcttcttcttcttcttcttcttcctcttcctcttcctcttcctcttcctcttcctcttcctcttcctcttcctcttcctcttcctcttcttcttcttcttcttcctcttcttcctcttcctcctcctcctccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcttctttcttcttcttcttcttcttcttcttcttcttcttcttcttcttcttcttcttcttcttcttcttcttctttcttcttctttcttcttcttcttctttcttcttcttctttttcctcctcctcctcctcctcctccttcttctatgagcttgctctagttgtcttcagacacaccagaagagggcatcagatcccattacagatggttgtgagccaccatgtggttgctgggacttgaactcagaatctctggaagagcaatcaatgctcttaagtgctgagccatctctccagtcccagctctctgtcttttatattctattctctacctttatgaagccttcattggatcctctgtgtggaccaaggacaggataaagatgccctgactgtcttgggtggtcctgagaagagcattgttcagagcttgttgctggcagggatttatccctacacactgtggtagacgccctgtgatgtgcatgtaggctgtttctgggatatcacaccacggagccaaaggaagtgagtgtagccatctcaccagggctagcctcatcagggtcctgggaatgcacacacatgtttgcagaaggtagtgtggggaaaccttgtggcaatgtgctgatccatgcaatccatcccatgccagtcattgcggatctcactgtcacttggcccatgaaaggcactgacaaacatatacatattttatgttttagagtggactttagacatactcattgcttcatgactagaatattggaaacgccaacttcttaacgcattccgtctgtggacataccagctggggtgttttgcaaagggtcataggttcacttacaagtggaacagccaggatgtcccctgtcccactgaatggtcagctctctggttaagcaggggctgccagcctataagtgcagggtcccatgtccctgtaggcatggttgtggaagtgcctttagactgtcccaccctctggtgagcccatcttggctccagccctttcatgggactctcttggccttcctgtggcttctctagactgggaggtgcagtttccactactaagtgttccaagagtattggctcctggcttctatgtgctttgagtttgttcctagtgtatgcgtgtatgtgtgcatgcattcatgtgcacacgtgtgctcagttatgcacagatgcatgtatgtatgcctgtgcatgtatatatgtctatctaggaaaaaaaccgactgtgttttatgctatttcatatgctacctcaaagaatcctagtttatgaagacccaaagatacacccaacatagccctatttctaatgcttgatatatgcttccttggcatcgtttgtgtctactcgaaatccagtgtcctcagctgggtggtggtggcacacacctttaatcctagcactagggaggcagaggcagtcagatcactgtgagtttaaggccagcctgctgatctacagatgagttcaaggacggctatatggagaaaccttctctttaaaccctacccacccccaaaccaaaccaaaccactaccaccaccaaaccaaaaaccattcagtgttcccctagggtggcttccttctgcactgtcttagcaattctgaaatttatcatcactttgaaaacagccctgtttgctacttgtaacttgagataggcagggatcacacctggaagtagatagccatgcctggaaacactcacatgactatattggaacccaaggcatgtctttggcatgtagtggagcaggggaagtaggtgaaggccttcatgctgaaagctgctgtttgccaccacgatgagcagcttcagagcttcctcccggcagagccctggtgatgcagggctcctgatcttaactcagccctttaggatttccttttgggagtgaagccctgctcccctggcatctgttcccattgtccctcaaaggagaacattcagggatgcagccctcacaagaacctttgggaagcactttctgcagctttaatccttctggaagtaattcagtgaaaactactgaagtaccaatgtcagggcaataataaaatactcaggacaaatggaaaaagtgagcttaacaggtgatttggtctgaatgaaaaatgtcccttacaggctcatttgaacacttggtccctaagttggtggtgcagttttggaagatgatagaatctttaggcggtggggcattttggaggacttgtatctctgccatgggctttgattgtttttgttttctttaggttatttgagatagggtttctctatgtagacctggctgtcctggaactcactcagtacaaccagggtggcctcaaactcacagaggtcctcctgcctcaggatcctgagtgctgagattaaaggtgtgcaaccaccatgcccagcttgggcttcagtgttttataacctggttgttacaacttctgttttctctttctgcttcatgtgtgtgtgtgtgtgtgtgtgtgtgtgtttgtgtgtgatgtgatctccctgtttcctatttgcatgtcttatactgctgccatgatggactgactgtaccctctttggaatccattttctcctctaagttgctttcctcagggtgttgtgctgaggcagcaagaagtgactgactacacatcagggcttggttacatgaacggaggtctttagatgcagtgacttcctagagccatttattaccacatgtccagcgaagtccaccaaaacatccagcattccaaatcttccctggtaggaagcttcaggcaatggcactgctgccaccacccacccaactgcttgctttgctgcctctccttcgtgtgttgctgagggacttggttttggaagctacagcaaacaggcctttaattcttaggggtgttttgatttatgcccggaactgtgctcaggtgattggtgactaattaaagtagggctgacaagaaccttacagacttttttctggtggaggaaaaactacctctaaatacttacgaatggttttcattaccgaaatgggctttttaggatgctatggagattgataaaattttgccccttaatatggtatggagtctgcatggtatatagaaaaagacgtaagaaacactaaaaacatatttctttacttagcctctaatgaaagtctttcccaagcggttattaaaatcatatccagcagctttggcctcccacacagctccgaccccgatggttcctagttctttcagctgttaagcaattagcgccaaggttggatctgaataatctccctgtcttgctggccccgggaactttgtacctggaccctctttttgccaggtccctctttttggtacacctatcatcttgtacctttgttcctttgctcagctcagcacccctatctgggctctttcatattgaaagtactgagaaagtttgtgtcttcccctcatctcctgcacctgttccccactatcaggtcagagagctcttgtgaagcctcctgccattggggtgtgagggtgccctgagaaacgagaggtgagggattaagctgtctctcccactcccacttctggctcataaccttctgtgagtggacagaataacacatctcaaactaagacaaagtatggggtcatcatttaaagatttacattaagttctctctgttccccatcacccctcctgcctgcctgcgtgcctgcctgcctgtctgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattgctaattgacctttgaagtctttgagcatatttattgatctaacatggattcatgtggtggttaaatattatactcatttacatctacaagtgtggccaccagaagcttaggtgtctcctcctcccttctctatcacagatggatgaatgggcgcgcacatacacataccgcccccctggccccccagtcccagcaggctttctggatgtttctgtgtggagtttgagcttttggcagaggttatagagcaacagatcacatgactgaccacacagttgggatttttctgtcttctacgacagacagaattgctctcttgaatgtacaatttaataaatatcaagaacatctgcattatatgcctcattagcaacatagccatgccttctggggaagcagacaggcacacatgaacatgtgaattgcagcgtctgtgtctctggaacatgattggggcacgccttctcatacaagtgtgagccttagaaggcagagggactgacttggtaccccaaccctctttttggagaagtggagggtttgcctcactgggagctctgcaaagagagaagcagcgttggggtgacgagtgtgtgcactgtggagtgagtaggcttggttctgagtctagagggaactcagataggggcaggtggctcacgagggtgaccacagaactccctccaagccctgccattctcgagaatctattcattacagaaataatgagggagagttgagatgagatgggcagggaggagggcagatttttttcatactgggtgtaagttaggtcgactttgggggctgccagcaggtttctctgactgtgtcacagaagaaaatgaatcaatattcacacaggttttgccagatgttttctgtaatgtgtattattgccaccctcacttttgaaatgtgaatctgggactcaggaggtttaagtcatgggcccaagtcaacccagctgcagtggacttgagcttccttccagcttttgtgaatgtgtgtgttgtatggatacatacatgtatatgttatatggctatacacatatgttttgtatgaatatttacatgtgtgtgttgtatgtgtgtatatatgtgtgtgtgtatgtggttatatatgtgtgtgtatatatgtgtacatgtgtatgtgtgtacatgtgtgactgtgtgttgtatgtatatatatatatatatatatatatatatatatatatatgagtgtgtgtgttgtgtgtgtatacatgtgtatatatgtgtgtatgtagggatatgtgtatgtatatatgtgtgtatatgtgcatacatatatgtgtgttgtatggatatgtatgtgttgtatggatacatatgtgtgtctgtgtttgtatatattatatatgtgtatgtgcatatatatgcatatgtgtatatatgtgtgcatgttgtatgtatatatgtatatatgtgttgtacacacatatatgatgtgtacatatgtatatgtgtgtatatatagatgtatgtgtgcatatatgtgtatgtgttgtatggatacatatgtgtgtgagtgtgcttgcctgtgtgagtgagtgtggaggcttgaggatgccctccagtgctgaggtaatggacttgtgccagcacactgagattctgaactcaggtccttctgcatgtgcagcgaacactttacccactgagtgagctcccagcttccaccccatatctttgaccccagctctctatctgtgttactgtggctgagagatccccaggaaatctggacagcaattttcaattgaggaacaatagacagcataggtcatttctgcatcaaggggagtgaagagaagtaagattttcgaggttgacctcgaaaccaatgtgtaaaatgctcatctcgagtctcatggaatggtgaccagggctcagagcagctcttactcccctctctgtggagatggcctctccctggaattacaaggcaggcactgacatatgtaagagtggatgctcaagagcaaattaaaaatgccttgttaaaaaccaattcagtgtgtgaacagaaattggcatgaaggttgggtccctgtgttttgagaggctaattaaagtgcttgaacaatgaatggtaaaatcagatagcccacattgccagaatccacgactaagcattcactgcagtgttaatggtagcctgtggaggtttggatagtctgtagccatttctgacacttcactccatcagcttgtgctgagaccactctgctctgaggtccctggaatctagggatgcacataccgatacatctcagcactcttgattttgggactcatcatggtacgggatgccactacctggaggctgtggtcaggtttttgtaaagagcttgattgaagctgaggcaaggggttgtagctcgtgggtgcttctccttctgagagcgaggcactgcatctgttttcttcagtcaatcaattgccacttaaagggcagactccctggccctcctagctgccaggctagctgagtatgggctatggcagggcaggagaacgaaggaaatttgatcagtggcagagaattctctcattttgccagtgacttggaaactggtctccagggcgagtttcctgtctgtcttagctctctgtgacactgacatgactgggttcaggcaaggaagttggttcaggtaagaatagtagaaacagtgaccacggggcgttgggtactaactactttacttaactactatcttatgtaacctcctggtttactacttccattgatgactctgtttttgctctaagaactggccatgctttttggatgtacctggaatgatatgaaagcaggctggagggaaacagagctgctcccgcctcagccctggctggagtcatgtgatcattttgtctaattgtttttcttcatttccaaccctccctccctcccttgagaccctgttgattgactgggctggctcagtcaggaagacttgcccctggcttcatagttcaataaatacagatgtttcttttactgtgatggcgccttgaacatcatagcacgcaatcattggtttctcgccaacagccatcatccctgaagacttgtactgtgtatggctagccttggaaaagacaaagccaaaaaaaaagagatacagtgtatcctttaacagcattgtgaagttgaaagattgtaagttgaaacgttgttagggcttatctttcttcttagggacactccaagctaagtaaaccatttccccctctaaggctaggttaattttgttgctggtagtctgtaatttcatatttatacttttcctcttttgaaaatttctaaaatagagtgaatattcattgtacacggatatagggatggcgtgtgaagaacaaaaaaaatgattttgaattgacttaaggcctctgtttcaaacagttttttttgttttgttttgtttgttttttttaacgttcctttggcttatttgttttggatacagcaaaactgagagaatcccttaaccaagagagcaagctggctcgagtggacttaggaagcttgagtggccattctgtagaaagggtagaggcttttatggcacatagtgaggacatttggctcatgcgcgtagtgtaactttcttgcgcattctctgtgttatgtagttctacatacatgcaactttatgcatttgtatgtctgtcagcatcttacatctccacccagtcgtgtaatgagtcgtagcttacattcagatgctctggaatttgtacccggatggtggctgactttagttggccagcaggggggttgaaggggggtaaggaaggggcatccagcttttctttttgccaactgtttttttatacatgctaattttaccaccttggtgtaaggctctttggaccttgctctctgtcctcgtttctaccctcggttcaccgctgagagctgtggttccagaaatattttagaggagctgaaggataacaacccaccttctggtcctgctcccatgagggtcacagtcactgtctaggaaggaagaactgtgacactctcttcccatagctacctgttggtgggagagaggaatctgtatgccttggggttggaagcagctgaatccctccattacaggcttagtctgggctgtcgaatcccagaagagacaacagcttttctctttcagcattaggcaggcccctcatgggtatggctagcattctcaggtccagttagatagtgcctcaccttgtaactctggctggcttggaacttgttgtgtagaccagggtggccccaaactcacagagatccaccttcctctgcctccagagtgctgctgtgccactatgcctggccagtcattttagtttttgagttcaggagtaaggttgtttgggcagcagaaaaagcaaaaatcatgctctattgaaaaggtggccttagctgggcgtggtggcacacgcctttaatcccagcactcgggaggcagaggcaggcggatttctgagtttgaggccagcctggtctacaaagtgagttccaggacagctagggctataccaagaaactctgtctcgaaaaacaaaacaaaaaaataaaccaaaaaaaacaaaaacaaaaaagaaagaaagaaagaaaggaagnnnnnnnnnnnnnnnnnnnnaaagaaggaaagaaagaaaaggtggccttttagttagatcaggacgagccaggtatattcattacttttgtactgctgtgacagaagaccctggtaaatcttaagttagggaagaaagggctcattttagcttagagttattgaggggctttagcccgtcatggtggggaaggcatgacaatagggataggaggctgtcgtggcagtcaggaagcagggtggccacagtttatacacacacaggaggcagagagaaagcaggaagtggcacagactataaaaccttaaaacacctgccctcaatgatgtacttctccggcaaagccccagaggttccaccacctccccatacagtactaccaagtggacacaaatgcccaaagacatgagcccaagggggccattgctcacttaaaccacaacagccggtaaaatgggtccatactgaagggagcacgctggtccatgacaaggacacggtagcaaggaggaaagccgtagaatgggggttcttgggacattttagagacggttgatatgggaaaaatggggtcaggaggatggattaggtaattttctaaaattggataaaaataccaccatcaaaagcaatttatatatgagaacagttattttggtttacagtttcagagagatgagagtcctccgtagtagggaggcagggcagcaggtgtctggagcaggaagctgagagatgaccacacctccaaccacttgcagagagaaagggagagcccgtagtggtgggggcagagaggcaacaggtgctggtgcaggaagcagactgtccacatttagtcacacgggaaacagagggattggattggaagtggggtcagagcttgctcgctcggacttcctccagcagggctccgctaccaacaagttccaaaaacttctctgaacagtgccactatcgggggaccaagtattcaaacacgcgctttggagagcatggtttggtgggctatgcggtgcaccagctaggatgctcatagaagatgtgccttttgaatatgctcagtctattcacacaaacatcccttacaagaccatacaattatagcggttatggtaacctcatctaaaaagatagctcacccactgaggaatggtcagtagggcagaaaatgctgcaggcttccaggggaggtgctttgggaagcaggctcgacccacacctgctctgaggtgctcagctgtggcaagctgggaacatggcatcgctggaagttccagagggtccttgagaagtcagcctgtggctggtgctcatagatgggctcatgtgaattgagcaacagtgctggcacctgaacaggtgccaagccagagtcacacagtagccagtctcaaagtacccttgctggtgtggattggtctagaggcttgagattctgtcaggatcatggcagtgccaccctaggcttaccccccaaatcccagcgtttcgtattgtttagggagcatcggttttatgttcttagggtttacagatttgggctggttcattaatatatcagaatcaccttggggttgcttcattagcatatgagagtctgtctgccttaggcttgactaatactgaagctgccttgtggctggctccttaacacatcttgcaagcatgattttattcccattcacacaaactgttttctcttatgttcctaatagaacctatggaaggggcaccatttaaatctccacagaggagatggagggtgttaagagtcctggataaatcaacagccaccaaaaacaacaccaggacaaagtgatttctaggtctttggtcccatgaactcaagagaatggaatttagagagcaggaaggtgtgtttaggaaggaattttattataagattataaattggggcttgagagaagggaagagaaaggactcctgaatagaaggggtgggccccagagtttgaggtaccatcgagctgctagcctaggggagaagaagagagaaaggcatgccttttttgagttggggaccaaggaagcagtcacgttcagcatcggaggtctgcaagcagctgcacagtggagcgggacaggggttagaagacttcagagaatgagaaagcctagcctatcgggaaagcgcgcttaagcctttggcaggtgtgatggctaatcttgggtgtcagcttggcacacctgggaagaaggcactgaaatcaggaactgccatcatcagattggcctgtgaccacgcctgtgggggcgcattttcttgatttctaattatgtaggaagacccagcctaccgagggctgtaccgtctctaagcaggtggcctgggctgtataagagagttggcggtgagcctggaagccagcctggtgcaacagtgctccttgtggtctcggtttcagctgtagggttcccttagggatggacggtaacttgtaagccaaataaataaacccctgcctcctcccgcagctggttttcctcagtgtttgttacagcaacagagactcgaagtgggacatcaggtgtctgaaaagataaaaaggcaaaaaaaaaaaaaaaatatgctttctgagttagaattcagagaagcagccagacttaaacatggcagaagttccgcaagcagctgcagagggggagggacttctggacgctgcattatctcactatggggataattattctctactcccagtcgctttagaatgtcttcaggtgaatcggctttgtgatggacaggtccagctgggctaactcttaagggagggggtgatagtagccaatgttctaatctttggagcagataacagccttacagggccagcggtggagctgagggcctgttgttttgacccggaggaagcagcctcccagtaaggagcctcaactaagctctcatattgtcttcttctcccatggtattttaaacccaaaggagggggcagtagtgatgctttccttttggtattacaaaggaaatggaaatatatatatatatatatatatatatatatatatatatatatccaaaactggccaggagagagggctctatcctccaaggctcccaaggctaacggatcactatctagctaactaatattttcccctgtcctagttagggttcctatggctgtgatgaagcaccatgactaaggcaatttggggaggaaatggtttatttggcttatgcttccacatctgtggtccaacactgaaggaagtcaggacaggaactcaaacagggcaggaacctgggggcaggaactgatgcagtggtcatggaggggtgctgcttactggctcactcctcatggcttgcttagtctttttttttccttagggaaccaagaccaggggtggccccatccacaatgggatgggctcttccacatcaatcactaattaagaaaatgccccacaggctaacccacagcccagtcgtatggaggcatcttcccaattgaggctccctcctctccgatgactgtagtctgtgccaggttgacatgacacttgccagcacacaccctctctgaagttgaaatcctaaagtcatttaggatctgggctttgtgtcattctgactatatcctgcgtcttgccatgaactttgctcattctcaaggtgtctaccttaaaatgtcttgacccatcatcaaaacacaactttgctcttccttttgaagagaggtgtgaggtctttcacaggctcacaggttctttgggtcctcaagtggattatgtgccaactggtgggtatcgcagtttggtagggacttcttgggaggttcccttgtgttctgaaaaaaaaagtggaattggacagacatgtggactagtagtaagcaaagcgagagaacccataagtttatattttgaagggagggacagttggagcgaggaagggattcaaggatctcagctagcagctggtatatagggctatactttcaggatggctgtaaaattgaaaaaaaagaaatccctataggaactttaaaaaaaaataagattgttctttgacattttcatactgtataaaaggcatgctaacgattctctcgccctgccaacttcccactctccccacgaatcttttccatatatacaccttttttttttgttgttttttgaaacatacacccctccctctttcatcactaataagtctcatgaagaagaaaaagaaaaagaaaaaaaatctcccttcagaaattccgaggtttatagcagacttgcagagataatgcaggaaacccttgttttttgtgcacccccgcacttctgatcctaacgtcttacctaaccaggtgtatttgttacagtaaagaagtgtgcacttacagacagtgctgaggaagagcacaggtgtgattagatctgatcgtttttttttccacgagcatcccgtttctgttcctagagaagtctaatacacggcactgcatttcatcacagagcttgttagttttatgtccgacttgatacaagctggggtcatgtgggaagagggctattgattgagaatatgcctccgtaagattggcctatgggcaagtctgttgggtattttattttacttttatttttgattagtgattgatatgggaaggcccaacccactgtgggtggtgccaaccctacgttgatggttctgggcgctataagaaaccaggctgaacaaaccaggaggaggagcaagccagtaagcagcacaccccgtggtctctacttcagttcctgctaccaggttagtgtcttgactccagccccgactgactttactttgtgacggattacgatcaagacacataagctgaaataaacctgttctcctccaaattgcttttttggtcatggggtttaatcacagcggtagaaaccctaactcaagacagacattgtacatcttactgtttatacaactttatttttgacttctctctgttgtaaaaactcaagctctctagagaatccgagaagagtcccagctgatgtcctcctctgcaaagtgtggttaatctcacttttctgccctaagcaattcacgcttcttagtgaaccaaggtggctagagcagtagaatactctccaagcttgggtttccactgctgttataaattccatgaccaaaaccaaaaccaaaccaaaccaaaaaaaaaaaaaaaaacccaaataacaatccccccaaaaaaaacaaccaaccaaccaaaaaaaaaaaaaaaaaaaaaaaccaaccaaaaaaaaacaaaaaaacaaaaaaacaaaaaacaacttggagagaaaaggcttattgcactttactaccttgtcgtccatcacaaagaaaagatggggcaggaagtctacacacaaacctggtggcaggagctgaagcagagcccacagaggggcactgcatggagcggtaagtgtcgtgagggagttgccaaggttgtaaggtcttgccttgtaagccgaggcattgtctgagggccatcggccctgataacctgcttgagtgactaagagggaacacttgacgatgagaattgtgtctggtcttcctccatggtctgttgcagttgccaggaaaaatgcttcagatgcaagagatacatagcaggtttgttggaaaactctctttattcatccctttgaatcgatgggtagatttagttatccttggtagttggggatacctctccaggtccacataacctcaggacttttgagatgaggattagagccattctaaagtgaattgtcaaagtggtaaagaccatcttagcctacattctgaccttagatgtcagggtcctacgctacctctggaatgctaaagcttttagggtttgcctttgcattgtacattatgcttgcctcagaggagttcccatttttgtgttttgctggttattggctgctcctggaagcctctcaataggccccagtcttccattgttaagctgcttcccaccatgatgccagaggcttcgcctggtagtcccttgggatcgtttttttaagaggctggtaccttgaacagaattcaaatgcagaggaccttctcactgatcttcaaaatatgttagtagcttacatgatagtttaatgtgggtgacaaaacacacacagagagacacacacagagagacacagagagagagagacacacacacagagacacacacacagagacacacacacagagacacacacagagacacagacacacacagagacacagacacacacagagacacagacacacacagagacacagacacacacagagacagacgcacacacagacagacagacgcacacacagacagacagacgcacacacagacagacagacgcacacacagacagacagacgcacacacagacacacagacgcacacacagacacacagacgcacacacagacacacagacgcacacacagacacacagacgcacacagagttatttgtgtttgcagaggatttagcttctccagccagtattagaatgtctccctgccataagttaagttttttcatgcaaatgtggcattactgccaaggttcaaatgcatgtacacatttacccctccaacagtgatgtactatgcacattctgcaggcgctaggattggtgtaggaagctttcgggaagggtttgtctgatctggtgtctgacctcagatagcctttgatatctccagtagtcattattaggataattgcaagtagaaataaggagtgtgaagatgggatggacagtcagccatggaaggacggacccgtcgtcagatgggtcctgactgaggtgtctggcttgctaggactcttgttgtgaatggcaaggagtcaggagccagggtgagagatgaaaatgtcattagtttgtattagcatcatgaggtcccgtgtgggccatttagaaacgggcacatttgtcattgtcccttgatgtccagagttgtttctgggtagggctagttggctgcgagctcccagcagagtgggtgccctgttcctagaacaagatccatactgttgcgctgttctgtcctgttgattttgcatcttgtacctttgctagttttccgaaccactggccataccacaaggcttcattgaacagatggcatgagacagacgcatgatcttggaaaaccggggccccagggatcaaggtacaggcctgccttacgcttggcacacacctcctgttcccaatctgaagcattttctgtggtaggccaggggtctgggctctgttctctgtggagctctgtgcctgtgaactgtctgaaccccggagttgagtgtcgagcatcacacttgcccacacactgccaggaattatgatctgaggaaggcggtgcctgattggagcccttgtaggagtttctgtatgactggcacttgtgggggactcagatcgtttgccatgctctgccattctgaacacaacatgtgcttaggcgccttagagaagtgtgtcatgtgctcagctccttctcagaaacacaatgtaaatctaggaagagtgatactttaaacctcttcttccttcccacccactcagggagcttcctaagccgagggtgactaagatccggatggctgataatgctgtcttctggcttgtttggtaccccgaggcaaggctcaattttggattcatcatgaagcgtgacactaatgggagtcaatttgtcatgagaggaactttcggggaaacggaggtcggagtagaaataggaatgttcagaaagaaaacggaagtcgagaatgcagaagaatctttcctgtgttcccttaaaggtgcagtggtcagggctctccatgtatgtcctttttccaaagagttgaacacaagctttccttagtggaatatctctggtcacaaggctgccctggcctctttacacttaggagtctctgaacatcaaactgttggcgaggttttgacagcaaatctccaccaggaaggatggtgttgaccgctctacctgcctttttgcttgcagccctggagataagccttggaagtgtgcgtgcttggcagcttgctatggagctgtggaaggttccaaggaaccgaggactcgggtatacatgcagaattgctattttaatactcaatattgaatttcttccatagctgggagaaagccttggagatcaaacttgtggttgggggaatatgaacaccagccataatctactccatgaggaggctgagatttctgaatgcatgtgctagaactgtgagctgaatggaacaggttttcatggtgaagggtagagacttcctgggcggagcaactgagagagcagggagcatggtgagccagggctggtgagtaggaggagggagttcccagaagacaggaaaagggttttccaagaccttgctcattgggtccccaaaggcacacgtgctttcagggtttaacaaatccaggaggcaggcctagtgggattaagcctttaagggctcactgggacatgtccctccctttgcctctttctttccttcctcccactttcacttctcatcgtgcacatgagtgtgtgtgtgtgaatgcatgtgggtgccatggtgcccacatgaaggtctgaggtgccctcaggtgtagctcctcaccgtccctgttgtttgagacagggttgcttgtttgctggttcttcatgtcagctggcacccaggctcacaggggttcttgtgtctccttccaccttcaattttgccataggcacgctgggatttatgttgttctgggggtgggagtgttgtccagactccgttgtgcaccaagtgcttaacccattgagttatccctcaactccactgtcttaataaggtgttagtgttgttgtaataaaacactgtgactaaagcaagttggggagaaaaatgtttagttggcttctgcttccacattgctgttcatcaatgaaggaagtcaggaattcaaacagggctggaacctggaggcaggagccgatgcagaggccatgaaggggtgctgcttactggcttgctccccatggtttgcttagcctgctttcttatagagcccagaaccatcagccttgggtggcctcacgtgcaatgagcagagttctcctatatcaatcactatgaaaatgcctataggctggcagccctacagcctgatcttatggaggtattttctcaaataaggttccttcctcccaggtgactttagcttgtatcaagttggtataaagccagccagcacaaatctttcattttgagacaaggtatctcttgtttcttcaaattggctaattggtccatgagcttctggccacttttctcgcgtctcttatctcaaccatgggattgctaggatggcagttgcatgccacaacatctgtgtgtgtgtgttttctggaggttgaactcaagtaaactcaacaagatcacctccttgagatgtctctccgacaactctcccctcttgcttcctggtcattgtaacatgaataggccaccatcatctgcttctgtggagatgatgttgctgtgacggatggattcatagcaacagggccagtgatgaattgtctgagactaagaaccaaacagggctttcctccttataagttgattatctcggtaaagctcggcttgacgatagctgctcttccaacctcagggaccagtatttactcttacagataaattcaatattgtatgccattcaccactgttctagagttaggaagttttcttagagcgaaggtgactgcaggagccaaagtgctccagtgtaataagcatttgaaaaacaaaatagggagcagggatgcagctaagtgacagagtacttgtctagcgagaatgaagcccagggtttatgcagcatcacaaagtcagttgtcaaaatgaaaaagaaaattcaaaaaattaatcctaaataaaatgtcaatagcagaacttgtcactatgtgatgctaagttttgtgacactagggctggatacatctgtccctgctcacagaagaaggatctggtgtcagattctgccggggatagttgctgggtcggtctgtgatcagtagctgaacctatgagcagctgagtgagacagacacacaacctgtgttaggttccaggccccgggactgtctaggcagaggccctctcgggagctgcttgcatatgttcacacctagcaagggctgatggctgggtactgctgagttcttcctgggtgctgaggtttgtgttggggtggggagaaaagagaagagaagagaggtgacaagaacatgccaggagaaagttccacccttgagaaaaatggggtttgttatggaggggtcagggaaaccttcattaataaggtggcatttgagcagagagtgacccatatgggtagactgagatttctaggccagaagaactctctgtaaaggccttagacaaaaggcttgcctggaatattcaaggtcagatggctggagaggaaccaaggtaagcgaacagttgtgcacacgtgtgtgcttgtgtgtgaattctgtgggtcttgcaggacttggcatgaaatgacattctaggatgggaaaggagctgtgtaggaaagggtctctgtggactattccacggaggacagggatgccgtgagaactgctgctgcatcaggcctctcaggccaggttgattagattggggagctgaaggaagagctaggaacctcccgtgtgtggcatggaagaggagggtggatctgagtctgccttagtacccagagtagttgtccctgttcataaagggggaaggagcaggtttcattactgttttattgtaaaaaggtgatggaatattggtgtctgtcttacagcctaggtttttggcccgactttcagcatatgccccctttgcaattagtcaccttgtagaaaacgacttgccacttattgaggacattggcaatgttagtggtcgtccaggaaccaaactgagtttcttggcaggaaaggtttgatttaaagaggtttgattcttctaggagaaggagttctgtgtgcacacaaggttttaacttaattattttcttggaaaactgtagagctgtggttaaaatatgctaactcaggaccaactgctccaaatgcagcaggaagtctgggcaaatatagactgtttatctttgagtccaccctcttgatatttgaggcatgctgtttaggtgtggaaatggttcttctcctaatttaggtccctaaacacaaacgtggtggggttttcccatgttcccatgcatacagatcatcaattcaggcgaatcacctaagccggactgggcagtaagtagtcttttaaaaagttaagtttctttccttctctgagctctctctgcttggaatcatagctcgcctttgttggtccaggttggaaactgaatctgagacacattcctgatcctgcatcaataacctgcttttgaacacctctcccctcccagccctaccccacccggacgattcttgtatactttaaagtttgagaaggactgagttaaaacagttgaaaggtttctgaagtgtacttggctttgggatcagcattttattgggggcagctgggtttaaatccgatgaatgctagcaggtgtgaactgagggcagcttggatactcgggttacaaatcagccttaacactaactctagcaaagcagcactccataagtgctcccttctataatgctgtgaaccctccctcaaccttgtaatcttgtatgaatgctgacgtggagcagaaagccccgcccccgcctcacttataagaaaagggtcagttagtgggagtcctatgagtggcggaaaagccttacctactactgcaaaaaaaaaaaaaacaaaaccaaaacaaaacaaaacaaaaaacaaaaaaaaaacaaaaacaagtaagtaaaatataaaaaatggaattggttggctagcctcggtgcctctgcaatgtggagcaggtgcagctattggcagacatttgtactaccgtgagtgccgcttgatatatggtagcgcacttacttggaaaatattgcccaaagatttctgaagttgtttgttgctttttctttaagcatgtctcttgtcggagtgaagagaaaattactcgtgtgggatctcgagaagtaaagaaaaaaaaattgttaatacctcctctgagaatggtttgtattcggagctgtttatgagcgtcacagatcatttccagctaacgcacagttgctagtaaaccaggcagtggtgaagtctgcgcatgcgcacagcctctagctgctactctgccgtctcgggcctgtatgctgtgggtctgttttttaaaatcagtgacacgatctacatggaccgaaaatacctggctcttgtgtagagaccctgttttgaaaatcatgtccctgttaaggatcttcagaaaccccaatttttaccgcataagttggaggcatagtcattttttttgatggtgcagatagaaactcagcgtcacacccttcattttttgtttgttttttatgacttgtgtcactctgggcggtgcttttagtttatcgttggtgggccatagaccccacgaagtatagcagatttccctgcctagtacctggttaaaacctgtgtaagatggtgatctgggtccagggtgaagcctgtggtctcagacagtgggacctgaatcatgtaggatgtttttcatggctctgggtgatgtccagcagtggttctcaactagggagcgctcgtccccagaggacatttgacaatgtagacagttttggttgtcataatcttgaaggcaaaggccaggtgtattggctagtttagtgtcaacttgacacaggctggagttatcacagagaaaggagcttaggttggggaaatgcctccatgagatccagctgtaaggcattttctcaattagtgatcaaggagggaggtccccttgtgggtggtgccatctctgggctggtagtcttggttctataagagagcaggctgagcaagccagtaaggaacatccctccatggcttctgcatcagctcctgcttcctgacctgcttgagttccagtcctgacttccttggtgatggacagcagtgtggaagtgtaagttgaataaatcctttcctccccaacttgcttcttggtcatgatagtttgtgcaggaatagaaaccctgactaagacaccaggggtggtactgatgtcctgtactgacaggataaactgaggtttatccaggtccagatgtcagtaagccttggtagagaaactatgctttaacaaaattgcccgttttagtgggtggatgatgatactgggtaaactttagaaaacacacagtggctgggcagcggctgaaaagatgtcggctttcgaacgtgttctgttgcatactgtcctaagtgacgtgtgttagctccacaggtcctctctattcattttcagcagatagctgagtgcattgatttgacttgaacttagccaaagttgcttaagttgggggcgactggggcatatgatgctttgtagggagtggcaggattctacagtacagcgcttctctgctcagcccacttctcattttccattcgtttattcttgttctttctcttacctttcccttcccttcttgcagatgcccgtcttagacactatggtcggttcacccttgactaagtctaccgtgacgttcatggagacagccctgggggtgtcatgatgctgaatgggtttatgatccattttgaggaccctgtggctgctgggaatctttttctaacacagtagaaaccaactcctcactgtcccccccttggctgggctgccttcagttcactttatacattatgacgattttaaaatttaaaggcaggcctttggtatgtgtgtgtagccccaggtggtcttgaatttacagccttcaggcttctaatgctgagattacagacttgtggccaggccgagcccgtggtcgtcactctgatgcccgaggcggaatctctcttccaggttctaaggcctggcttgctttctccgttctgcccctggcacacggctgcttcctttattctgtgcccagtgcagacagacgggagagctttgtggattcagggcttgatgggctgaagcccgagcacaacaggcgttaagaagtgatgagcagctctgtagcagtcggctttgctgtatcgtgtagcaggattcccagtcagtccatttactggtgaaaaaaaaaaaattccggctggcttcttgctgttctgcttgctacaggatgagttttcttttgctttatttgttaggaaagaatgtggtttctgagccaaggccttggattcctggttcctagtgaacagtttcagagtattctgagatttttttttcatctatggaaaagacagtcttgagaaaatgctcagcagagtgtctgtctgggagagagatgacttcagcaaatgtttgtaaaaaaccctattttagtttaacttgtggactgagaagccttgtggttagattttaaaaattccagccttagacaatttcatcttttatcacttttgggggtttgtggccccaactccagctgtattcataggatgctttttacacaggcccacctgtaaatctgttgtaagttgaaatgcactgaatacatgtaactggttgaatatggacttagtggtccagcacactgcaggatgtctaatgttgttcatcacccctgtctcggagtagaccaagagatatggctgctgccagtgcccaacattgagagagacctacggtttttatctccattctgagaaaagatttttaaaaattcaaaatttcaactggttgtcaagttgaaaagaataccatgtggtctccgagtagaagatctttatacacaatgaggcactcatagacctagggaggctcacagaactagagagaagcctatttgttcactcagccttggaattggactcgtaactcttgttagaaactgttctatttctacccagtgtccagttcagagagaagcgtcagaattttgaaagtcgccattccttatggagtgctcaaaaagctcaaaaccatcagtaatgttcagtgtttaaaatgtggccagtcaattgagaagttggggcctcatgaaaccaaagcttctgtaaggcaaaggacattgtcaataggacaaatagcctacagaatgggaaaagacatttaaccctacgcctgacagagggctaatatctaacatatgtaaagaactcaagaaattcgacactaacaaaccaaataacacaattaaaaatcgggtacagagctaaacagaattttcaacagagcaatcttgaatggctgagaagcacttaaagcaatgttctacgtccttagtcgtcagggaaatgcaaatcaaaatgatcctgagattccatcttctacccatcagagtggctaaaatcaaaacctcaagtgcgagcacgtggtggtgaggtggtgcagcaagggggaaggaacacttatttattgctgatggaagtgcaaacttgtactaccagtttggaaatcaatttggtggtttctcagaaaattgggaatagtttgaccttgagatccagttagaccactcctgggcatatacccaaaagatgtcctaccataccacagggacacttattgctcaactactgaattggctggttttgtgtgtcaacttgacacaggctggagttatcacagagacaggagcttcaattgggaagtgcttccatgagacccaactgtggggcattttctcaattagtcagcaaggtgggagggccttagctcattgtgggtggtgccatccctgggctggtagccctgggttctataagtgaacaagctgagctgggtggtggtggcggcggcacacgcctttaatcccagcacttgggaggcagaggcagaggcaggtggatttctgagttcgaggccagcctggtctacaaagtgagttccagggctatacagagaaaccctgtcttgaacctcccccctcccccccccccaaaaaagaacaagctgaccaagctggggaagcaagccagtaagcagcatccctccatggcttctgcttcctgacatgcttgagttccagtcctgacttcctttggtcatgaacagcaatgtggaagtgtaactgaataaaccctttcctccccaacttgcttcttggtcatgatagtttgtgcaggaatagaaaccctgactaagacaactatgttcacagcagctttatttgtaatagccagaaactggaaaccatctagctgtccctcagcttgcagaatggataaagaaaatgttgttcatttacacaatggaatactaatcgtcaattaaagacaaagatacatgaaatctgaagccaaatgggtggaactagaaaagatcaacctgaccaaggacacccatgtgtggtatgtgctcacttatacatggacattagccataaagtgtaggataactatgctacaatctacacacgcaaagaaaccacatgacaaggagggtggaagggaagaggcttgagtcttagaagaggaaataaaatagacgtcaggggtagatagaggggaaactgggtgggaggaatggggtggtgagaggaatgggggtggggatcagggtatgggggaatggactgggacaagtcaaagacctgagtccatggcggtgaccctagctgagactcttagcagcaggggatatggagcctatagtggccacctcctatagccaggtgggactcccactgaagggagggggtacaccaatccacccacaaaacctttgatccaaattttttcttccctacaagatacacaggaataaagatagagtagagactgaggggatggccagccagtgagtgactggcccatcttgagactgagagagccaacccctgacactattaatgatattctactatgtttgtagacagaagcctagtgtaacactcctctgagaggcttcatccagcagctgatggaaacagatgcagagacccacagtcaaattttagaagtggggcagggtcttgtggaagagtgccaggcaaaggagggaacggtttaagagaactgtaggggtcaaggacaccataagacctacagagtcaactatgtgggctcagagagtctgaacagccagccaaagggcatacttgggttggacctaagccccctacacttatgtagtagatggtgcagcttggtctgcatgtggctttcctaacaatttgacgcgagggaggcactgtctgtgactctgttgcctgcctttggatctctttcccctcactgggctgacttgttgggcctcagtgggagagcatgcagttagtcctgctgtaacttgatgtgccaggatgggtttggtacccatgggacaggggcgctccccttctctgaggagaaaaggaaggagttttggaagtgggtgtgtgagggtggagaggggaagggcttgggattgggatgtgaagtgagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaactatcgaacttcattttccaaggtatcttaagccttcttctgggctccttgggtaccaggcacacaaagacatgtatgcaagcaaagcactcataccataaacaataaaataattaaaaaaaataatagaaaacctccacccatgagcaaaaagaatgtaaagaaggctttatttttggcttagggttccaaaaggttagaggccataatggagacaacatggcagcaagaagcaattatgctggccagagcaggaagctgggagcttacattttcacgtatgatcaggaagccaagagcaaattggaggtggtgctagggcttttaatctccaagcctgcccccgatgatgtatttcctccagcaaggctgcaccaaccaggcctccccaaacaactgaggtccaagtgttcaaatgcctgtgacactgggggacatttcttatgcaaattactacaccatccccagacactaagcctcagaagaagccaaacttgttaggtatgatctacctgtgtgtgctgcggccgctgggccctttggacataattggtactgagcttgaaccttggataacccctgtctagacttgaaaaacaaaggcctttggggaaattttaaaaagttttctttattcttccacaaattcatacataggtaaattactgtaaccacattcactccctgatcccttttatccctcttctccctccaagcttcctttgctctcttgacaggctgtcgtctccctgtttttaaactgtatgtgtatgtggtatatacatgtgtgggtatgtatgtgtgtatgtggtctatacctgtgtgtgtgtatgggatcttcaacagtagagtattatcaagttttggaggacaaccaagatcaatattagtcatgactttggggcctttgtgaacactttccagggctggaccccgcagccggcacagttttggttaatgactgatggcttctggagcaatgctgtctgtgtatgccacataccagctttttaaaatagttattagtattattttttttaaatagtaggctgtgtattgcttttcagacatccttagttctggttaactccccttgccgggcccttcctcaccatctgcccattgccatctcccttaaacctttccacttccaacattcccacccactgctttcggattgcagtgggctagcctgttcaccacccccgagggcttctttcctcccttccactctaaaaggcccctttctaccttcttgttaagcactccgagttaaacacacaaatctaaagattccaagctgtgatttgcatcatctgttgtcttcctgggtctgggttacagtcgcttaggttatttccagctccctccttccccctgaactctttagtaaaattccatagagtatgtgtaccacattttcgtatccattagttgagggacatctcggctgattctgtttcctagctcttgtggacagagcagcaatgaacgtggctcagaaggtatctagtatgtggggtctttgggatgtattctcagtagtagtatagctgggtcatgtggtagctttttgagaacctcccacactgatttccataatggcttcactaattgatgctcctaccagcagtgagagttcctctttccccacattcttgcctgaatcatgatgatgatgatcttgttgttgtcctcctcctcctcctcctccttctctctctctctctctctctctctctcaatattcattctgatgggaatgagcatggattctcaaaatagttttaattgacattttcctgttggctaagggtgttgaacactttagaatatgtttattagctgcctgcatttcttctttggtgaattctctaattctttggtcattttttttttttaaattgaggtgttttatttttaatgtttatcttttttttttgagtcctttcccaccatcttctccaaagatttatttttaggactcttccctacttcttttttctggacccagaaagacagaagccattttgctagtcctcttaactcactgtgctgcttctctgtttcatggctgctcccttgagggcctggcctgcacttcccacaccccacatgaagctctccactcttcagagggcaaccttggagaccgcctgaggaagagggcagattcggggagggtgttttcccctcctttcttcccggcatgaagttcctattcctagagtcgggaggaagtgggcgtggctgaaatgttacttattatattatattcatcttagatcgaaggaaagcagctgaagggcttttacagtgggaaagctttcagagcgagcccagcactgcacacttggttccttcagtctgctaggcagtcatggccagactctgacctgtgcctggacactgttccttccctatctctggagtttctactttcagggtttcattttcgtctcagagggtggcatgtcacggattcccgatagatggaaatacatagatgataccaaaggctgaaatgtctcaacaagactaagaatctttcatgttgcctggatcaatttttttttttgtacatttacatgcaatctcatcatgccataaaataaaattttgtatgtttgactttatatttcggtcacagtcaacagaaaaatggtggagttgatgttgataaatattctcagacagtacctgtatttgcaatatgtgctttgcttgcaagggctgaacccattagaaatactgcatacagttaggtgtgcagaactgtgcccttaaattcttttgatctacacttttaaatcatccaaggagactctagttatgataattgaaactgcatctgtctgtctgcctgtctgtttctctctctgtctgtctttctctttgtctctctatctttctatgtatgtatgtatgtgcatgcacatgtaggcctgcacacatgtgagctcaggcctacagcattagcagttatcccaagagtggtctgatctatttattttaaaactaacagcaccgactccacctgtcacattttatggtggaatctgagaagaatgaggacagttttatcaggattgtgaagttttccaggggcagagcttgtgtatgttaatttactttctaaaaacaactccatgcagcgttcccatcctggagaccagctgtctgttttcactcagacccagctcctcctgccatgtaacttcgcgctgagcagaggctcatttctgaagtggcccagggctcacctgctccctccattccttctcatcttttgctcttttttttttttcccacgaggttttagccagaggtgtaagtgtcacactggatgaccgcaaaccatttgaccattgatcggcactttttaggggttccctagcaatagcagctaggatataatgtgaatggacacatgctctgagtcaccagctgcccttttgaaactaaagttctgtggtcagttcaatgcgttcatttattaattttcttaattcttgcattttagaagacatggcgaggtaatttccccttaagtccaatattgtatgtggtgctggagtgaacatcttcattcgcagtaacacatggtagcatccctaccagtcatgaagtgatgggttggagataacatggactctgctttcctcccagtcatggatctctaggttttctttcctttgctcatcttatcctctttcctcttgcttctctccttccttgacccttcttccttttggccttagcatctcttgccactaggaggttggccaaccacatcacgtgtcaagctcttgcggctgtaactatcttacttctcatatgagttccaggtatttgagtagcaccggtgtccgattctgtccaaggaggggcagatttcacgggaggacctggaaatctgacgcatcttggtgtttatctgtgtatctgggttttatacaggagaccccgaggaggggaggtattttaatacgctggctggcgcaggcagctttatgccctactgttgctcgagtattgctgggcggccaaagcgtcccattctgctctgagtttggttttccctggagtgctgccttcagtcactgcgggtttcccaccttgacttctcccctcttccctgcctttggcttcaggctttacgtatatttaaagctaacgtaacacaacagagcagagccttaagagacttagaagctacgtgctgctctatcgtaaatctgtgtaaatccttaacacaggcagcggcttggatggatttccatgagaacttcttcagctacaaggtagtaaaacaaatgcctgaaaataactgaactctggacaattgtttggcagtgtctaccttttagaaactttccagaccttggggaaggaagtgagtctgagagtaagtagtgattttaaggataaacgtaataaatgagcattgacgttatttgccaacaattttttttttaattccggcatcttatcccacatcccaaataattcagactgtgagagttttactgtactttttttttttttatttaattgaaattggttttgcagaagtggaaaattggcaggaagtatggaaactaaactagcaaaccggtttatagtgctctgtgcttcttagcttaatgaaacccgcaagaatgaggaaaggcttcatggaaaggccgggataagaggctgcccggtaggcattcccttttctggaagtttatttttacactttttgattctatagcatgtggaacagcatgaccaggctctagtcgactaacagtggcctctgagatgggcagggctttaaccctgttatttttccatagtcccgtgtagaaaatactgggaaatgtttataaacaagaggaacttgggaattaaaaagaaagaaaaagaaaacaaacaaacaaacaaaaaaaccccaaacaaacctctgtgacccaacagaaatgagcattggcttgtgaaaccatgcttgctagtctcagcagtcagaggttgtgttctggaattctttaacgaggcagtagatgcatgcgtctatttttgattacagtgattggtggatatggggctatttggaaactgatgttgactaaattatggtagatgatcatttcccccacatggtaaaggcagtgtgaacgatgaatgacatcatcagtatgttcctaggtggaagcccaaactagaccactggaaagaatgcacctacacctttagtccaacacaactgactgtgtaagagtgtcttccacatatatgctcctttctgatcctctgaatgtttaaggtttttgtacctggtcatttccagggctgatgtcttcaccgaagtcccactctgcaccctactcttcccatatgacccttcccatcaaggagcctccacatagcaggccgatggataccacttccaagcttctatcaaaacaggctcttgctgctctgaacttgaatgcacattcctagggaagctgagtctggtggtcccacctacaatctaccctgttctctagtgtgctttgttaggggactcatctgtacctcacatttcctgagacacagagccttgcgattcactgtagagtccaactagctctcactggtgtgcgaagctgagcttatgctaagcctactggaatgaccatttacaagctattaaaactgtgaaagccaggaaagtgttaagctatttcagaagattgcgtttcaaatgtatttgaaaaaaaaatccatatgcaggtagtatagatgagtgagttctgttttctgagtagtcatggatcatgcaggatgagcctagaaataagtcaagttttccaggtaggctacagcttatccttctctgaaggtcaaatattgactaggaagtcatttcaatagattacaactagcactgcagtaggcacctgtaaatcacagatggaatatcttttaggctgtaagcttaaatatgtttccctaaacttaaaaaactctatgcttgtatgtttgtatatgtatttagtgtcataaccttatatgaatgggtggggtatacatatgagttttgcagacatcactaatggatcaatggttcattctagtgaagtctgatattttaggacaggtctgctatcttaccaagagatcaagatttgggccttttaagtgttaggagctgggtatttgaggcttctcctgaggtttctcttcctaggaatgccagctatggagatatggttatgctgggggtggaacctgacctggtgggagagtcccaagtgagcctgagcggggaatgtgcagacagttggtggatgctgaagaagtgagcaggactggagaaggttctagaatgaatcttccgtattcagccagctcctttggatccatacatgtgctacctcacagaacacttaagtacacgattgcttaaggcagaacccaaaggcaccgtggtctcgtccgtccttctccctgtgagggacctgtaaagcagacatgctatctattcatcagctcttgagtcttaggttgtaatctgctcaagagcattctcgattggatgtgaaggtcacttaaatgatgccatccctttttagttattattttaaggttatctttttaaggctttattgttttggttattatttatgattaataaaacaaaagaacaagaacaccccacttcctcctgtgtgtattgttctgttaaagttcccctaacacctggctcagcagtgcctctgtgtgtctctgcttgcaagctggtgtgcagctgtatgctgttgggaaaggacttggaagtaccatgttggctgtaattcttcccagcgctatggtatcacctgagggtggctttgttctgttttcctcttaaatggcttcagggatggggcttctgaacttcgctggataaagtgccaaagccacacaggcacaggaagacaggaaaccaagcatagagtagatggcctgcgttttccttgatgaaagactgtagttggccaaagagagcaagagagtcagagaggcttgcagcatgaggtctctgtcccgattctgtgttcctcacatactttgaaggacactctggtcccctgaagccaatgaagcctgaggtgccctagccaccataggtccagctacaagatggttgtccaagctacagttccagatggttgtcagatattttgaagacactgggcacttgtgggcaagaggaaagaccctaagtctagtgctctgagctccaggagagacaacctgtgagagtgtctgccattttctatttcttatctcagggcaaaatgggacactttagctttgaggaggcccttcatttctatttggggataaaaactcaactaggtcagacaagtgatatatctggcctctggcttgtttgccctcatcaggttagtgtctgttagttgcccagtgcagccttattgtatattaatgtatatctatacataatgttaatgtatatagtaatagaatacgttatcagagagtatgaaatggttgcctttgctttattaagaacaggtgttcaagctgtaatcacagtaaggatggtcagctaggggtgtgtgcagtcacactacagctttcatgcccttgtgcgctaggctggggtccctgagcagggaggcagttactgtatttcctactgttgtatgacttggaactcttcagctgccagcttcttcctgaggcaaagcttagtgtaagtgcgccctagaaaagttgagcctgtaatgaatatttctcaacattagttcactctgaaacaatgcagccctgtgagagaaagccggcaagcattttttttttttcctagaccagttcaagaagatgcttcagtcaaaaatatctagcacgtgtggattcagtgaaccaagttggtgtatacatgcatttgtgtctgacacaaaattcacatgtagtgctgtatctgagatagggtgttacagaattaatttttaatatttctggaaaaaatggcatcaaataaaaaatggattggggaaggacacctcttctttttccttattcttcctgtaactctaacgattctggaaattgcttttttcctccccaccctcaccccaagttctaattttcatgaaatagctctcttgtctgaaggcttcattgtatcataaaaggcttcataagacagttgtcaggtataacaaacctcatttcagagcaagaaagaagtctcctgctggattcttctcaatctttctctaaaacaagtttgttgttgttgttgtttgtttttaaaaatattttattcttctttaatgatggagtgagaatgttgagaaaattaagaagaaatttcaggttggcttggtggataagggcacttgccacttagtcccataactggagttcaatccctggagcacactttatggaaggagagaaccaacgcctacaagttactctctaactgccacataagctctggcaagctcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatggtgcatttcagaagcagagcatttagctagtatgtgtgaagccctgggttctgtcccaggcactacctagaaataaacagatgaaggggagtggggcttacttctctttgttgcttttgtattctttccttcacatgtcttcctcttgtggcaagaaaaagtcctacctgttaattttcaggagtaccaacccaccctgccggtttcttggttctcacaggaggagctcctgcctgcaatgtcaggagcatgtctttcacaagatggtttggggttagtgagattatcagccccataggaccctattttattttgttggaaagacacgtgtggaatcctcaaaatactatgagcagcagggactgtgcatgaggaacccagccagcacttccgggtgcagcacttccgggtgcagcacttccgggtgcagcacttccgggtgcagcacttccgggtgcagcacttccgggtgcagcacttctgtgactgactgtacttagtctcctggttatttctcttgagcaaactgttcttctgaaaccgaagtttccttttgtaaagacgaaatattcacgcatagtcgttttgcttgggagtgtcctgggttttgtgttgagagtgctctgtgggcttatgaaaaaaggcatgtgttcgctagaaggaagggaacagtaaaacctggggaggtgttatgtctgtgttctgacttgggatggatcatcttttgtgtaagcccggcactgattccatgccagctcgccacctggttcctgcgtaagagggtcctaatcctgggccgttgctatttttatagctagagatgggcccaagagggttgaaattctgcagggatgaagaagttgagtttgttgaaattctcagccttgtgttatggaactgatgtttttagtttttcttggcttgggtatgagaatcctgctgtgtgaggggataacgttcctgtttactgagtgatttatgaaagactgggaatatgtagtaagttcccgagtatagagttttggagactgtgatacttttctgtaatgaatgaagtttgtattttcactcttttgaagaaagttgactctattaaaatcaagcctttcaaaatctacaacagatagaactttagtcatggttctttttctttacagtaaagtataaccttttatttgaggggaatgagcactgaaaatattaatgcattcaacttaaatatttgttattatttttgtgtgggtgcaggtgtgtgcatgccacggtttgtatgtggcggtcacagcacagtatttgggagttgattctcccgttcttccattacagaaggaaatgtcttacattgtaggtttcagatatttaattccggttgtcaggcttgtgtggtaaacaactttaccctctgagccatcttgctggccctgcattcaacgtttttgttttttaattaaaatttatttatgtggtgtgtgtgtgtgtgtgtggttaggtgtgtaccacagagtgagtatgtgtagatacttgtgggaattggttctccccttacactgttgggttctggggactgaacttaggtcgtgcagtctggcaggaagtaccccgactcactgatcatctcaacaacccagaacacagcttttaaaccaaattgaaacaaaaatcttaattaaaagttttaaaaacgatctatttttttaaaaatatgaatggatttttaaaatagctattcaagagtttgtatcagaatcttgttgtagaattataaccagatcattgaccctcagtgaaccttgtcattttgaatgggagggaattaaagactgatactaatagataattgaaagtgaatcatgaagtcttactttagactttttcttaagcaatttttatttttaactttgcttttagataataaaattccagagatgatatctggcaaaaatgtggactcctgggatagcattttatttatttatttatggttattttattcatttacatttcaaatgttgtttcccttcctgggctcccctctgcaaactctcatcccatcccccatcccctttgcctctaagaggatgtaccacctcacatctgcccactcctgcctcacccctctagcatccccctttgctggggcatcaagcctccagaggaccaagggcctcccctcccattgatgagagataaggtcatcctctgctacatatgtagctgaagccatgggcccatccagggttatagttctttttaaaaagtgatatattctttgataatttcatatgtatatacaaaatagtctggtcacagaaataccctctcttatcttcctccgggatccactgcacccgatttctaccattgagtttccatgccacattcatgtcttttattttgtttttactttgtgacccactgggtgtaactagggccacatgattgggaacagatgggaagctagtcactggagtgtgagttaactgaccagtggctacatcactgaagacagtgaattccctgtaacatcttgttcagagagtccttacttgcatctgtgtattgaagcacagtccctactttttcttctagcagtttcaaagtatcatctcttatgttgaggtctttgagttggtgggagttgagttttgtgcagggtgaaaggtgagaaccgggattcattctcctttatgttgatagcctgtatcctgggaccactttttgatgatgctgtcttttctcttgtgggtattttagtatttctgagccctctgtctatcccattgatctgtgtatctgtttttgtgccagactcctgctgtgtttattactgtggccctgtagtgtaagttgaaatcgggtatggtcatacctcttacaaaattctcttttcttaggatggctttggctagctttagtcttttgtgtgtctatgtgaatttcaagatttttttctttttcttttttttttttaaagatttatttatttattttatgtatatgagtacactgtagctgtcttcagacacaccagaagagggcatcggatttctttatagatggttgtgagtcaccatgtggttgctggaatttgaactcaggacctctggaagagcagtcagtgctcttaaccactgagccatctcaccagcccaagatttttttttctttatctgtaaagagtggcccagaacttagattgagatgcatagaatttgtagattgcttttggtaggctaaccatgttcacactattaattcttctgatccatgaacatgggtgatctttctgtcttccattgtcttcctcagtttctttttgcagtgtcttattaaagttttcattgcaggggtggcttggttccttgagtaggtttattttcaggtcttttattcctttggcagctaaaggaatccatgggaaaggatgtttcccggagctctttttcagtatgtttatctttggtgtatagaaaggtcactgatttttcatgtgttaattttgtatcccgctattttgctcaatgtgtttatcagctggaggagtttcctggtggagtccttctgcatgtctagaatcctattggctgcaagttgggctactccttttcctatctgtatcccctttatttcctttctttgtcttactgttttagctaagacttcaagcattggagtaaaagtaggagagtgggcacaccagtgttagcgggatgctttgagcgccccccccccccatttagggcagcattgttttatagattggctctgtatagcttcgtgttaaatgtgatcctcccacccctgactctccattactttcatcatgaagatgttggattttgtcaaaggattgggtaatcatgagatctctaactttgagtccagttatgtgatgaatcacatttattgatttatggcacgtagaaccatcactgcatttctgaaatgaatccaagtttgaacataatgatgatgatgtttttgatgtgatcttgaattctgttaaaaatatcttattgtgaattttgaatctatgttttgtcaggaggttgagctattcttttatttatttatttatttatttatttatttatttatttatttgtagcatctttatctagttttggtgtcagagtaacaccgggctttgttaaaagaggtggaagctttgtttcctgttctattttatagaaacatttaagaattatcaattttattctttgaaggtctgagcgaattctgtagtgcattcccctggccctatacaatttttagttgaaggaattttgatttgctgcgtcaatctcattgctggttataggactgtttaaattgtttattttatgtttgggttaattttggtaggtcaacgtgttcctacaaactcatccatttctttcagattttccagtttagtgggacatagatttttttatagggttatctctgtgatttttatgaattctattggtatcataatgtctgccatgctgtgccatgccatctcttttttttttttgttgttgttgttgttggtaaatttggctaagggtttaccagtctttatcttttcaaagaaccaactgtttaattttttgagtatttttaatttctatttaattaatttctgccatgatcttaatgacttcttcccatcagttgattttggcgtaggtttgttcttgtatcattaagtcggttatttggatttctttctggttttcagatgtagacactcagtgctatgagctgtactctgaggattgcctttgctgtctccttttcatctgattctaggaatctttactccctcctggatttcttctgtgatttatcattcattagcgtgtggtttaatctctacaagtttgtgtcatttctgcagtctttcttggctgctgatatttagctttatctcattgtggtctgaatgcacacaggatgttatttcagtttttctatgctgttgcgtcttgccttgtgtcccaagtatgtgatctgttttggagaaagatccatgtgctgctgagaaaatgtgatttttttattttttatttttttagtgttttagcagaatgttctatagatatgtattaggtacattcaatttatgatattatttagctgtactccccaccactaccacgtataagtttcctgcctgctggtgaaatggttatgttgaagtcaccccttgtttctgtgctgaggttagcttttgactgtacatctggtagtagttactttgtaaaatggagaattcctgaattttggggtctacgtgtttagaattttaatatcttctcgatagatcccttggtaagcatgaaatgaccttctttatcttttctgactaattttgatttaaagtctgttttgtcagatagctgaaaatagctgcatgctattgtcaatagcaacacgtgctcatttccttgttctgttggcttggattctaaatttttacccttaggttatgtctgactttgagggtaagcagcctttcttggaggcagcaaaaagatgagtcccattttcaatccattctgttagtctaggtctttttgttggggggaattggggccattaatagggttattatcgaaagacgtgctctgattcttgtcattttgtcgcttttgtggtgttttcttaaactcctcttggccaactgtcctggtcttctcttctgtggccttttgggaatgtttagtctcttcagtccagaatctttgcagtgtctctgtggattagtggtcacagattccttcagtgtattttggttgtggaaagttgttatttctccttcagtcatgatagacagtcaagtgtgacagtctggggaggtgggtgctcttctagctctgcgtcatcagctgtaggttggactcctccgcctttctgtgtaactttgcccctctctcctgtggctttcagtaacctttgtttagtctcggttttggtggcttaattatactatggcttggggagtttctttttctgatctttttaaaaattgatattctgtatgtttattgttcccagatggacgtctttttctttagatcgggaaatttttttctttggctttattgaaagcagtttctatacttttggaatggaagcctcctccttgtatgtccataatccatagattgatggtctcatggtgtccccaaaccctctcatattctgttcatgtatacatgtaaagattcaccattgaccttgaactaatgacctaattctctcacattgccttcaaaccctgatgcgatgttcaccatgtgatcagttagtcctgttggcaaggctgtccactgagcggtgtttggctgatggaggtccatgtttccatcgtcatttcctttggctttgatttagcagttctctccctttactgagttctactttcatattttgaattgatgtctttatttcattcggctgttcgtttttgtgttcttggagtacattcatgcctcctttgagtttctgaacctatctgtaatccttcctttgaattctttgtctgacagttctaagtcactctcattggggaccatcactgtggagtcagtaattcttgaaggagatgctgcctttcttctgtgtgttgtttttgtttctgcactgagacttgtgcatctgaagtcagtttatctggattttctctcctttctccttttctacctcacttcctttctttccccccttttcttttcaagttaaccgtgtttgcatggaggcagttgcaatgttcggagaggactcagaccctgaatcagatccagctgcctattctcccagctgccgatgtgtgtggcaggtctccacatacccgagcaagctaccccagggtcaagtctggtccacttctcacccgtgatttttggtgtgggttcttctgtaccctactctagttcatcgctggtctgctccctgttcccactgcccttgctgtgctttgtgagccctgtgcaccccattggccccttcactccgtctggcaccttttgtcactttgtttatatacatgcaccctaccctgcattgagtccagccttccctgaacgtcccctacttctttctacgctttaactttgccactttcagagaggcattcctaagcactgactcgggttcacaggcaaaagcttcaaggctaaatatctttcagtctcttttgaaattaagtttgaatctttgagccctgctctgaaggattcaatggattcaggtactatgaccttattgcgttatgtagaagttgactaatcctaattgttggagtgagaagctagcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatacatgttacatacatgttacatacatgctatggcatgcttgtgcctgcactcagaacacatatatacaacaacagcaacaacaacaataaaaacaaaaacaatagcaacggcactgctacagacaaactcacccacattctatggcctgtgtgcctcccaggaggtctgtagtaaccaaagacagagcagatgggagtctggcatggctgccctcagagaggccctaccagcagctgactgagacagatgtagatacttagacccaaccattggattgaagtcagggacccctgtggttgaattaggagaaggattgaagaagctgaaagggagagtgaccccataggaagaccagcagtctcaactaacccagatcctagggagctcccagagactgagccaccaaccaggatcatacatgggctggtctgacaccccgggcacatatgtagcagaggtctgcctggtctggcttcaatgggagaagataaacttaatccccaagagacttgaggccccagggaaaggggaggtctggtgtgtgtgggagcactctcttggaggcatggggaaggaggaatgggagcaccctctcagaggcaagggggaggaggaatgggagcactctctcagaggcaagggggaggaggaatgagatgaggaactggagggggactactgggggcaagaactggaatgtaaataaaataatttaagaaaaatgatccagcaagaaactgtccattatttgtgacttctcattgaagacaaacttcctgtcattggaggagcaagtgtgtctttcgatgtaaagatgagaacttactgtcctcaatggcgcctaaaaaagtcccaatttaggcatatccttcactccagatttttggctatgaatctcccccccccccatgtaatacttaatgtttgtgtttgcattttcattttatttattttgatatttgtgctttttattgtgacagctcttaaatattttgttttgttttggaactgagagaaatcaagagtcaactcatggaatttctctgtatttcttccagcacgtctgactctacatttgtagtacaagaccctgttctcctgttggactgttttaaagaacggacctcaggcttcacctagttcagaggtgagctgagttctttctgatgtttgtgaaatagagtttgatggtgccggtccatccgaggtggttggctgcccttaagtcacctttgttttccatctgtgtgtctaagtgactgaaacttggggtacatggaggtaaaatgtagatggtaactacatgtcttggtgactcagacattctttagtgtaaagcaagattcaaggctagccctggaggagttggacgttgctacagaatgcaaggtctgtccctaagctccagtttgtctgctgtttgctcttcacccaaggatgtcctttgcctctgttatgttgactctcaagtgattttattgattctgatcctgcctagttggctgtctacatttgatgtttcctggcatcaaacgaagacatttgataattttcaaaaagattaggagttctatagtgttctacagtgtttcagaatattccttccctcctgccttcctttcttccccctctccctctcttttttcctttttaaaaatttgctacaaggtaggctcattacttacaacaagttccacactcgctctctaaggtccaggacagaccctgggctcttttattccatcctccttctcaatggcttgcttgcatggctggtctagaacaatatctggcgtgctaacccaactcaatacaacttgtgtcaaatgtcattagctgatgagaacctccctgggctcttaaaaaaaatgtacggttgggcttcagtgaggctcctgattgatttgcagcacgaggaagaattgtgtgtacttcttcactcatttacacagatccctaatttaaatgggcttttctcagccttccatagtgctaaacatcacgtattgttcagcagactgcattctacttcagtgtgggtccagttcacttctctctgggtgagttgagttgagtttatgcatagttccttcctcagtggattgacttgcagggtatgatggcaagtgttcatttggagtgcccagagcttctcgtggatgtttgtgctgctgacgtatatttgtgcgatccctctctctctctctctctctctctctctctctctctcttttttggtttttcaagacagggtttctctgtatagccctggctgtcctggaactcactctgtagaccaggctggccttgaactcagaaatccacctccctctgcctcctgagtgctgggattaaaggcgtgcaccaccatgcccggctgcaatctctctactaactggatggaacaacacggcgctggagagtctcttgttttttgctgacttaatgaatgcgggtgatttttttcctatggtaatttggcacacttactaccagcttaaagtaggaggaagtcttcacccaaggcctgtgcaagtgtgagtgtagtttaacatttgtctttgcttcacatgcattctccttaagttcacccacccaagcctaaaattgtctccatgtcgttttctaaggaagtgaacataccactgagttataccccaaagggctgtgaaatttgatttacaaaattttggtaaaagtagcaataattcttgaaaattacataagttatctgattcctctccttatatgggattacctcattctgtcaactattttaagcaactttaaaattggtaatggaaaactttctcttgactacagtaccgtatgtggcttttaggttaaatacaaaactgtgttcctccccgccaacgggagccgttgaagaactgcccgcgctcgcttgcacaagtgcatgttgctccagcattccccgggcactctcaagcacagacttttgattctgaggtgctgtcaggactttcacactttaaaataggctcttacagctggctgtcctggaatttatacttgctctgtgacttgtaaagctcacagctggactgcgagacattcctaagtggtgagaacgctggacaggtgtcgcttgctctctctgctctgtttctctgggagggtcctgcctgcagtggatttatttggacttggctttgaaggtgggtttgattgactctctgtgcttcggttgttgttaaatactttaaagattcagtcttcctgaagattccggaggtatgcgcacctcggtcatagtgcgcttgcacagacgtttccttgagttccagccctgccaggtccattcattctgtaccctgggcaagttgtcaccgggagtctcagtttgtcttatcttatgggcgatttatcttgtagaattatctttggaatggctagttcatcattgatacatattaaagggtcagtaaaatgtcagttgtcattttctattgtgatattagccagctgtcagggtatggatcatacacatgtgggaactagtggcgtacagacagaagtgctgtctgccttcccccaggactgagcaggtttcctaaaacactgcacgaggcatcttgctagagccaggtgttaggaaatgggcaaagcacagagctgctgagatgtaggtggggacatcattaattaaatcataagttcaggctccttgctcaatggtgaggacagggagccgctttgagaaacactcagcaattaaccaacaactccgttcaacactgcacttctctgacctgaacttcctgcgatcatgcgatcatgtttaaagaaaaaaaaaaaatcaagatcaaagaccagcagccgtactgggaaaaagatttgtgtttcgtcatctgtgcctgctaaagtgatgtgtatgtacaaaatgatctctgcggtgcagaaggatacggatgaaatggtgaaaatgggaccgaatgagagcaattggagctcggttgtaaggagagcctgaggtgcctccacttgaaggaatagacaattcctgtggaggctgcagggatttgctgtctgcatgggaagctgggcagtgatgggttatcctccaagttggttatttgggacgtgagagcaaaggtaccggaaggcctggggagatctcttcactcttctcccgggttctcagaggactcccactcccgaatcctttcagggctccattcaggatctccctttgtctggaaaccccaccctcttgcctgtccatccctgtagcagtctctgtgggactgtgaaccggagtcaggaggctgtagcatccctccccgtccctgctcccccattctctggctttcggttaagagtgtcactgggagaagcagaagtacaggtgtcaggaacactgggtgtgtcctcataaacactgggtgtgtcctcataaacactgggtgtgtcctcataaacactgggtgtgtcctcataaagctgggaaatgccaagaggaaggctagaaggaaggaacttcagtcacacgtcacgggccccttctgtccctggcctgagaccttgggatttctctgtctactttattctctctccatccatgattttgttccataatgtttgtgtttgtggaggccagagaacaacctcgagtgtcctttagccacagtctaccttttcttttgagacatggtcttctactggactggtacttgccacgtagaaggggctggctggccaaccagtcccagggatccacccgcttctgtctctttgacactgggattataaataagcatgtgccaccctggacacctttaaaacatcttaatttagaatttttacatggctctgggggttgaatttcggtcttcatgcttgcaaggcaggcactccctaatggaactgcctcttcagtcctctgcccttctattaccaagtgacatttttttattttccttcatcaagtagacaactgcaactgtaacagaaaaatgcctttagcaaatttcttctacagtcaagtgcttcgtcagatgatcacagtattgtcaaacttcgaaaaaagctagcaaattttccacctaagatttttttgtgggggaggtttgggtgtgggtgtggggaaagagtataaaataagactttcagagattctcggttgcttggtgtcatttgtatttttccacggtgcgggagggttagaaagagagctgctttttatgggatgctcagcagcagtttggaaacttggtttcgtgggtttggtctgtctatgtgggtgaagtcgtttctgcagcagggtgtctttgggcacagtgcacacatgcacgctccagtactttcttctctgccttcctgccccctcctgcctccccacttggtatcacccagatgagcagcactggagtgtaaaatgtgctttgccagggtcaggttcttagcacttgcttgtggcaactgatgccagttgtaacagactgtgtctcagcagtcccagcaaagtcacacttggtgcatctgtgagggcatttgctgggcgtgcgtgcccttcaaggaagatgacctcctaaagtcctgttgttgttggtgtacacgggccaccctttcaaaaagtgtcaccccagaggctgtataattattacagattcttccagatggaagtagtttgctaagttctctctggattcaatacagaaagggcaggaagattgagcaaaacctaaaaatagtttgtttgttttttttaaatctatgtatatgtgctgtgtgttgatgttagcatgggaatacccgtgccacagttttgcatgtgtgagtcggagaacagccttgaatattgttcgtagtcttccactgtgatgcagagtctcttgtttgttgttgccaacactgagctagctggctctctgggatctgcctgtctccatatcttgtctctctgtgtgagtactggaattgcagacatgagctactctgcttggattcttaggagttttagggatctttgggtttgagtggttcatgctttatccagtgagccgtctcctaatcccaaagataacatttctgattcctagggaacctggaggcatccttgaactccatggtatcctatccagttctgggctttgaagggctttgaggggatgttgagcaaatttctcccagtggtctcccctgtggttagagagcactttcgggcgtgaggcatgactatcattaaataattttaacgatgtcagatgtgagatgtcttgagtgtgagctgaagacaatataggcacgattgcagaggacaggtagggagatggaagggattggattgtagctcgtgtgatgtaacaacacaaggagatggttacatgtgtcacctggtaaaacagacacacatgggcaacccaggatgaactcagcagcttgtgtttatttattctcagtaacaaagaaaaggaggtcatggatttgatagaggaggacatgcaaggggttggagggagggagaaatgacgtaaatatacataaaggaaataacaaatgagttcaatcaaaacaagaatgtcgactagtctcttctacgaaggctttctagttgagtgacgatttgttctgtgtggtctttatttgtgtcggaggctgtttgctgatgcgcagctgattagtacaaacaatgcccagaaggggctccttcttgtcactaggtgtctgaggtttgtctacaagcagacgtgtaaggaaccgttttccttccctctcctggggtctgaattgccaccattctctacattttacttgcatatctttcttggaccttgactgctgtggtgaagaagtcagggctgtgcagttgaagaaatgctgatagcattgatgaaatacaggaaaacctgttttaaaaacgtggtgtcaaaagagaccaggagatgaaatctaacatatctgttaaatagcttgagcttattaatttttttaaaaaataaaacctcacgtagacctacaagccatcaggtaaatgaccagccatcactgtcaccttccccaaagagaattgctccgtgaagactacagcatgggaactatattcgtttcacattctgaactgaagaatttgttacagttaaactttgttatttgtggtttctttaagacagtaaagcttacagcaagtagttgataaccctccagttaaatttaagtgaaatataacccagccaaaaaaaaaaaaaaaaaaaagcaaataaatgttcccacctcagtttcggtttagataccttccattagctgagccaaaaaatccgaataaagagttgttccacttctgtgtaatgggcaggccttgattgatatctgtttctggccatctgtgttggagctgttagcactaacagtgtatctgacttacaacaatgggtgtcttagttgatgatgggatgaaattcctgactttggctgtaatattactgaaatattagtaatcagaacaactgaaaaaaagaaagaaagaaaaagcccatgaaagaattagtataatatcataatcacaaacgaatctctccttgtctttgtcctagaactcattctattgagcaggttggcctagaacccctcacagagatccacctgcttctgcctcttgagtgctgggattaaagatgtgtgccaccactgcctggctatgaagctctctttaaataccactgctttcgggtgagttcagggtcataatagcagtcttgtcaacactggcagtaggccattccttgtatactttgagacacaaacaaacatgagggcttactgatgtaaatgttttacttagaagcatttaaaacacacctaaaaacagcaaagacatatgcagcgttggcagaagaactagagtcctgtggaagtacagcttctcctgagttgtagatgctttggctttggggcttttagattgggtcttacaaggaactgcagccctgccctgttttgcactgatgttgaaggttccaccacttggcgttttcccacatctctgtgagggtcccggtctccaccttatccagtaattgtttcaggtgtgcccagagtctgtttaatcagtatctgagtcctcaaaagagctccattctagggcccaatgcaatttacatctcaggtaccgaatcttatgatttcaccttattaccttatttattcatcttatttttattatacaaacgaggcagcgagagaatatgtgagacctactgtagcgttggtgctcgttggttactgtgtcgacttggcacgagtgagtgtcatctgggaagagggaacctcagttgagaagtgcctccatcagattagcttgtagttaagtctgtggagcattttcctgattgataattgatttggggacttcagcccactgggagccaccccaggaaggccgtcttgggttatctaaaaaggtaaattgacaagccagggggagcaaagacagtaagcagcattcctctctggcctttactttagctcctgcctccatgttccagctttgtgtacagccctgacttctttcagtgatgacctgaggcatggataaacatttccttccctaagttgattttggtcatagtgttctatcacagcaatagaaaccctaaccaagaacttgtgtgcaatggtttacagtgttaggagagattaaaggagataatgggacatttaactagttaaggatttgaaaatacgtaagtagaatttagttcggcatggttgatttggttgtttaatcaattaagtttaagcttttccaatagagttgcctatctttcaattatagtgggatgaaaggttttgactccatctttgggtgactggtagagaaagcctaaataaaatcaatattaagaattgccagctggggggtcctggaagctggttctgtagttaaagagcaaacaggagggggtggagtttggattccatgtaaatgccaggtgggtatggtggctcctctgtgacttcagcctaagaagacggaaataggagatctctacagcaactggccagctagactagctgtgttgacgaccttgaagttgagagcccctgtctcactgaataagacgaaagagcaatcaaggaaagattcctgacacccttgggcctcacaggcacatggatgcacatgtacccacctacacatacgtgcaaacatgcgtacccccacttgtgtacaccacacagatacatgaataaaaacgaactgctgtatggccgaatgaagtgctttacaaagtgggagagcttgttattgtttgaatctgaagtgcatcccacttgcttacctttgagcatgggtttcctgtctggtcctacgtttggaggctgcaggacatttcggcgctggagcctagctcagtaagtcactatggagtgtgtgtccttgagggttgtagctgcatccctggttcttcttgctcctttggctcccgatctaccatggtgtgaacagcctctgccgtgtgctcctggtagtctaccctcgtctcctctaccaagaccctctgaaaccatgaaccaagcccaatctttctcagttctttctgtcagaaacagtgatcacagcagtccaagtaactaatacggctgtgagtccttggtaaaatcatttaaaggccatctatccccatatccgggatttctgcccagctgcagatctacttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaaaagcaaacaaaaaactaaaaaaaggacagagcccttagttctggtttctaaagcccccaatgccccaatgcctagatatttgaacagagctgttgcagtgttagtccttctgataaagtcccttatagtctaatgtgtgggcagacatgggtgattcacacccctgggggaagacctgctgctgcctatctgtgtgtacctgggagacagctgttctctcccctttacaggtgccatagctgttcctctcattatcaccagagtaggtgactttgtttccttattcccagtgacccatgaccacatgtttcagatccttaaagacaggaaaaaaaaaacaaacaacccaacaacaacaaaaaaaaccaaaaaccctagtcatttctgtctgtcctcaatagaaaagtgttaacactttgcatgcctagaaaggttagcttatggttgaagagtttgaagccatctcctctagcttaacctttgtttgtgtaggatactcagcattcctccaagtatttccatatgttattccgggagagctaatcctgaaactctcagaatttctgcttgaccagaactgataatttctttcatctgttgataattttgggggtcccttatccttatactggaatatgtatagtctcattttcataaagatacaaattcagattgttttgagggagttttttattgtccaccagcagatgaattacctctttatttatttttttgtgatgataatacaccaagtgagctatcatagtaatgaatcaactagttggtacagtttaagaaattagagtattaaagggggggggtgacagggatgggagcagtgaatgggatgcaaagtgaataagtaaaaaaataaaattaagccggacgtggtggcacacgcctttaatcccagcactcgagaggcagaggcaggcggatttctgagttcgaggccagcctagtctataaagtgagttctccaggacagccagagctatacagagaaaccctgtctcgaaaaacaaacaaacaaacaaacaaaattaaattaaataaaaaagaaatttgaattcatcaaacgtggaaagggcttttgtccatcaactgctgtttatttatcatcaaatctttgcttctaggatagtaggactaagaaatgtacagagcgcagtctacataaggcccacccttaccagtactcatgagcagatctatagaccctattctgcatcttggctgcctgaggaaaagtcctgcccaagggccctgcacgctgctctgttatgacacatagggaattgaatttcctgagactgactaagtgtgaggaattttctgtttacaggcaataaaaagttacagggaactaaagccaagtgccaggaccggtaggggtttgggcctctgagtcacagcaaagtagccccttgagagaatgtctgtgcagttgtgtaccattccgctctgctcactctgccccatccaggctgtgttggcagacatcttcacattctccagctgaggcacaatctgtggtgttccataaaaccaagtgataaaaccagcaaccctcttgctaccaagatggccatctgaagatgagaccaagtgttggtgtttatatactaacctgtgcattcacttactaatttatccagtgaataattaccaagtacttctcaattgaaagcattaccaatgcaatggctgaggtacagagggatgtgatgttccacgcatgctggagagcatggtagcccagctatgaggagccagattgagttttgttaaatcttttacctcattatggactcattgctttatcctcctttatgaaggagttgtgcagacaggcctggaattaagaaaaacagtttgggctgaggagacggctcagaaagcagagaggcttgctctgcaaaaccttctgacctgagttcgatccctggaacccacttggtggaaggagggaaccgactcctgaaggtcatcctatggcttctccatgtgtggtgtgactcgcgtgcctcctcccctacacagttaatatatacatgttctaaagggtgaagaagaagagctggagagatggctcagagcacttactggggacccaggtctggcaccgttgcctgttgttacagtacaggggatccaatgctttctcccagcttccgagtccctcgtgttcatgatacaatactgcatactcatacacataaaccaaggatacatggaaaaggatgtacaaagaaaaaaggagaagcaacatgacattaataggctcgcagacataaaggtttatttcttagccatgttacatagcactgtagaacttccccttcctgtaactgtgggagccaagctaatagaaggtccatctctgcatacagctccagggtgtctgaaagcagggatgtgtactctggcaagtccataactcaagcctctgacccaatgctaaagacgtagcacgtgacattttaggactctgtccgccacatgcctgtcagtgacaggcactggttatccctcctcttttcttccctccatattctctatggtcctcctccttccagtgtctccccctcccttcccttattattttgaggtagggtttttgctgtatacgaagctgtcctggaaccatgtagtctaggctgcctttgaacctataactcctcccacctcagtggccacagtgccaggattgcaggcaggcaccacacctgccctctcattttgttttcctaagagattataataaaagtcatggaaattatacttttactgacacacatgcaaaattgattttcaggaagtatttattatttaattcacattcttaacaataaaataaaagacaggaagacagaagtcgcccaagattccattattttcctctctaagcagttgctttcagtttattccaataatatataacatatagtatatacaatatgcaatatacaatgtatggtatgtaatatattaattaatatatacatatatataatatatgcaaggttgtagtaatacgactatgggaaaatgtgtgaatgtcctaggtgagaggctcaggcttgctcctttggtcataacatttattcattacgtggctttggaagtctcttccacctgccctttcttcatctgccaggagagatcacagcttcttctcagagatgtagttcaggaacatgtctggtcctctgtgcttttccatcgtgcaccatttgctggcttgtactctcatctgtatatgtgcaactttgctttatgacacgagaagaatcattaccttctctgatgcgaggaatcctatgatgctggttgcttccatgggcgaatgaatgttcatggggtcgggggaggtgttgagaccaaggaactctcccaccaaggggcttctgtgtctaccagtgtttatctagaactcacatgattgaatttcttgagctcgaaattgtacttggaccaacaacagctggtcacaggacacgtggctctgtctattgcctgaaaaatctttgctcctggggaattctatcctcctcaacttcaggtctttgcttgtctgtggcaaggcctgattggagggtcaacagtatttcgaacagatgtaatctgcggggccacagaagactgaacggtgcagagagagaggcagcctcttccccataattccactggtcccttcccatctgtggctttactctagccaagaggccaacctccaaaagaacatcagatggtgttgtaaagacccaagcctctgcaggagctgggatgagggacaacctgtgttctgttggctttgtctctggaatgtgacacgcatgggatcagctatgacctctggtctgaaggggagacctgtgtggtgtggatgcttcctcccctggagcctgttgcaggtagatgcctggacttccaccttgctcattggcaggaatgagtgtgcgtgaggattagccatgagccaaggacttcagtgtcagcagaatgagggggatctggtatctatatcatccttattagccaccactacccaaggattcctccgttacattaacagtgaacagaatcattatagtggatatagtgcagtgattctcaatcttcctaacgctgtaaccctttaatacagttcctaatgttgtgatgaccaaccccccagccataaaatcattttcattgctacttaataactttaattttgttaccattatgaattgtaatgtgaatatctgtgttttccgaggtcataggcaaaccctgtaaaagggtcattaagaaccactggtgtgatgcatgttcatggggccaaagcacaggctggcgataacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggagggtttctccgtggaatattatagaatgagagacctgggcatgtggtgatggagaaaaactgggtcatgttagaggcggcggggagtaaatgagatgtgggttatttctaaacagggctaagactccagatgaaaccttgtaatccacattgtagctttcgccagggttgagatattaatctttttggccaaactcacacatatgggaagatgttcatcttgttgctagggaaccaggacagtggtaaaatatatccatggatccgttttattcatggttgctctcatgtaaaccctcacaattgcacgctagctgattttctccctcgctccctcctgcctccctcttttcttcttttgtaatgtatgtgtgtacacgcatgtgtgtgcatgcatatgtgtgcacatgtgtagaggacaattttaggtctcttcctctgttgttctccatcttttttgacatcttcctgaaactgacggtctttaattcatctagactggctggatccctccatctctgcctccctggggctgggatcacaggcctgagccacttggcctaggttttacatgtgtaccggggatctgagctctgagtccttacactttcaaggcaagcactttactaaaaaacatcttctcagtcgtgcactctaagtgtgtctaagggtaagtgtctttctattgccgttatgtttccccaacactgtttttaagtcttgagctatggggaaaaatgatgatgatgtctaaagatgatgttcagcaatcgtttttgctctgtcccatttctcagtgagtctgggtgggatgcaacagaggaagcaggcagtgatgtagcttcacactcatacggcatgtctgaggatgctggtggatgtatccagtcaacaacactacaggctcttttctctcttggccacccattgtcttccctggctatctgtatcctagcccttgaggtttgttttctctctctctctctctctctctctctctctctctctctctctctctctctccctccctcttaaataagcacacatagatgtgattatgtttagaagctgaagcatgcaagtaaatcagatgcgtttgctcaacccttgaataaagactgtagttattttaacaacaacaacaacaaaaatcctgcagtcttcagctatttctggataagactagtaattagcatgccatgtgtaattcattgctggctctggctgcttatttccttgttccaatgcagcctaatttaggggactggatttatttcacttggaaatgtgattttttttgtggagacctctaaaatgtcatcatgagattaatgttttgtttttttttttaatttttttttttttttttgaagccagagtttgccaagcctggtgtttggagctcagttattagttctcagcagttctgtggtggggagtaacagcttgctaggatgatatttagtttcagagaaaactgttaaaagcaactgctgcaggaaagattgctagtacctgaagagggagatgttaaggaaccacaggttgatttgggggtagattaatccctgcagcatttctttggttttggtgccactcttgggggacattttacatcattattagcagatgtattactgacacgcaaacatttactgatctatcggaggccaaaggcacacatgtgcatcttttgaaattgatgttgcctctgttgaaagaaggctgcttgtagtgacccagtgagaggagccctgaggctgctgaggaaagccatttggttctttatttctagaaggatgtattgaggtcatcagtccttaagagactgactaattctctggatctttccagcaaccagtcaaccccagtgttgccaatggtgaaagctcaagaagggcaggatgcaacttaagttgagagtgggtttgactacatgccatgctcaccctgatgctgctgttggcccatgctcaccctgatgctgctgttggcccatgctcaccctgatgctgctgctgcgtcatgcttacattgatgatactggtccacacacacactggtaatgctggcccatgcttaccctgatgatgctaagccattccagggatcacctacatcctctgaagtcttttcatacccatcaaagggaagtagatgccctttgctttctgaatactgcttttaatgaagaggaaggtattttctgatacacgagctgtgtcttttaaactagtctccctacctactcccaaatcatagaaaagaaattaacaaaaaacccaaataaaataaaactctcttatgcctgggtagtacgtgtattgttgcatcttgctcaattggagaagttagatacacaacagattctagtagtgagtgaattacagcagtccagttgctccatattatatgatgatgatatccattcacttggaagaaaccagattgctcattaccccattgccattccagtagttagggttgcttcctcagagtggggactgatgagacaggaggtgaaaagtgttgtaggcagtttagggtaaaaagctaccccctcaaagtgatttttttcttgtctcttcttggaccccttgcaactctttcctcgccagagaccagagatgcaggaagcttttggaggcattgttttgatgatgatgatgcatttaagtgctttttctgcatgtttgtataaacatggtcttggtgctcctgaaggtcagaagaggccttcaaaccctgtgagactggacttacagacagttatgagccaccacgtgggtactgggaattaaccaggggcttttgtaagagcaacaggtactcttaaatggtatactagccgccccctgagggatctcaaggtagcttttcagaggtgggaatgttagggtagcagtaaaaaaaaccattaagggaaaactcctagtcaagagaatagaatttctagcctgggcagaggcctcattccagttgggtggatcagtcacttgtccaaggtactaacccccaggcaggacggatcaccccaggaaggtgagcatgccttaagccatgctaaaatggtaagaggtacaatgacccctttaatgagatatgggacttttcctcctagaattcctgtcccctagtgtagtagcttataaggctctagctatgcgcttcctcattgtgcttgccatttgcttgtccaccatgtcgctggacatcgtgctagcttaactcagaaaagtgtggctgctgctgctttttctcttctccattggactcttccgggcagctgcggagatttactggttgcctgccctagcagttttcggattttattttttttacttgaataagagtttcccttcgacttatatttgtggccattcttaaattttattagtgagagttagaattccaacaggggatcccaattttctcagtattatctggcgaccatgaagggactctcccaaaatttgtggccaaaagaaaggctcagaatgttgtcagctagcacgagacttccagcacagacctctctactttgctgttgcttgtgtgcctaatgtttctgccaatgcatttaaaaagtgcctgaattcatcacttcccgctcctttattactaagtggagagaatctggaaggagttggtgtggggggaaagaatatgattgaaatatattgtataaaattaaaaatagcatgaataagtattgaagctgctatcacattggaacatggtatttgggggtgacctgagttcctgggccatggactctcatatttagttctagaataaaccatcttttatacaggcagccctggtgtcaagacacaatgtcaagagggaatcagattgattgcagagaatccaagcagttatacaaaaactgtgacatgaggtgctgttggaccatgtagtttgtcaccaagggaaattatctctggaatttttaaaggcaaaattctgtggaagaatttggacccaatcttgtacagtgcaagttctatgtcatgttaagggttgatatggaattcttcaaatctagtgttcagggggaaggtgagtcatcttgttatttatttatttatttatttatttataatctagtgttctgggggaaggtgagtcatcttgttatttatttatttatttatttatttatttatttatttatttattatgggtcccagtgcagagagtctcatgcctctgctggcttctaggcttcttcacgctggtccagtcttcctcattgtggtaaaggagttggaccttagatacgcagggagcctggttccttgtcacctccttaaatgactggatgggcaaagtgagcaagaggaggatgagaaattttaaagatgatctcctgagcaggaagttgaatcattagggtaccctacccatgttctgcagatttcagagatcgtgaatcccttggtatgtgtgtcaggcctggatcttgacacagggtctggcttggccattatagccttatgtcttgggtggtttccaaggcataggcttacccaggccaacaatgggctgttgtctgtttgtacagcacaggttatacatcagaccaccaggaagagctctggcagacaggagaaggtgtggatatccttgagtaatatactcagcaaccacattcatttcattaaaccccgtggccccagtccatttcattgctgcttagcctcccaggctcacttcagtgcaggcttaggaacacgagttctattgtttcagtttctggtctattccattcctaaagccattggccatgaaagcagacttgagagtttagaactgccaacctctgtgccgcgagatggtgttaataattctttaaggtctgagacaaagtaaatggttacagaagacaaaagaatcctctagggcagagggactctgaacttctgcctctggatatagagtctggaaaggggaatagatctcatggtgttctgttattttttgtttaggtaacactgtcacacggctcagcccacttactaagcactcacttggaagaccatggctatccttttcttcctttcaactatgctattattttttcaactgtctttctagagtttctttatgtaatttatgctatgtaaacaaacaacacccagagaactatatcattagctatcataattccacatttaggtggtgcagtctttctgtagcaagcaggctctgagatcatgtataacctcaccctccttggagtttgcttcctatgtttctcgtttgcacttgaactctcagcttcctgttcctaccaccatgcctgctgcttgctgctgtgccttcctaccgtggactcttcatagctttggaaccatgagaaccaaatacagttttttttttgtttgtttgtttggttttttttttttttttttgtgcataggtcaccttggtcatagtgtcttatcacagcaacagaaaagcagctgatacttctgcctacctcctcatttcccttctcccatttaatttatgtacatcactgactaagatagccctctacagatgaaaactgtatttgcaaattttcgattttaaaataaaacaaaaacaattgtgtattttattttagtcaatttcaagtcataaatgtgcaaggatagtttttgtataatttcccagaatcggaattgtcaagtccagagtatatgcctgtatagttgggctgacactgcgaagctgtcctcctggggtgtttttccagcactgtctggggcacagggtctcaccgtgcagccttgagtggcctggaacttggagacccatcttcttctgcctcctgagtgctgagagtacaggagtgtaccaccacacctggtcagtttcagcattcagataattttgtattcataactatatattaaacatgataatgattacacattaaagatgtcaaagaacttacagagtaataacttctcttttgaagtggaaaataatctttcttagagatttttaggaaatttaggtgtagcctgaaaactgtttgagccaatgttgattgctgaattagacatgaggcgtgatagccattagtaagtgttttccatgacttgggagccaggctcagagtctggtctgagacacacgctgggtgatccgtaaagcatttgattgtcacctatcttcctcctgaaaaggggtgtgtcggggactgttctcttacctatttgcactggtagtattctcggcagctgtggctacactaacttgatgcgcttgtctgtaagttgtagctattttagctgtaagtcttttaagcaaacacaatgaccaagtaactaaatgaaccttgaatccctctcaaagagaagcgctgtgcacagttgcatgctgtgtactgttacattttttcttactttgttgccagctacacagctgtgaagaccaatcccaagctctatcgtcctctggatcttcttgtccctcccttcaggaccccctgctttactgtgtacagtttccaggtgtcttctcccatctcactgtcaaacatgaacttttaggatattttcttttcttttttttttttttttgggatgtctttttttttccattttttattaggtatttagctcatttacatttccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttcatgtgtttagcaaattgtatcttatatcttgggtatcctaggtttggggctaatatccacttatccagtgagtacatattgtgtgagttcctttgtgaatgtgttacctcactcaggatgatgccctccaggtccatccatttggctaggaatttcataaattcattctttttagtagctgagtagtactccattgtgtagatgtaccacattttctgtatccattcctctgttgaggggcatctgggttctttccagcttctggctattataaataaggctgctatgaacatagtggagcatgtgtccttcttacccgttggggcatcttctggatatatgcccaggagaggtattgctggatcctccggtagtactatgtccaattttctgaggaaccgccagactgatttccagagtggttgtacaagcctgcaaggcaaaagacaccgtcagtaagacaaaaagaccaccaacagattgggaaaggatctttacctatcctaaatcagataggggactaatatccaacatatataaagaactcaagaaggtggacttcagaaaatcaaataaccccattaaaaatggggctcagaactgaacaaagaattctcacctgaggatattttctacttgagagttatcaggctgtttcagaatgagcttggtggggtggggtggtagtgcaaggagtggatattgtctccttgtgactgaagccatgcaacattcattccgtagcatctaccttcttctgtttctttcttcactgagctggaagcagttgatagactaatgtaacctttcaattcatagagctaggtgaatagtgagacagtggaattatgatctgaagatgtgctgcttagatagtgtccacttgacacaagctagagagttatccgggaagagggaacctcagctcagacagcgcccccatcagattgatctagtgcagtggttctcaaccttcctgatgctgcgattctttaatgcagttcctcaggttgtggtgacccccaaccataacattattttgttgcaacttcctaactgtaattttgctactgttatgaattgtcatgtgactatctgttttctgatggtcttaggtgacatcgcaaaagggttgtttgaccaccccaaaagggtcgtgacccacaggttgagaaccactgggctaaagagaagtctatgggggatttttatgattaattattgatatagaagggactagcccactgtttgtggtgccaccaaagggttggtggtcctgctttatataagaaagcaaactgaccaaggcatgggcagtaagccagtaagcagctttctgttcaccttcttcttctccaggcgcctgtcctgatttccctcagtgatggactgttaggtggatgggcaagccaaacaaaccctttctttccaagttgttttagatatggtgttttatcatagcaatgaagagcaacctaggccaagaagcaaaagtagagatattagtagtatgacttcagcatgcagccagataaaaatgaacaaggaggattgtattcactgtgatgatacacaaaagtgagaccaccatgccgcctgcatcctgactctgtagtaaaatgtggtccaaaagggcagccatgctctcatgggatgtgtggaaacttcagagcagcaggctcaccacacaccagaggaggtgtggtgagccaccctcagctggctggctccttttgcttctgctggactcttcttccttccgccttgaccttcattcctcatctcctagtctaaggtttctgagtgtcctttgctctttccttctgggataacggcttccagatgggtttgctcttcagtttggcttggctcggcttgttttggtttatgtcatctgaagtgcatagtcagagaaacataactaaagtctaaagaattctttaaaattttcttttcctatttttacagttttgtttgaaggtttcccagagttaggcttccggtgaagaaatgatttcttatgagctataggctctggaaacagagattctgcccttgggtattttgtggtcatagtcaagttttaaaaatcagtcccttcctctgaacagctgggagaatggtacttctgcccctcaaagagttgctctaaggctaagaaattagaagctatgactgttactggggatgacataagattaataaaactgttcttattttatatttcaaatatgttcatccatccttacactgaactgctgaatcaacacaagtttagtggatcattcgtgtatgccagaacattaaatggatggacatatatgcaaatgtgatcccatctcaccgtcacagtgtcacaaagtgacagacttgaacatagtttagagtaacatggccaagtgtgactcatagggcctccaatggtccacagatccacccttcacttgagagggtatcttgtgtcctgactgcagtcctggaggtatgggtctttcacaagcagctctactatccctcaagttttggctttcacagactctgagggactgttgagtctttctacagtggtgtcaccatcccttgccctaaccagccaagataacatttactccagtgctatctgcagattgcccctgacagagtggtgcttcctcccagtttattatggggagatttcacagggatacaacgtcttagtcactgtaaccactcactgatgatgccattggagttttgtggtgagttagcctggatgtggagaatattatgtctgtaactttcaggactggaagaggtctagtctacattttgaggttgctttgtgcagaattcccatgggattgttcagctgttcatttgactcatctggagaataatgagaaaatccataggaatatttatatgctcattagaaccataagaggtttttttttcttttctttttctttctttcttttcttttttttttttttttgttaggtttgggttcgccactgtggcacatgtctgtggtcctcagtagctggagaggtggaggttgtagagtcatttgagtcaataagttccagatggggcgtgctagtggggactcctgcctaaatctagctgcctgtctttcagttactgttaacccttctcataaacaatcgatcacaagaaaaaaaaaaaaacacctaagaaaatgcctaaagaacataaaaagagttaacgtttaaagtaaatacttcacaaaaatcatattatagtgacaagaaggagatacttaaagaatcagagctatgcaattgggaactcaccgagggcgacctcctcaggtggatcatctgagttttcctgacccacttagacttcataaaagatggcagtaaaaaagatctgcttggattagtacagcagcctagtttgggtatagagcagagggtaaagtcggttattccctacttctggaagtgtaagaaaaagattgcctcccccaaagtcagctagctcgcagcagcagggcaagttttctcaagggatacccaggtgcaatcaacagagagaacagggtttcaaaccattcagatctgcccccgacaggattctaactgttgcaaaaaaaaaagtgcaagttcgggtcactctttatttctggggtgaactcacttttcccagtggtaaacacttatttaaaacactcacccactggccctgagctttagggcctaccccctaggcaggctgtcttgtatggaatgttatttcttctttgtgtaagttgcatttcaaaggaatgattagtgcctcttgttgtattacttcttaattgtctcagctgttttcctttccctcctgagcttgaaggactttgaggaaaaggaagaaaatgatagtttctgcttttccactcatttacccacaaaacacatacctgttcctcgtgcaaaattagcaccatgaacgtttccaggcaagtgtgcaccgtaggtggccttctctatttcctgactgatgatgtcattttttgatggaggagaggagtttgctttatgcattttgaagccagagaagaaggggatggaggaaggattattttattattgtgctggctagtcttttgtcaacttgacaccgactagagcagcctgggaaggaggacccttgaggaattgccttcatcagatttgcctgtacacaagtctgtgggggcaatttcttgactaatgatggatgtgggaggtccctgcccactgtgggccatgctgccccaggataggtagttgcgagttgtgtaaaaaaggaggctgagcaagctgtcgacaaggagccagccagcagtgtcctggcaaggtttctgctacagttcctgtatccatgttcctaattcagttcctgccctgacttccccttatggcggactgcggcttaagatacatgagagtaaataaaccctttcttccccaagttgcttttggtcaaagtgtttatcgcagcaatagaaagcaaaccaggatggatggaaattggatgctactgaaaagcacttccattaacccctgcatctgctgtagaggtagatatagcaccacaccaaagtcaatgtctaaattgcttttaaattgtttgtatcaagaaatgagatggttattctggagatgaatttgggaatcagtagggcttgaaggaattatctccatacagtgtggagtggttttgacacatctcctaatggccggatagtaactaggtgataaatcagagaagagggtttgggctaaaggtgtagctcagtgcttgacatgcacagtgcttgggttcagtacagggaacggaatagattttcaaagaaacactatgatctgttgcagtggaatattttatgaattaaaggcaggaaggagttgttttctggaaaaaaattaaagcttttttttttttaaatcgtgtgtgtgtgtgtgtgtgtgtgtgtgtgtgtaacagagcagtttttttgggagttctctcctcctccatatggattccaggaattgaactcaggcttggcagccaagtaccttggctggctgaaccatcttgttggccccctgtgaatgcttttacattgtaatcttaaaacattttgtgatgtggctgatattctcattaatgtgtgtgtgtgtgtgtgtgtgtgtgtgtgtgtgtgtgtatgattaaaatgacttaataataaagagagacactaaaacagttcaagagtatcaccagctagagttagtcaataatcctcattgaaggggcgtttggaactatccgggagctagctcagaaaagaaagggcccgaaggaccaggaagccacctgtttactacctttcacgggggttggcttctgtgtctagccagatggtccagcagacttgctttgcactagcagagctgctgcagtctccaggtgtgctgaagggaaggcacatcatcgccttagagcagtgattcttaccctgtgaatctcgaccctttcaccatcggaaagcacagatgtttgcatcacaattcataatggtagcaaaagtacagttatggagtgataatgagccttcagaactccacattggtgacctctgggcctttcacgactccccctgctccaaaggtcatctctgcagcttcatgtgtgcatatgtggcagggtgggctcaccactatgggagatattagctctggaataatgtccagggagttggcttgtgtgtgtccatagctttgtgggaagagatggagatagttatcttgtctctcctcctcattgctctctcacaggtgggtgggagaggcaggtgaccacaggcagagtatagaagaagaccactggagaggccctgagccattcaggccccagctaagatcctttaaagaggtttaaattcatcttcagtttttgtcctgtccttggttgtaagctgtgcatcagtgtggatctggaggtgcagtcatgttctatcatttaaacatctccctgcagacatcttcaaggttcccatctccttcaccgccttaagaactccaagatgagtgtcatatcttctctccctcaaaagtgctctctgtactttgaagactctctctgccttgtcaatgggattgatggatggccgtgttaatccagggaaattgacttttaagggactctgacctgttagcagatagtttaatggcggccagctcagcctgtggccatttgacttctgcttaccaaatctctatgtgttgacctcacttatcatgtctgcttctctttggtgtcccccagcacacacaggtcctcttaggcaaaggttcataaatgtgtagtggaggaccaaggatgtcagggctgccacaattttactagtttggaggctgtaaaagttgtcacgatctcagcaatagtattatccaaactatcatttcataggcaagtgtcttagttagggttttactgctatgaacagacaccatgactaaggcaactcttataagggcaacatttaattggggctggcttacaggttcagaggttcagtccattatcatcaaggtgggatcatggcagtgtccaggcaggcatggtgcaggaggagctgagttttacatcttcatctgaaggctgctagcagaatactggcttccaggaagctaggatgagggtcttaaagcccacacccacagtggcacacccactccaacaaggccacgcctactccaacagggccacactttctaatcatgccactccctgggctgagctatgcacaccatcacagggaggaaactgaaattgtttaaaagtaacaagaacgatgacaaacttccaagcctatccttgttggccaggaagacatctgctgcttctgcacctacctccatgcccttgctacactgtatcaattctaacacttgctacactgaatcaattctaaccccattggggctatgagtctagtgaaatttctttcctttataagttttcctttgggagattgaaacagatggggtctagtcagtggtcagttttcatagctggagtctcagatgccagttacacctttgggcagtctttcaggagtcaagttgtgactgctgacctctctgctgacatctctgatgtatggtgctccccatggtccggtatgtgtcactgtgtgaaagttttcctgcagactctggctcctaccaggttttcggctctgattcaaagttgcttttctaggatttaggatatggacttttgatacttgttctaagtattttgacaatatttctcaaagaaggtcttggtatgctgtgtcaatggacacagcaatggatctccccctgctccctgcccccctacccttcagtactggggattgaatctaggacttcaagcattctagacaagcagtctaccattgagctacatacagtcccagccttatcagtggtctttcggaagtggcttcttgaggctgttccactggatgctgaatgcctagcactgaaaagggaagggtttcccagcatcttcctttgctggtaccgctgttctcagatgagtgtgcagtcttcatttttctctctggctcccaccgcactctgctgtaggcgtccctcttactgggagtagggaactttccaaagcaacccagtccctctgggatgcactctggactcctctcctgctttataaagttccttatttaattttgctgttggagctagaattacttgggcactacttacctcttcttgtagatgctttttggcttttagtccctggagaccctggcagcccatgagagggtgttgtcaccatcttcctaggctgtacacctcacatttccattttctgggggaaagacttaatgactttttcaactgttcacagttaacagtaaaaccacttggcagtgttttgtgtttgttttttgttttgtttgttttttcgttttacattctagttgccatgctggctactttgacgtctacttgacacaagctaagtcatcagagaggagggagtctcagctgagaaaagcactcaatcagaccagctacaggcaggcctgagaggtagtttcttatttagtgagtgataaaggaggtctcagaccgttgtgggtgtggccattcctgagctggtgatcctggcttccataagaaagaaggctgagcaagccagcaagcagaaccgcactcctcacagctgctgcaacagctcctacctccaggtccctgtttgagctcctttcctgacttctttccgtgatgagctatgatacggaagtgtgtgtcacataaaccctttccgccccagcttgcttttgatctcagtgtttctttgcagcaataggaaccctaaaagacagttgaggagtttcttttccttcttcatgatggggtgatagaggacttggaggaaccactcgaagatggatatatcagtgtgggaaatctgcaaacagcaaaccattatgtaggcaacagtctattttgccacatttcctagaagacttagatagttcgccgataaggaaagcttagcttacttcaggaatacggttgtgcatttggtgtttcccctctgcaagtgaggttctgttattgacagaatttaaatatgagagttagggaagtgagggatgctttagaaacttgaagcacacacactggccttccccttgcctaggtctgatggtagtgatggatttgcagcataaagttgtctggggtgactgggagtgtgggccaggtaggcgcaggaggaaagcttttctgtaacagaaaggaagtcctgcaaccgaggaactcagaagtgggagttgcccagtttaagtggatcaaagtccaggaaatcacaaggatgtggatgtggaaggagcacgtgggaagaacctggtggagatttgggataatggaatgctgcttatctgggctgctctctcagctgctatttaactaagtgcctggaagggctttcagagtagcttctaagcaaaaagggaagttatatggattctgcgagtctccagagatgaaagccataattcagttcaccataaaagttatttctgcttttaactagagtggtttatatactaatatttccacaaagaaaattagcaaagccagaaaaatgtggtatctagtacttgagggaccaggatctcagccgacaagagaaggatagaggtggaatttatctctatgatgtttttactctccaggtatttgctggttgttaagggacttggaaggagaataaacaaagaagccagatagaaagtagcttctaaaaatccgaggccatgaatagagagcctttggtagaaagtcatgttgggagacaaaactttgttttaatcgtgaatgcactggggaagagctcagctgtaaaatacaaagagaatttcattcttccaagccaggaagctggcagtatcaaggacttgggatacaaaactggagtgtaggcaccgataaacaccctaggagttctgttaaggctcggtcccgaatgaggagagagttaaataagcccaagaagctttcgctggactagaatccacatactctcactgatggcaccgtcctctgcttgtctcatgaagccactgtagcataggccccaacatccctgctgtgtctggacttgagggaagggttaggtgtttattggctcccagtttgatcagggattttaagtactatgaaggaatattctgagttatggtataatatagactatcattagaaagaagtataaggtgtgcttagcacatttccctctcacaggtcacctaatttcattttctttttgcctaagtgccatggaaattattatttttttgtatttaaagtcatattccgtggtgatgttcacctataatctcatctgttctagaggctgaggcagaaacgttgtatattaggggcatgacagggctgcatagagagggggaagggaaggagaggaagagaggagttcagggctagcctgggcaattcagtgagatactcttggcaaatgagaagattctacaagggcttggagccgtagctccgtggtagagtgtgcacatctaccttgtgtgaaacccagggtgtgatctctactactaaagagaaggaaaaccaaattccctgctgagattaattttactaggacacgcttgcttgcttttggtgagtcacatgtaagattttggtacccttttagtttgtagagttgcgtctctgttcaagaagtgtttcttttctttttctctttctttctttctttctttctttctttctttctttctttcttccttccttccttccttccttccttccttccttccttcctgtctgtctgtctgtctgtcttttttggtttttcgagacagggtttctctgtgtagccctggctgtcctggaactcactctgtagatcaggctgtcctggaactcagaaatctgcctgcctctgcctcctgagtgctgggattaaaggtgtgcaccaccactgcccggcaagaagtgtttcttgaatagtagacttgaatatatttctttctgttgttcacggtcaccttttagggatcacagttatacatatgctgagtcgtatttaccactcattctgcaaaatgtataacttggggggtagtgtttagggatatagataggtagtagagtagggatatagatccctagaacgtgtgggacggtggggaaaatgtaatccacggttcttcctctttgtagcttggtttagttctatttctttgttcttaaacttcctgccttgtcccttgtttcctgaatatctattgtgactgatgtccatgtagagcgcatctatttttctgtgacatttatgctcctaaatgtttttgtcatcttctctttattgccagttccccctggattttatatttaagcatggcctcactactcttttctttcccatctggttccctttacttcttcgaatcttctccccagctttctctttttcttcattttctccttggatggtaggttgtttctgaagtttctaaaatttattcttcgtcatttgtttgtggctttgatcacaggtaatatgatagtagagagtgatttttgtctgttggccagctctttggttttctttcacatatttttttttggtagaataactttttttttcagatttatttctttgtgtgtgtatgtgtgtatgcacgtgaaagcacacgtgttcatgaatttgtatgcaccacatgcatgcctcatactcctcccccccccccccgaggttagaagatggagatagatccctgggaactagaattatacatggttgtgagttgcttgatatgggagctgggctctgaacccaggtctgctggaagatcagcatgtactgctcactgctgggccgtctctccagttcctcatagaatacatttttaaaaattaattttctcatttatacgtgtgtctatgtgttcctatgtatatgtgcaagggcatgtgcacatgtgtgtggaggctagacggtgtatcaagtgtctttctcaatagctgtctactgcatttttccaagaggtcatgtgatgtggagagaattcagggcaactttctagtctttacagcctaggcctgtctgtccctgctgccgtagcaagagggatgcttcctgcaagcttaattcatctggtcttagacagccatggccaccagctcctctcatcccagccctttgctgtatccttgggttgtgttctgctggtggtggccagagtcttcttgttttccctatgcagcctcctttcaagtgtcagagcccacctgaagtccttccagatgccttgaatctcatcagttagctatgacttgtatctccatggaaccttttcactatgacctggcttttgcctcaatgtgcagagaaagaagaggttctgtgtgtgttcacttttaagatggtggagatagttttcttacagatcaggagactctttgctgatcttgccagtcagcaaagagacagcgtgaggctgaccagtccgagacctttgattttcacatgcccagaaagtttctttagtaccgggcacagtaaagacgagttactcaggcaaagcagctttgatgttgatttagtggtcatggctgttgagaggtctggttggtagaataacaaaaacgtctggaaccatcaactggtaaacagtaacaactgcggtgcattctatacatttatgatattctcaaataatagatacatggttttgaaatccttgttttctttctccacccttcaatttgccttgtctcctttcttctcttactatgtgtccagttcttgcttatcttctgtcctctctttctttgcatctgggacctagaatctgtggtcagccatgttttggaatctgttgtctttttttttttttaaataactgctctgaaggcaggtggttcccgaccatgtactgatttttctcccctactctttggcatcttttgttcgcattttagaatggtacctactaatgcatgctcttccctggctttgtccaaggactcttctagctatacacttagagagggggattttcctctcttatcctgtcaagttcaccgtgttcatagttgttgaactgcctgaaatggatctaaaagcagttactgctgctcttggctctgacagctgatcctcagccatgaacaccacggtgcccttattgaatatggcgtaggtggatttgtttgcaaacggttctgagagtgtaaaggttactatcacacgcacgtttactctggcgaggtaaggttatggtgaaaagagtgatgagctgcaccaggctgcctgtctttggatttttacaaagaatgtattactttctaagaattatttgtggctgttcctttgtatgtcaaaacgttagcttaattgctaaagttaaaattcttggagggagtatgaggggcccatacatgaattgggcttgccgttttggttggttttcacctggatggatttgtgagagatgcagaataaggaccgaagataaaaggctgttgatgttgcgtttcccattgacttggctgtcactgaaggcagaggtgaggctaggggagggctttgttgctactatgtaagggtagagaaggggaaaggcagtctgtgaagattcttaaaatgatttgcatttttgttaaggctttatgtgagacacaagtgtggaatttgaaccagtgacagccaaacacagtaaggaagagagaggcatttcatacttttacttatcacactttagggacgaggtccctttgcagtgtgagactgcattcactcattaaaataatagctttttaaaaatatcattgtgttacatgggaagcacggtgtcttaactatttttcctttttatttgtattacatgttttgtctttttcatatgtaaagtgttaccatagaaacataaatccagaataggtacagtacccagtacactggtaataactattgttgttgctgctactcttgttgctgttgttggtattgttgtttttgaaggaacaatttaaaaaggtgtttccttctttattgtaatggtaataaaatgttttgaagaacttttaaaagttagaccataagcaatgtacaaccaacaacaaaaccacttacttctggaaacagtctttttatttttgtctggtaataaggctgaagcccagagcctcctccctcgttcttggtatggcagtttgatgagatgcccttccctctccccaagtctttggcatttgactacttggtccccagttggtggcactctttgggcagtgtaggaggtgtgatcttgctgaaggaagaatgtctgtcactaggagtggggtagaccttgagatttccaagccccagcctcaagtctctacttaggtgactctgcttcatgtgacatgaaccctcagcttgctcttttaggctcccgtacttctccgctgaagtagtgatgggctcttacctcctctctggaaccataaggccaaacaaacacttctttctctgagtggctttgatcatggtgtttggtcacagcaatagaacagttgatagactaaatgaataaatactctaccacttagatacacccagtgtcaggacagcataattactgctaagtttttgtttttggtggcaacctgtgtgtatatgtagaaacaaacaaaatgcttccagatatgatacagctctgtcttagtcagggtttctattcctgcacaaacctcatgaccaagaagcaagttggggaggaaagggtttattcggcttacacttctacattgctgttcatcaccaaggaagtcaagactggaactcaagcaggtcagaaagcaggagctgatgcagaggccatggagggatgttctttactggcttgcctcctgtagtggctattgctggttgtcaacttgacaatatttggaatgaactacaatccggaattggaaggctcaccagtgacccttatctggaggcttggagatccttatctggatcttggtttgaagatcttgagccatagtggctatggattccagaagattgaatctccgagtttaaggaacacacctttaatctgggctacgcctttcatctgggattaaaggtgtggtggaacacacctgtaatctgggctacaccttctgctggagacaatataaggacattggaagaagggagtctagctctagctcttgctctagctcttgctccttcgcctgcttgctgcgtgagactgagtaactgctagatccttggacttccattcacagctgcgactgaacaattgttgggaattgggctgccgactataagtcatcaataaattcctttactctctagagactatccataagttctgtgactctagagaaccctgactaatacacctcccctggcttgctcagcctgctctcttataaaactcaacactaccagcccagagatggttccacccacaaggggcctttcccccttgatcactaattgagaagatgccttacagctgggtctcatggaggcatttcctcaactgaagctcctttctctgtggtaactccagctgtgtcaagttgacacaaaactagccagtacaagctctttgtgtaaccttcttcacactcttccttgtttacccactgacactctatacctgtcaaacaccaagtcttgagaccaggctcctagaaggcgccactctactatctgcctttggactcgcctacttcagttacattataagcagaattatgccttatttattctttagtgatggccttattttagttagggtaatgtctttaatcttcattcatagtgtagcgtgaatcaaaattcctttctttttaagttagctgaacgatattctactttatctttactggtttatcattcaccccatgtattgatgaacatttgggttatttccacttttaggtccctattaatactgctacaaacatgcctaagtacatatctattcaactcctcgttagatttctttccttgctaacagacgtcctattgtatgtgaactgttatctcattacagctttgacttgcgttgtcttaaggatttatgagtttgtgtttatgaaggatgtgcaatactacagggtgtgcaactctacagggtgcacattgccattccaaaagagaggatcaggaggatgcaaatgaatgatcggaccgaaaagactgaaaccttaggacagacattaagcacagcagctccgtgtcaggcaactggcgattttcgcggcatcatctgggctccactggtctggagagctagatgtatacagctgttgaactaaaccatactcgggccttctactgggctggcctcactccatgcctgcattgttcccagtaggtgcccggcactccttgcatgtgtgtttccagcatcctgaagtctctattacagtacatgtggaaacttcatagtatcatatgcagtctactcaagagtgctatgcaggacactcgactctgttgcacgtcggctcccattagcagcttcctcccaccttatccctgtaacctcggactctgcatgtccgtaaagctatcagtatgtagggggtggcaccaagctacactgccagctccagatgtaggctggttccccggaccatagctgcagcagccaggtgtctgtgtggctgaactggggagaccatctccctaggtggctattgggggaactccatagagaaacactccatccaaacactatttttttttcaggtgttatatttcaagtgaatgtgtataatcctggagccttttatgggtgaggtcttgctgaagataccattcctgttgtcccagtgtaaactgaacagcatctccttaactgtgcccatctcttgaagagccacgcctactttggccacacctgctgtactgcagtacaggctaagctcatgctctgttcctccaaagactgtgagctttctaggtccatctgttccttgtcttactctttctcactgtaagtctggctaaagacaatgagtaataaccacattgcatgccgaaagggatgctgctttgaaattacctccatgcaacaaattcatgcatttctcttgaattctccctcactcagattcccaaggcacagacagaacacctccgggtacttggcccaaatgtagcgtgaatgacctctactgtagttttatctcccagttgagatctatttctagaactctgtgagctgggccttcgctgtccacatttttttttttttgaaattatggtcatctgaattcccagcagaactgctcattaaactctcagcattctagagcttctctatctgtggctttgtacgctttcagattcttccaccaactggtttcagtggcctacgagccatatggtcatggttgtcacaacagtcacttcttggcaccaatttccagtgttgttttggtcaccatgacagactccctgcatgtcgtatgcagcctttatttctgttcatggtttgaatgggtgcagtccattgtggtcatgcaggcacgatggagtttttggtaccctgtggctgtgctgccaggaggatgatcgagtccatgtcagtgggtcaggaaacagaagtaaagccaaaatcgggctgagggcgctacctaagagcacatctcagtgactcactgcccccagctagacgccaccttcctgatgtccacgaccggcgaaacagtgccttaagctgtggactaaatttttaggtgcatgagacttttgggggtgaatgtcacctttaagccacaataggaagctcaaggataaatagaactctgcaatggtaagatagggagatggagttgtccaagaaaaaggaagattgcccgtcaggtaatggctttcccgtatatacaactgttaaagctagcatagagccaggctttatggctaactgctaactctcaattctctgctgctccatgtcacttctatcaacaaaggagagggcttactttttttttttttaatgacagatcaacatgattgtgaacatatgttgattaatctagtaaggaggacaatgatttaaatgttggtacctgatcagaaagaatgtccctgactggttttcagaggataccagttcctcgagctggcttagtcctcagacaatgccagtcttggcttgtgtgtttcagagatttcttgcagccacgaggcacctggccaaggaagaactgagaaccgattggatttatttcagtctttggcttttgaaattacacaactgcatgacatcttcagcttctgatggaacacggaggatgtgagctctgggcgagttgtagaatgaatagatgttaaagttcgaactatggcgagtcttaaagggcaggtctgtctgagtgatgtacaggcttggatgcctaagatctcagccagacttcctttatccaggataaggtctcagatgccctgttagctcttgctaccacatcttgagccattttggaaacaggtatatttcatactgagaataggatgcttctgtacggtatctcttaggaaaacgtgctgccttccttcagatgggttgtcgtctaattgtgagtcctgagagatgaatacatgaactacacatatgattctaaccaagccaggaaagttggcaatgtttatcagttggtcctgcttaggttttgctgtcgaagttctgtgtcttgtgtgactcctgtgcatccgtttactacaggtgtcggcactgagaagtcagtatgaccaaaggtccttgaattcttttaggtcatggcctgtccagatatcacgcataataagtacaaatagtggtgggcggagttagaggtaacaatgcgggtttttcactttctgccttgaaacgttctagccatctaaagcatttgctgagatcatgtgacttaagacaagtattcactatccattctaaaaagagagacagaagacagggaacccgcgcatctcacactagtcttagactgcatgcaaactgggtaacaggactggcatatgctacttcacagtgccaggaggaggtgctgtgctgtgcaggtgcctgcactggtcctggctccagggagacaatgctccctctggtaattctctgcctcacctttctggccttcacctccattgacctctgaaaaatatcccctttcctcagaaaaggacaggaagtggatagaaacggaatctgaaaatctcagcagagatggctcagtgtttaagagcactggctgctatcccagggtgcctgggtttgatctcaagtaccaaggtgtagcttacaaccacccataactccagttgcaggaggatctgacgccctcttctggcttccctgggcaggggcgtacacacagtgcacagacatacatgcaggcaaaagactcgtggatataaattaaaaaaaaatctaacttttaatgaagaatttgtttaagattggcacttaacaaatgtgccatatcccttgctctctgcatgaatggcttgggttgttagaagtgcgcaccagatgttctgaggacataacaacacccgctgaaagaactcaggctcactggaaagactctgggtgtgcctgcaaggcttttctgggttgtgtactccaggcatgcttctgaaatgcaagtgtatgatgtgtatattaaaagtcatttaaatatatacagtatatttgtattacaaataggaggatgccaatctttttcagatataacttctcatatgataaaaatgttgagcttagggaaaagtgtgtgtgtgtgtgtgtatataaaacttatgccaaattcttgttgcatattactttggctgttggttgcatggctttaagtaccgtgctctcaatgggatagccaatttcaccttggcgccgtgtcagattgtcttgttccatttgctaagagattagggcgtcagcctttggggcctctgctgtgggttctttcatcaggttggctgatgtcatcttttgggaggtctagatgccatcattgtccgtcttcatccttgccagatgctctcactctgaactgagaagagaatggagaaagaatgaggtgtgtgtttccaaaagggcctctcttggtacagaagctgcacagtgtacctctattggtagggcctgtccccagccatccgagcgggtttgcagcaggtgaaggcatgtctgctatgatttcctccagtagctgttaactaaaggtagcaaggcttgactaggacaatataacgggagcctaaagatttgcatttgtacccactgaattctgtgtggcaaagacttgtcttcagaacagcgtgtgagtggaggtgttaataagagaaagagagacagacggacagacacatatagatgggatggggtgcagtggtgtgtacttctttaaccccaacactcaggaagcagaggcagggggatcagcatgagtcgaggctggcctgctttctatagtgagtttcagacctgcaaaactacatagtgtgagaccctgtcccagagaaagaaagagagtgggagggagagagagagatggagatggagacagagacacagagagaatattttttgagctttctgtgccttcacaccagttacaagtgattgagtgctgtgtggtttctgtaagaatgtttgaagttattctagtctgataacctcccgtattcctgtttttttttttttttttttttttttttttttagcgctgatggctctacacctccaacttagtatggggctcaggatttctatgaaactgtactggttcagtgtgacagtgacctcattgttcaaggtcttttgcactcccagcagacacagacactgtatatggagttttaggattcgttgtggcgagatagaccttacatcatggcccaggtgcgatttgaggaatcacagggccaggcgctgctgctgtttgatttgaaattcctgtgccaatggggctgcggctcactctgtctcctggtttatgtacaggtactccaagctgggacttaatagcaatagaaacacatttttaagacaaattcaacaagacatgtagaaaatcagagggtacaaggagagaggacaggtgacaatttaataaaatcgagaaggggaatacaaaaatgacaggcatcataaattgtacctgaataagtatttgtatcacagacaggaggttctatgacgattgcaggagaaggaagagaccaccagagttttcatgtcttcagagcagagcttaattggaaaaaccatctctctctctctctctctctctctctctctctcaacgagagcccagttcatcatatctctaagcatatgctgtagttatcaggaccatcatgaaatgccagccagcagcaaaggctaacggtaagaacagagaccacaggtgggggagagggtctctgggcaagctgcaagttcctgtataagatggacatcttttaggactataccaggggaaaacgaaggtagaaatggacacgctgggtttttaagcgcatgtgtgtgcttcagttatgcctgcactctgaagagctggctctctagagccaaagctgctatgtggcatgttagaggagtgtcggaggacagcttcactttataactacagaattgcctttggattacatttggtttatgaccttggctttcaggcgctatttggacagctgacaatagcagtgctggttatcctcatgtcccttataaactatgtagcgtcaggtgcaggactgtcaccaagtaaatgctgcctgcgactctcacgggtgcctaaggtctttataaagataaccactctcgtttgaaaacgagtaacattctaattgaaatattaacagcagaactcttcattcaagtggaacagtaatgtacctggacacttaaccttttgcctaccaatattagaggtgtctaaagtaaccctggggtaccatcgtgctaggtctgacctcattgtcagaaggctttaagtgagtgaacataggaaactctgaactttaggaggctggtctccagtatacatatatgggatcatataaatgttgtatgccaaaggagaaatataactaacataaaagagctttaatacatatcaagtaaataagtattttcattcttttccacagtgatcattggtgccctttttttttttttttttttttttttttttttttttggtttttcgagacagggtttctctgtgtagccctgactgtcctggaactcactctgtagaccaggctggccttgaactcagaaatccgcctgcctctgcctcccaagtgctaggattaaaggcgtgtgccaccactgcctggctcattgttgccttttaaaacaaagttctccagagacagatgctgtggggtgtgtttgtgtgtacattctgattagaaaatccttgagactttctgtgataggcacccctctggatgcaatagcatcaggtttttagtgtcaaatagattttcccatgttaatgattgttgtgggagggcccagccctctgtgggtggtgctactcctgagaaagccaggagcagctaagcaagccacagaagcaagccagcgctctctgtggtctccgccttggttcttgctctcaggttcctgccccggcttaagttcctgttttgacttcgcacaagtgatacagtgtaacctggatgattaagatgaagaaaaccctcattcccctttgttgctcttggccatggtgtttttcacagctgtagaaatctaagacaagcatctttatttatcttcctgctgaacactaagctaaaccttatgggtaaaatgcaaattaaactcttgccctcacaactgttagagtgaaccgaagggaacactatgtgcaagaaaaagatgaagaatataaacatacgaaaaataaacgattgtatgctaattagtagcagctgtgctgagctggcatgtaagtacttgaaatgtcacagtatttttgggtgttgtgggttcagggctaagtgaaaagcagaaatggagtccgacttggcaagtcttttctgtccttaccctgaagctatggaatccaagttgaataagacatttccttgaaaataagttgtatatattttgttgttgacaggtgatggcttgtggttcacataatggccaatgcttatttctatcagtgaggtcctactgtgacatacatggctgcactagtttgtttatgtgttgcttgtggggcttctctgatcctgtcacgacagggttctgaagtaagggacagagactccatagctgtgtacaaagctgtttaccatctggccctctgtagacagtttgctgactctccaattgcctttttgtgtaaacagaaagtaaatacatgtaggcagtaaatactgacaagtgattttctggcttgggtctcacagactaacagattttagtggttctgggtataagcatgtctctgcatttatccctaattatttttactatttttaatggaacacttaacagccagctcatattcctttggcctagtctatcatagctgttgaacacactcctctgtgtgtgtgtgtgtgtgtgtgtgtgtgtcgcgcgcgcgcacacttcatatgtgtgcacgttttaagtgaatgcatgaatcctttgctttgatttaatgtctcgtcaaagcagttgtggtactgtgcttccaaagagcctgaaagctcaactggatctcagtattcattcgcaactttagagcaaagcttatgtaggatactatatatacacatagaaacatctaaaggcatagtgttgcatcagtagaatgaaaatgcatatcacagactatgctttcggttatagggctgtgtagaaatgcttggctcattttgattgtgtgtagactaattaaataattctccctcttgctcacttagaatcagaatattatattttcaagcaagattatgacatccagtaatctatactctaaatctttgcctataatttaatttcaaagatttatatgctatactctttgaataaagtacaaagtgtatttagtgaaatagtaacttggttttgaaccgtatactaacatattgcataattttgaaccattcgatggctcaggtggaaataaggaatttttttttattgacttgatacctttagtcgagacagtgacactgctatatgcatttctgtttagaatagagactttaggaatgcttgaattatttatttataaaaatttaacatttattcttatgtatgtttgtgtctgtgtgaatgcatggaggtcagaggaattgaatccctggacttggcattacaggcagttggaatctacctagggtggggactgggaaccaaaactaggttctctgtaagtagacactgtgagccaccgagccaactctctagccttgtatatttatttattaataaaaatctcagggttttcccaattctgtaaaagcaattcatgaaaagtcccattcttctttggtaatgtgtagatatttataaacatttgttagactgttacacatctcatccatttctgactaccagtttgaccctcaaacgtgagaactttgctcttatgttttgagtcatttgagaagtttgagaaatcagatctgacagagataatcatgtttatctggtgactatatatgaaatcaaatccatcccccctctcttttttgagacagtctcactgtgtaccccagttggcctggagcttactgcatagaccaggatggcctcagactcatgcaaatttacctgcttcaggctcccaggtgctggcgttataggtgcgcactcccatggccagcgacttctccttttatccacacatctttatgtaggcgttcattgtggcctttgataagtcttcacccctgtactctttcttactaacctaggctccccagatggtttcttctgctttcataacattcaggttaataatatctaaattccacttttgggagaaaaaatgctttatttagcttaacatgatgattcatacttctgtctgttttctacagagcgacatcgtgttcttttttgaggtcgaatcacaagacactgtgtgcatctgtcaagttttatttattatcaattgacaggaaaactgatttcatattttgactattgtgaatattgactccataaatggctgtgtgggtatttctgtggtatgttgactctttgatgtaaactctcaagtggtatagatagctaaaacaggcaataattgcaattttagtttgtttttttttttgagatacttttgtactgatttctatagctgctgttctaatttacattcttatatacttttaaaatgtttggttaccttctgatcaatatggttatctctaaggggtagaaacatttagtagggaataataagaggtagaagttgattttctaatcagtttctaacactagcagtctgcctcagaggccagggatgggtaggcctggtgacgtgctactgccgatgtaactatagtttccacctttgggatgtgacgaaggcactagggccaaattcactggattctaggacctcagcactcagacatagttgaagatggagaagcagtcaggaggagcatcccctgggagtcacttggtaatcccctgggagtcatttcaaccatgtctcggatttgctgggccaactctgctttatcaagatcctcacagacttcacaagcgtgttaaactctgcagaggagctccagcttagggcctcgggcttcacagaatggccaatgttagaatcatcacccttagagctatgaaacggtacagaatcatgatgtgagcttccgggagtatcagttcatgaagtcaggaatgggtctgctacctactgaggtgcggaacctctgctgggattcgagtcctctctggttgactgaagggatgtttgagatggcaagtcaccttctcgggatctgttgggaagtcacagctggctttccccatgtagtccagccaggcttactctctctgaggttctgttgcatttctacagggcccattgaggcctgcgggcacagctctgggcatggctagatattttcaggcagtctagatacccaacctccattcttttctcttccagttcccatggaaacagatgggggagggtgtggagactgggcatggtactatctttacccctgctttttttttttttttttttttggtgatggaaggtctgtttccatgggaactagaaggggaaaggatggtagtggagtaactagactgcttttaaatttcaatgacagcttctgtcctcatggtaaagtccactttgcccaagtttacagctaggccaggagagttcttatttctctaaatgtggccatatttatctgtaaggggagggaggggggagtaggaggaagttcttaaaatattcttgccaatattttcattttcctccaggaaaccatttttaggtgttggtataagttatttaaaaaaccgtctttagctattatttttttggtgcggttttattgaacataataacatgtttttattcagaggaagtgtggagatgagtcatttcaaatagagagtgatttctctgatgtagggaagcccttgtcgcttgttagtcattatgcattaaccggtgcctggctcacttggttggaacgggaaggagggccagggccccaaggaacacacgaggggccaggttgccaaggagtagcttacatggagatgctttggttagcagaaaagtaaactaccagtactgacatatgtaagcgattatttaaagataacactattacgttctaataaacacaggccttgggtttaactccctgaatgttcagccgtgtcaagaaccccatcagggcctttgtgagtcagctttccctatccctcctcttgtgcgaacagcttgttccccctcccccaaccacttacaatccaagggaccacactgccaagattccactggcatcaagggatgttacccccacaccctctctaggactgccatctttgaaggggtcattaggtactcctgtaacatacacagactatgcaatatgccctaggaggcttcggtggtctgtgcagctgaactcaaacttgggtgtatgactccaaagctgtgcctgtccctgtggtcaccacaccctggtagcggggacagttgtaccgtcaccaagggatctgtggagtacttgtcgtcgaaggagagcccccttgacagctacccctttgccctcctctttattttttcttctctcactggtgtttatcaatatttatcttgatttcaactcagcacaaacatgatagacttttggtgattgcatgagtgggttggggtctttgggaaacccaggaaggtgatgaagaacagcatcagcttgctttcctgtgaggcatgaaagctggtcttcgtgggtgtgacttgagaagttgtgtttacttttcaaaactgcaggaagaaggaacacaggacaaggtgccttgaaatgacatctccttctattcatgcgaccccctgtctgtcccttctgcctgtttgtttaatctggctgcctagggctttcagtcctccggcctccagtttcaggagtttgctgaggagtgagggttaagtaatttcttaggtggtgacttcaggcgagctgggggaaagaataaataagggctagattttgtaggttaaatgtggcatagttttaaaaagtgtgtgtgtgtgacttggacataggtatccactgaatgatcaggttctctgagacatctttctaaccccaagatgacagttttaaatatagagaaagttggcagtcaggctagtggggtccatgttggtatgactgatgtgggatttcagtgttgtatttggcggtaactgcctcttgcttctagagctcttgttggtgtctggaaattctgtgactgggaattctgtgacttaggcctgtttttagatgcattcagacagacatccactaagttctcttgctggaatacacttaagaatgcaatagccacccctgcccaacccccgtagctgctttatagagctttggtagcttgttaaggtggcaggtgtatggtgtgggtacatgggagatgtctctgatccttccaggttctgtgtggaaacacaggtgctcttcacgacagatgcaggttcacagctcctccacacgcaaccttccaggagaacatgagaccatatcaatatttccctgaagatatgtggagtatggtgattcgtcagccggtttggtgtgacaaggtttctcatagatgcagtattcattattgcaagcaccggtcaccgagagctcatttgttataccctcaggcccagtggctgcttgtgtcagctctggagccaacctcagacaacgccatgatgtgtggtagcgattaagcatccgcttaaccattcatttccctgggtttcggtgatctgatgaagtggttccaccaatggaggctgacttggttttaaaacttggtgtgagcttcgtgcgttgaatttcaagccattctcttagaaggcggaacgagagattacaccagacttctcccagatggatgaagaatggtgtgttattaatttcatatttcttcttctggtttctataaacgataagaaaacagcagactgattgaatgggaatgaaagttctaagaggaaagagatgtctgtgtgcactgctcttccagtgcttagcaagaccttgcctgatttttctcttagtaggcatttgggctctcatgagtctttctgccagaagagaggccgttaagtaaccctgaggggtgtgtgtgtgtgtgtgtgtgtgtgtgtgtgtgtgtgtatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctaatctttagttggcttggtccttgttcaagtttcaaccatcagccctttgggtagaggagctaagtaagttggataaggagcacttagctttctttcctgcacatctgcctcagtaaaaatccgttgtcacattgggttttaaaggaaccagcattgatatattctggtaatgtcacggtagaattctcaagtgtcttccagtctagcaacagtgcctcagtttgccaaagttgagaaccacctcttcaatttaaaaaaaaaaatttttggtgttatttttcttcctggaactttcctgatgggcagagagagagtgagaggtcattagacacaagctaggtcctggactctgagacactgggtggcttgcagctctccgctgcttcgtctagccgtcacctaggtaaccgacactctgccagcgaaacagtctgtccacagtgaaaggaaataaaaacacaaccacagtgttgattctttgtatgctgtaattttttttttttaatgttaacttgatttcaaaagaggatttgccacttctctgttgggctctggcccctgtgcccactgtgtgaccttcctacttcctggactgcatatctgtttttatcacgtatttctgtgtgtgggggaggcagggggaggcaggaaagctaaaagagaaatgaagttttcattcttgaatgagtcccaggaggggactgtatttcacataagtctttatgaacatctagcaacttctacaacttatttggttcggtttggggagtgtttatgtttttaaaaaatgtcccttcctgtgggggtgtttttccattgagtgcgctctatttccttagttactgttgctctgttatggaagtgtttcaagacggttttcaagtgcagtattaaattaatttatttcctggtgagtcctgcccatctttccaggataaatagaacaccagagtaggcatgaatgtgtgtgtgtgtcggtctgtctctctctgtctgtctgtgtgtgtgtctgtctctgtctctctgtctctctgtctctctctgtgtgtgtctctgtctgtctgtctgtctctgtctgtctgtctgtctctgtctgtctgtctctgtgtgtctgtctgtctctgtctgtctctgtctctgtctgtctgtgtgtgtgtgtgtctgtctctgtctgtctctgtctctctgtgtgtgtgtgtgtgtgtgtgtgtgtgtgtgtgtgtgtgtgatgcagtgggctttctatagaggttgtgagcttgtatgtgtggttcaggctgagcctgtgaccttttgtacttggtaagtctcctccttccttgatcattatcatcatcatcattattattattattattattattattattattattattaggtttttaggtttaaagaactaccccccaggctcggaagctgtgggaaacaggaggagaggagacctgtgtaagttgtgtttctccctccaacacattagacatctgggctggttaacctctgtaggatactttcttttccctgtagtcttgataagtaactcttgcaaactacccgttcagaggacttcaagccgactgcttctaaagggcttcactggataagacactgtgaagtgtgaccacaacagcccctcatgtcttctacctcatctgcactaggggacggactatcgtcccccacccccacatgcaggaggatcagggctaagcagagctgaagactgcttctccacctggtgcatagatagcactgtaagctcaaggctcggggctcggtttataaatagagacattttctggacccttgcatgtgcacccgtttgctttgtgtgaggcacagtacttaggaagcattgtgttaaataaacaattattcccattcagtcaaatattcattcaatgagtgtctcttcactgaacacctgccaggcaaaggtagtgctgtgcgtgcggaggaagttcagagactcaaacagtcaatgcccttgtcctcatgacacttacagtagtgagagaagtgtatgctctgatcaggacccccgtgtggcatagactgagtcaagtactagcaaaccagatgacaggccagagccaggctctgatctccttataggaattttttttcatatgctctcagctgttagtaaacttctgtgtttataaagctctctattcatgtcttcagactgttctttataaataaatatataacaaattatatattctttatatattctaaataaagatattctttacatattatacatacaataatacaattaattaattaatacataatataatacattatgcaatatacagtataccttttataatatattatcacataccacataataaatatacattaatattaataatattagtattattaataataacagtcttacgttgctgtaagtccactggttaattttgccctttgctccctgtgcttctagggacatagaaaacagaacaaaaggcaatgttaacaaattctaagtgtctcatagttcagcctttgctgcattggggattgatttttctgtgtggtgagagacaggtgtgtcgtttctttcatctgaatatggatctccaggtttctcagtaccttttattgaagagactgatgttttcttcagtgtatgcttttgtgcctttgttaaagattggctggctgtaaaccaaccctgggttctcccttctgatgcataggtctgtgtgctatttcatattgctgcaacgctgctctgcaatgtgaaatttgggtgtcttgatggttcatggttcacagttgctttgcaattgaacttaggatttgttttaaaaagatttgatttttgtttgtgtgtgtgtgtgtgtgtgtgtgtgtgtgagatgggtttgtgtatatccaaagaagtctgaagagagaattggttacctaggtgctgggggcgctggggttacaggcagttgtgagctgctgtgggtgctgggaactgaacttgggtgtcttggaagagcatcaagtattctcaactgctgagccatctctacagccctggatttggaatccatatggtagttacatataaatttagaattattttttctatcgctaggtgtaataatattggtcttttcatgggtattatacttgatctgtacatcatgttggacagtatgataattttaatgatagtaattcttttaatccatgaagatggctattttttctgcgtgtgtgtgtgtgttcacttcaatgtgcttcatcagagttttgtaactttatattgtagtgattacttactttctctgttaaatatattgcttcatgtgaggcccacactctgacgtcaggcaccgaggagagtcatggaggcttggcattgggggttggggagagataggaggaacttcaggaacctaaggcacacttaattcaccagcccacgggtcacaaggcaagtagctgctggggctggcatccgggcacatggtgtcacacatgggccacacacaggcaggcataagcacaaacacagattggtacacaggtcacatggaaatagacaaacacgtgtgcaaacaaacacacaggcaggctggcagaaatggaggggaaaagcttaggtctctgacctcaaggccatatttatacaaaattcacacagaaatgacattctgggaggaacagttacacagcagattacgtcactgtttatttttggggttccccggatatgtggcatcagtcgtactgctcaccaggtgtccacatcagcttcaccttgtccaaacataaactggcccttcctgctttctgcccccaatactagttttctttcctttccctttccttttccttttcctttcccttctttcccttcccttccctttcttccttcctctcattcttcctcccccttctgtttcttgtagtcttgtttcttgtgagttggaatatttttatttctttcccagtgattttactttgatgtttaaaagttgtccttatttttataagaaataaggatcatttcgctctcagctttaccaactttatcagttctagcgatctttagtagagtatctgtgttttcctgctgataaaaacccaggggggctggagagaaggctcagcgggtaagagcactgactgctcttccagaggtcctgagttcaaatcccagcaaccacatgatggctcacaaccatctgtaatgggatctgatgccctcttctggtgtgtctgaagacagctacagtgtactcatataaataataaataaataaaaccttaaaaaaatagttttctcgggctggcaagatggcttagcagttaagagcactgacggctcttccgaaggtcctgagttcaaatcctagcaactacaggttggctcacaaccatctgtaatgggatctgatgccctcttctggtgtgtctgaagagtgacagtgtacttgttatatgttatatatatatatatacacatatatacacatatatacgcatatatacatacacacacacacacacacacacacatacaaaaacaaaacaaaacaccaggtattggcaagcaaggatgtttgacttcatttgtaaattagacactttggcatttttctctcgcctttttccctccagctagaacctctgatgccatgttgagtgggagcagtgttggcggaggtgctcgtcttgttcctagtcttagataaaaatgtttcctcctttcccattggtatggcattggctttatatcagtcttatattgtctgtttatgctggtgtgttccttctgtacctaatgccatgaggagacacttaagtttatcaaatgctttttctgcctctgtttaggtagttgtttggatttgccctcatcctgttggtgggatgtgccatgtgttttgacatctgctgagtcgtcttttatcccttggttaaagctccaccagatcatagtgtcagagtcacttttaaaaattgcttcttccagagcttcactgtacgttcttatagggctgatggcagctgacatgaattaaaggcggccttctaagatcttgggatccaactttgggaaattaattccataagagcgtgagttctaagtagcccaaggaaagacacttggagattgtggtcttatatctgttattagagtggctcggaaaatggataaagcatttgagggttgtgagtggggttccccctcaccccttatctcagtgttcacagaaaggtcatagtcaggcctgagttggttttcgtttcttagtttctgtaggcctgttaatctgctgctgtgttgtttttgtaaaacaagatctcgatatgtggctgagtctggcttctatgcctgccctgcctcagccttcccggagctcagatgacaagtatgtaccaccacccccagctagtctatttatcttcatggttcccaaggtccttaagaaagtgacttatttctttttaatttcagcaagaacagaagcagagcagagaccagcagatctgagcagactgagagcccttggtgaggctgagcctgctccctgtgtggaagatgccggccgctgcaaggctgaggcgcccttcgttttgaggtgggagagcgggtttcggcaggacagcttctccgttcctgacctcaccatggcttcaactctctggctggatggttgatgtgactgtgtgtccccacatgctgtcggactgtgtgacatccgggtagtgcctgctcacagggtgtgggaggacagccagtgggcatcagatgctcccaaaagccggaccagcagagtgatggacttggacaggctaagatggaagtgacctgaggcctcgcccaggcagtttcttcacaacaggacagctgaagaattgaaacacaggcttgtctggggagcagtatgccggaagctggttttcaggccacaaatgcgttcacaggtgagagcactgtccacttaattgggaggctttgatgtcactgttaggtcgtgggtaacaagatagcaaacaatcgtatacagcatggaggggtgttcaaacttataatctgaatgctgttgggagctaagggctcaggctgccatggtgacagattttgaggaaataattgtatatgccaccttctctaaatagggctgtatcattaacagaacaatgccttagtaatttttttaaaaaagggataggaaagctctccaaggggaaatggattgctgaccagtaaccgttcactttccatctctcctttccatcctcaacttgaatgccgtggtggggccatggtggctgagagaactttgcacttaggattacccacttgtaaatgagcaagcaggacatgagcatttactgtcgattttccctgctggctgtctgtttgcacattttacaaggaaccactgtactgggctagtgctggaaccatggcctgagatgatgcagtaaccttggatgctgaattctggctcttttctgattcacttagcatccagcgggaaatgacttcctcttctgggcttatggtggatccttgtttatttggaataatatagaatatagggaaaatgtttttatgtaaaaataaccttctaggatggtgaaaagtatttttatgaagaaagaaccctttcctttgtgtgttttactttgaaggaacgatgagagaaatagttggagtgtgactgtcgctgtccctgtgagtcttaaacttttcaaagagtaggttggttgttgaggtgcctggaaaaaggggtcaaggctcggcattgagagccacggggactctttcctggctgatcttaaccccttaacaagaccttcagttcctttctgtctctctgtgaatgaatcgccccgctgttctgctctgaggaaggctaagaacactggcaggagatgtggagtccacagagttctgttgtagagttaggtggccaggctcagccccattctcactgtgggaacatgggttaattccaaaggcctcagaatccttggatgtaacctgcggagcctgaactaaaagctcttttgtctggagcagtgatgggggaaggttatcaccaaatgatcgtgaccaaaatgagatttaagcattcactcagaagacaaagaacaagggtaggccccttagcactatcttcatcagcttcggcagcaatcccacctggccttctaattactgtgtaggccaggcatcttcggttgttttgatttcaaaacctgcttatttgtggatgtcatttcacttcctgtggtgggtagcgacttgtttgtcacctagcttccttgatacccagaaggcaactaaggacgggaggtatgtagagatatgtgtcaagagcgtccaaagagccgttctgagaagaagaggggacaaggatggaaaggggagaggaactgggacaagaggaagagcatgggttcatcaccccagcctagtccccgggctggcccagaggttgtctctgcttccaaggctgtgaacagttcctatagctgctgtttccttcctgactcctgaggctgcttcgatacctgccttgccagcctacacagaccactactggttccttgtggtctccacttaggcacatccagccctccccactcctccatcccaaggacaaaggaagtcagaccaacctggggttctgtgtgaagcaataagcagaaccccacacattcgacctagagaatcccagataggtaacacagggctcttcagacatgaaggcccacgtcagtaatggcggctactgtaatttctagctgcgtctgctcccggtagctccctccacccaccacagccttgttccgtccattctcaggcagctcctccctcactctcattctcttatctcacccttttctcaggaactctatttctttatccttttatcgcttcctagttgtgttggcctgcttcaagaacaatcacacgagacctggggatggaacacaggtcattagccttggtggcaaactgcctttgcttactgagtcatcttggcagctttcagtgactttttttttttttttttttggtcttgtagggttctgtttattttttctacctgccgtgagctctggggacagtacacacagtgtggcttccaattagtccccaatatctctgccaatctgtgacttaccttagagacaaaagcaggaacaatgtccaatctaattaccttgggcactctgaacctctggaaaatgtcttcttagctaccgtggtagctgttttctgcttggtggggaaagcctcaacccatccagagaaagtatccacaaacacgagaaggtatttgtaaacatatttttctggcttaacttctgtaaaatcgacctaccaatatactctgggctgttctcccctaggtcttttgccctgtttactgttggctgcagaagcattcacttgctggcattccttacactgttctactatgttcctggcccagaatctgaggtctattatatatactttaggtcccttaactgttggacaagctttttatcccctaaatgagtcagtccatctgtgcatttggcctagtaagtcttttgcttgctttctggaaagtatagttctctcatcttgtgtgcaccattgtccttttttctcttggtaatagttggtagggtggctagcaatcggagtcctttcttcttctatatattttaagcgaagccatcccttagtccagtcccattttccagcaggtgtgtttttgcaggcccataagcgggataggttcctgcatagccacttctcaagccacttgattctgcctggtcattgtgccagaccactgagtttcttctcctctgatgtactgggcagtgaataatactcacagttgctgacttcattagggcatccaagaggtccaagatttcttgtttgtttcctctgatgtgagcagtcctctctcttggcatatagtcctgtggacgcgggctatggcaaaggcatacctgctatctgtgtggatgttaattttcttgctggctccaagttccaaggccttggtgagggctattagctcctcttgctgcattgacatgccactgggtagaggttgtgcccagatgacatttgtgccatcccccacaggaacacctgctcgtccctaatctttatggagaaaactgctcctgtctgtaaaccaggtagcctgcctgggctttcagcaggttagttatggcctgttgggcaggaagtgtatctgggcccccattttggagagtatgtctcaccgcaacagagggtagggacagtctggggcaaccctaaatgaatgggatacctggcccatccctaggtccactgttctttgggtagtccatgaaagcgttttggtggcttttttggacccgtgatcttttcttggaaacagggccatcggcttgaagaacccagcgttgagctgtgtccgccaagaattgagtgggtttcccctccactcacagagttagcctgggttcggggagtgagtccaaaccctgtcctctaatcactgtcttcacccagggctaagacctttgccttttgggggcacttttcccaaggcctgggacttcctgctcctgacttctgtttctagggcacttgagcccagtggcctctctcctcgcagtatacacactggtccttttcaaggggttttctgtctatcttgggttggagtctctcttctctgctttccctaactactgtagcccggactctctgtcaacttttcttttttttcttttgttcaacttttatattcatagcctttcataccctaaaaatatcattaatgaatatttaatactatccatagctgagaattctatatctaatcttgaatattaaattgtttgaaaacatgcaaaatattccttgggaattaagcatagtaaaagagcataaaatactagaaatgaatcattaagaaatgtattcaaaagcccttatatgataccacctgacatactgagagagtatttaaaattcattatatatctgtgtacattgtctaacaatcagtttatttacagaagattatcagcggttctaggagagaaattattttatcagtaagtatactttaaaaatttcaaaatagcaaaaacactttaaaagttaaacattaaagaaaatgctaatttcaagcacagtgagaaaaattatcaataatatttccatgtttgtagaacataattttaacattttcaactgttaatattcaacagacagaataactttttaagatatatttcattgttatctctccctttccatttctgattttattaatttggatattgtctctgtgccctctgttagtctggctaagggtttatctatcttgttgattttcttaaagaaccagatcctagttttgttgattctttgtatagttctttttgtttctatttggttgatttcagccctgagtttgattatttcctgccttctactcctcttgggtgtattttcttctttttgttctagagctttcaggctatgaagttttcctcttagcactgctttcattgtgccccataagtttttggtatgttgtaccttcatttttcattaaattctaaaaagcctttaattttttttatttcttccttgaccaagttatcattgagtagagcattgttcagcttccatggtatgtgtgctttccgttgtttttgttggtatttaagaccagccttcgtccgtggtgatctgataggctgcatggattatttcaatcttctggtatctgttcaggcctgttttgtgaccaattatatggacaattttggagaaggtaccatgaggtgctgagaagaaggtatattcttttgctttaggatgaaatcttctataaatatctgttggatccagatggttcataacttctgttagtgtcactgtgtctctgtttagcttctgattccatgatctgtccattgaggagaatgaggtgttgaagtctccgactattattgtgtgaggtgcaatgtgtgctttgagctttagtaaagtttcttttatgaatgtgggtgcccttgtatttggagcatagatattcagaattgagagttcatcttggtagctttttcctttgatgtgtatgaagtccccctcctcatcttttttgatatcttttggttgagagttgattttattcaatattagaatggctacttcagcttgtttcttgggaccgtttgcttgaaaattgttttccaactttttagtttaaggtagtgcctgcctttgaattgtttggaagctgaagctcagttgactgcagcctggctatgggaagaatgggtggctctgtagctgtgttggaataaggaaggcatcacttgtgtgtgaaattgaagatggcagaaacctaggagccctttcactttacccccgccacatggttagaagtcaacttttccatcttttgtgctgagtgaatgtacctctacccatagatgcagatcaccctcccactggtgtttttcttgggcttatctttgtacataggaattgacatattgtctttaatgttctcagaacatattgcttaattatcttagctgcttagatgatacttggtagaaaaaaacaaaacgaaacaaaaaaacccggaaaaactctacagtactggatgattttgtgtgtcagcttgacacaatgttgagagccatcatagaggaaggagcttcagttgagaaaatgcctccgtgaaatccagctgtaaggtattttctcaattagtgatcgatgggggaggacccagctcatggtgggtggcagtccctggcctggtgtcctgagttctataagaaagcaggcggaggaagccaagggaagcaagccagtgagcagcacctctccatggcttctgtatcagctcctgcctccaggttccagccctgcttgagttcctatcctgacttcctctaaggatctcagaagtgtaagctgaataaatcctttcctccccagcttgccttcgcattatggtgtttcatcgaagcaatagaaaccctaaggaagacacctccctttgcaagtaacatctgctcattgtaagaatatttggaaagccacagacaagtcaagaaaggaaaatgagttacagatgtgtgcttgtacagatgtgtgcatgtgctgtgtaaattttctttttgttaacattctaacttaagagtctttcaatctttttcctcgagcaaacttctttataaagatctgtgttcataatgcttgttcaactttataagtggattatttagttttagtattacgctatgaacatttttctttataactatgcttttaaattactgcacaataccctttatatacttgacttttaaaatcatatcccccttgttgaatatacataccttttaccttgacgaatatgttcatgcataaaagcccttctgtagacttatttccttaggttaagcccctgagacagaattaaaggtctaaagtagtgaaatttattaaagcttatgatacaatttccaaagagctttggttaatccttgctttggaggctgtgctaacattttgagttgccagttacttgtttacagccggggtgttcagaatcagtggtctgatctccaacattgagctgagaaggagaaaactattgtctgcctcccacacaaatacaagaaactctggagcctgccgctctacagtcaggcccaatactgcaagcaaggttgatcacctccatatttagtaatatgggctggttaaattcttaggtggtcttaattatactgttttgattctttctggtggcctttattcccagctgtagtttgtagagtcaattgtgtattgatgtagaaaataaactcctggaaaataagacattgtggtaaaaacaaagacctggtgtctctgggcagaagcttgctatagtttggagggagttggtaaacgtcctgtcaaaggttgagaatatgtgtcttctctgcctctgagaccgcacttagatacctcagaggtgttgcacaatttttataagcttaagcagactatttcagtgataagaggaaacccatttaaccgtggaaattgatacaagaggatcagatttctgtagaatttatagcaagcctttctcatgcttattttacccataaggaggataagagtcaatttaattctcttcagatagctaaaaggaagctctttatgggtgctggtggccatatgtgcttagctactactgcccaaaatggaaggaattgggatgcctcctctcctctattgtcttttgagtgggtggagctggtcctcctggaggtgtggctagcgttttacacacacacacacacacacacacacacacacacacacacacacacacatacacgagtagcactgttctgaatgcttgctttcgacagcccccagaccttcagcttctggttcttcgaagtagccttcaaggccatgcctttgggaagacccatagatgacttcagcctgaaccttccaaaatggcctggagtgtttctttgaaaagatccttcagactgcttttcaatcaagggcgtgagagaagattcatggacaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaggatttttgcaccgatattcataagggaaattggtctgaagttttctatctttgttgggtctttttgtggtttaggtatcagagtaattgtggcttcatagaatgagttgggtagagtaccttctgtttctattttgtggaatagtttgtgaagaactgggattagatcttctttgaaggtctgatagaactctgcactaaacccatctggtcctgggctttttttggttgggagactattaatgactgcttctatttctttaggggatataggactgtttagatcattaacctgatcttgatttaactttggtacctggtatctgtctagaaacttgtccatttcatccaggttctccagttttgttgagtatagccttttgtagaaggatctgatggtgttttggatttcttcagggtctgttgttatgtctcccttttcatttctgattttgttaattaggatgctttccctgtgccctctagtgagtctggctaagggtttatctatcttgttgattttctcaaagaaccagctcctcgattggttgattctttgaatagttcttcttgtttccacttggttgatttcgcccctgagtttgatcatttcctgctgtctactcctcttgggtgaatttgcttccttttgttctagagcttttaggtgttttgtcaagctgctaatgtgtgctctctctagtttctttttggaggcactcagagctatgagttttccgcttagaaatatctatgaatatctatgctccaaatacaagggcagccacattcattaaagaaactttagtaaagctcaaagcacacattgcacctcacacaataatagtgggagacttcaacacaccactttcaccaatgtccattgctttcattgtgttccataagtttgggtatgttgtggcttcattctcattaaactctaaaaagtccttaatttctttctttattccttccttgaccaaggtatcattgagaagagtgttgttcagtttccacgtgaatgttggctttctattatttattttgttattgaagatcagccttagtccatggtgatctgataggatgcatggaacaatttcaatgtttttgtatatgttgaggcttgttttgtgaccaattatgtggtcaattttggagaaggtaccatgaggtgctgagaagaaggtatatccttttgttttaggataaaatgttctgtagatatctgtcagatccatttgtttcataacttctgttagtttcactgtgtccctgtttagtttttgtttccacgatctgtccattagtgaaagtggtgtgttgaagtctcccactattattgtgtgaggtgcaatgtgtgctttgagctttactaaagtttctttaatgaatgtggctgcccttgtatttggagcatagaaattcagaattgatagttcctcttggaggattttacctttgatgaatatgaagtgcccctccttgtcttttttgatgactttgggttggaagtcaattttattagatattagaatggctactccagcttgttttttcatactatttgcttggaaaattgttttccagcctttcattctgaggtagtgtctatctttttctctgagatgagtttcctgtaagcagcaaaatgttgggtcttgtttgtgtagccagttagttagtctatgtcgttttattggggagttgagtccattgatattaagagatattaaggaaaagtaattgttgcttcctgttattttttttttttttgttaaagttggcattctgttcttgtggctgtcttcttttaggtttgttgagggattaccttcttgctttttctagggcgtggtttccgtccttgtattggtttttttctattattatcctttgaagggctggatttgtggaaagataatgtgtgaatttggttttgtcgtggaatactttggtttctccatctatggtaattgagagtttggctgggtatagtagcctgggctggaatttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgttgttctgattattatgtgtcgggaggaatttcttttctggtccagtctatttggagttctgtaggcttcttgtatgttcataggcatctctttctttagatttgggaagttttcttcaataattttgttgaagatatttgccggtcctttgagttgaaaatcttcattctcttcaactcctattatctgtaggtttggtcttctcattgtgtcctggatttcctggatgttttgagttaggatctttttgcattttccattttctttgattgttgtgccgatgttctctatggaatcttctgcacctgagattctctcttccatctcttgtattctgttgctgatgctcaaatctgtggttccagatttctttcctagggtttctatctccagcgttgcctcactttgggttttctttattgtgtctacttctctttttaggtcttggatggttttattcaattccttcacctgtttggttgtgttttcatgcaattctttaagggatttttgtgcttcctttttaatgtcttctacttgtttagcagtgttctccctgtatttctttaagtgagttattaaagttcttcttgatgtcctctaccatcatcatgagatatgcttttaaatctgggtctagctttttgggtgtgttggggtgccatggactgggcaaagttggagtgctgggttctgatgatggtgagtagtcttggtttctgttagtaagattcttacgtttacctttcgccatctggtaatctctggagttagttgttatagttgtctctggttagagattcttcctctggtgattctgttaccctctatcagcagacctaggagactagatctctcctctgagtttcagtggtcagagcagtctctgcaggaaagctctcctcttacagggaaggtgcacagttatctggcatttggaccttctcctggccgaagatgaaggcccaaaacaggacctttcctagaagctgtgttgctttggcctgtcacagaagctgttagtttcagtagtccacactctcacctgttcagactattttctgcggagtctcagaaccaagatggctcccgcgggtcctgaggcaaaggtctcccgggccggacagacacctgtcctctggccggaaaggtggccggatgtctggagcctgaaaatggcgtttcctcagaagctctgcagctcttgcctgtcccataagctgttagcttctgtagtccacagtctcacctgtgcagactactttctgtggagtcccggaaccaagatggctcccgaggatcctgaggcaaagactgggacattgtcttaattaaaggttaatatgggaaggctgcactggctcaggcaggtattcctgagctgtagaagcaagcaagctgggtgagccaggagatgcaagcctgtaagccatgttcttcaccggcctctgcttcagtgcctgcttttgtgctccctgccttagctttcctagatgatagactctaacctgtaagccaaataggtacttttctctccaccccaaattgcttttgatcatagtgttcatcatttcaacagaaagcaaccaagattggcatcatgcaccatttgtggattagaagtaatggaggcccagagagccctgtctggtggtgctagatttgaaatgcaggactattcccctctcagcactggacagactccatcaggtttggaccagtgtaggccctgtagatgctgcacagtttctgtgaagtcacatgtgtgtcagtcctgttgtgtctggaaggcactgttcctttggtgtctatcttcagtggtttttacaatcttcctgcctcctcttccccatacttacttgactgagccctaagagaggagttttatggagacaattccattcaggactgagtgttttctaaagtctctcactctttgcacattctccagttgtggatctctgtatttgttcccgtctacttcaggaggaagcttctctaatgtctaagcaagtcattgatctatgagtatagcagaatgccgttagatatgattatctttagcatggtctgtctagtctctggttcctggtcagtatcagacatgggttctagctcatggggtgagtcttaaatccaatcaggtagtggttggttactcccataactgttggaccagtattgcatagcacacagacaggtcaggtcagcattgtagattgaagggtttatagctgggttggtatttacccttttccttctgtagcatgcagacagagtaccttccagagcatgaacagtagtcggtaagggtgaaagctctacccttaacaccatcttaacttctttggtttcaaattgatatgcaggtattgttttcagtaaagtggcccctagattggcatagattggcatcctgggtcacttcttaacctgcctgtcccagaacctggttcttcttgggtaacaagtcggagtggagttacagacattggaactggattctggccaagggttgtagtgttgtgttgtgttgtttcttccgtctctgcacttgcctctgtgttatgccagcctgacctgtggttggttctccagggttgcttctgctccatcttggatcgtgtgtacccctttgtttcttagttcctcttcaccaacccttctcttgaccctgggagggttatagaagcttttgaagcaaaaagtctgaccttctcctgtcttgatctgtggggtctcgactcttgatttggggccgacgagaggcttggcattttgattgaggccacagtttctggacatggtttccttccttcatagttgtggccaaatctccatagaggcaggcataaggaggaagaatggactcgcagtgctgaatcattgtcacactcatcgatataccttgaagttgaaaggaccactctaggacgaattgcactttaggagaaatggcacttaggcataaaggggagggaggtgtgtggggaggggctgtgtgagggagagactgggggaggggtgttgggatccagatgtaaaatgaataaataattaatggaaaaactattcccttctcctctggcaggtgacactgctaccagtccacatcaggatttttccgcacacttgcttttgcaaacacagtttccaaggggtaattcgtcctcatccagggacaacagcttattgacaaagcagtggctcattgtcgtcatcaaggcgggttttcaatcctcacatacttaccacctctcacatagaatgagaacatctgacacagttttagtcatattttcagccttaaataacacttttcaaagagagaagactgaaaaacagtgatctttctatcctttctacctctccccctgtttcccatcttcccttgatgctcttggccaccggagcccactttcttgtcctttgtgatccccccctcccggcttctgtggtaaagtgagggtccctctactgttcattgcctcaaaccctaaacctaaaggagccgctgttccaacccagacttgtgctttcattacgagaaccctgttgccagagacttttgtatctggtgttttgtagctggaggtcagttctggcctatggcagattctgaggattgaacttgggtcaggctaacaaggcagatactcctacgcacggagccatctatccttcgtggatagccgttagtaaacgtgctttaaagagtgaaacagggaatgaaaccagcacctaggatgattcggcaacttttccctaatttgacttctgacttgacaaactcagaatgttgatggacgggttagtgtcaagcaagaaagacatggttctgtcacggatgttcttgccgagcatttggggaaagaggagacaagtttatcacatttagaggtgacagattacaaggggttatttacccactgtctgataaccgtcaaaacttagaaagacgacagtatccaaacgtggcagagtggtccccagataacatacagctaatgataataccacatctttatgatgcaatgccgggtagctgtcattaatgacattcgggaagagttttcttgcccttgaaagactcttataatttaaaaaagttggcgtagtttttggggtgcacacttgtgatcccactacttaggtaggagtctgagggaggaagatcttgagttatagactggtcttgtctgcacagtcagaatttgtctgaagagctgataaataaataaataaataaataaataaataaataaatcagcttgccataaaacagccaaaaagggatgtttaatacttagagaatggatcaagcagcattaaaagtagtaaattttacttccctgtatttcctcatttgtatcttcctaatttttcttcactaaagtaaaattggaagctggaggaggatgctcgggtgagagaatccgggtgctccctgctttgggaaagcacgcagactcagcaactgaaagtgatgtttgagtcaagtgagctaaccactgaacagatgaggaaggcaggtgtgaggcctctgaggtccatttccatcttgctgggccagtgtgtcctagaaaacgacctttcccttactttatgagtccagtttagtgatagatcaatgttctaaatactgttacttctagactaatgtcctataaggctgacaggcactaggagattagacatcctcacagagcatcttggatgtgtagttttaagtcctgaacttgacagctcctctggtcattgtttgtactgtaacataggcactgatgtcctccagaagtttctgtgttcgttttttctgcattggcttggtttatttacctcctaaaacgggtacccagatgagcacaggcttggggtacagtgacactgtggccatagcctggtccctatgcttgaatgggatagcctgagaccctatgaatcttctacaccatcttcccacattggcacagcgaagtttcttatataacgttggtcaggcactgtaccaggcacttcatagaaagttatcttaattatcacaaaaacaatttacattcattttgggtgtgaaaatcaaagacttcaagaaacagtccaactctatatcagaattggggtatgtatccaagttacccccaaatcatgacataaacataaagactatacgatcttaaagtaccatgcaaggaaagcaagatataagctaacaagttcatggctatctccttaaacataacactatcacgaccatttcatcttgtccacaaagccctcccatctcccccttctaaaatttcttacatctgtgctttgggcatggaaggtaaggtgaatgagaggagttatgtgtgtagataagaggattttgactgttccaagtatctgccttacctatcgagttttagtgcacacacccctgatgtggaatgtgtgggtctgctggcttgagtcctgagaggagtccaggaggctctctgtaggcctctagccttctgctctccaaaaaggacagttttccttgttgtgagagacaatttcttcctcaactcttttctttagattgagtagtgagcttcctgtcgttccttctattcgagttttaaaagtatgtgtgtgtgtgtatgtgtgtatatgtgtatgtgtgtgtgtatatgtgtgtgtatgtgtgtgnnnnnnnnnnnnnnnnnnnntttgcatgttgaggttagttgtgtcattttacaaaaattgtgcaatatcagtgatggcccaaataagtaagcaattgttttggcatgcattaagccaaaatgttagcttctgttttcaccccaaaggctctcattataaagaaattttgtatgcaatgattagcgtgaggataagaatgcaaacctttctataggcgctacagaggagaaacatctgccccttgctcttagtcattgctaacgggacacatggcaccacagtattgaggaccttcgtgaaaggggactgtactttgtctgaagcctcgcagagcataggatggttttagaactcttgaactcttttttttattatttttaacatctcagttcttcacagacgataagcttcacgagagaatatttgaggtaggtgtcaggatctcttaaagtgacagagcagaagttgttttctccattagaagtaagcggtcagtggaaatgtagataattcctggattcaaaggaatgctaccttgtataaactgttgttactctttataggctggagggatggctcatcagttaggagtcctgcctcttctttttagaggactggtgttcacttcccagcatccacatgtcaagtcgcagctggctctgattccagctgcagaggatctaagccctgcacttacacgcaggcaaaacagatctactgaaagtagacatttgttattcgacgcgttctcacgaccggccaggaagaacacaacaaccagaatcttctgcggcaaagctttttattgcttacatctttatggggccagagtgtaagaagcaagagagagagaaaacgaaacccctttcctctttaaagagaacaacaattgcctaggacgcatcactccctgattggctgcagcccatggccgagctgacgttcacgggaaaaacagagtacaagtagtcgtaaatacccttggctcatgcgcagattatttgtttaccaacttagaacacaggatgtcagcgccatcttgtgacggcgaatgtgggggcggcttcccacagttcccccttttctattaataagagcaaataggccacccatattaatgagagtggagatagaggtcaaatccccagtgtgtaggtaaaggaaccatgtacaggattagctcttaggctcacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttaaccttgcaactctctcgggctgctgaagcacactcactctatctcgtgcaatgagactagcctcgtgagatataagagctgagtggccagcgacctattgcctaagcatagannnnnnnnnnnnnnnnnnnntgtgtgtgtgtgtatgtgtgtatatgtgtatgtgtgtgtgtatatgtgtgtgtatgtgtgtgtatatgtttgtgtgtatgtgtgtgtgtatgtgtgtgtgtatgtgtgtgtgtgtgtgtgtatgtgtatgtgtgtatgtgtatgtgtgtgtatgtgtgtgtgtatgtgtgtgtgtgtgtgtgtgtgtgtgtgtgtatctgataaagtacctgtacttttgcatcaaatttcagtgtgtgttcatagaattacagggctcaggaaatagctctctgatagaacatttgcctagcatgcgtgactaagacctgaatccatgccctggcatctcctccccagtactgagaacactaggaatttggagttccgctgctgctgactgctttgttacaagaaaccaagggtccctataaattaagaaacagaatgaatgttggacggtggtggcgcatgcctttaatcccagcacttgggaggcagaggcaggcggatttttgagttcgaggccatcctggtctacaaagtgagttccaggacagccagggctatacagagaaaccgtctcaaaaaacaaaacaaaacaaaacaaaacaaaacaaaacaaaacaaaaccaaaaaagaaaagaaacaaaatgaatgatactacttgggcattcctttgtggaatgcttggtatcatgcagatccacagaaggaagacaagtgtcctctttgtcccttggtttcggtgacacatgtctcagtagcttactggagaaggtaacttcacctttatgttaaacctgcctactctcaaattcccagacttgcttaatcattctgttggcctctggaaagcagagaccggtgcgggggtggggcagggctctggaatcttgacagggtaggaggcagacctagtcatgcaaggcacagttagtttctcctgatgctgctggccggccggggggctgactcacacccggaagcctcttgtccccagtgttgggagacgtcagcatgctgctcccgttggacgccaggtgagaagacttgggagggattgtcaggaacttctgcacactgacaggatgaggcatgtatcctccacatgatggctgtgagaggaaatatggttgttatggtgctaannnnnnnnnnnnnnnnnnnntgtcctctttgtacccttggtttcggtgacacatgtctcagtagcttactggaagaaggtaacttcacctttatgttaaacctgcctactctcaaattcccagacttgcttaatcattctgttggcctctggaaagcagagaccggtgcgggggtggggcagggctctggaatcttgacagggtaggaggcagacctagtcatgcaaggcacagttagtttctcctgatgctgctggccggccggggggctgactcacacccggaagcctcttgtccccagtgttgggagacgtcagcatgctgctcccgttggacgccaggtgagaagacttgggagggattgtcaggaacttctgcacactgacaggatgaggcatgtatcctccacatgatggctgtgagaggaaatatggttgttatggtgctaaggttgggcaggtgacaaatgaaaatggatttgagtccttgacctctgaacaccagacagtgatccagcaataaaataaaatgactgtttatagcagcagtctaaggccagggctgtaggccttggctctttgaagatcactataaatttaacatgacagtctgatatgctgtgcattcatctaagacgtgaagaacatggcaacacggcgatgttgattctaagattttcttttgatttttcttggcatggtattttagacagcccaagaattaatgtgaaagaggacacgggctctattccccctctgtgtttcctgcttgactcaaatgattgaacacagccccagagaatctgtgatttctgctcttacaagaggcacacaaatatagcatctcgtgggaaaaatataatcctcctccaattaattgagtatgtgattatctggggtaaatctgaccagtgctacattacacctccagtgctaagccttgcattggcactgtaattggatgcaacgatgaacaaggcaaggtattgtctcagttcattacttacgttaatgactttttaggtgttttttcacgattaccccagagtaacctagtagagctatatcagtgcaagttctgacctccttcagagccagatgaacatccacagctcaacgagccactgcccgagaataccgagaacgtaaaagattcaatctccttcctatatatcaatgataaatatgcttcaaaacaaaacaggaaacaactcagtcacattgcctctccaaaaaaaaaaaaaaggaaagtatgactttagaatacactgaaagaggcttataaggaaaacttcaatgttcatgtgtcacaaaaattaatattgtgagcatggttatactatcaaaagcaatctaaggattccacacaatttccatcaaaattacaatgtcattcttcacagaaatagaaaaataaatcttaaaatgtatatggaggcaaaaaggagctcagataaccaaaacattcctgagcagcacataaaatatgttctaggcaccaccgtgtctgattgtaagttattacagagccatagaaacaaaaccatcacggggctgcggagataggtttgttggcagaagtgcttgccttgcaaggatgagggcatgagcccagaggccaagcaccttaaaagctgggtgtggcactgtatgctggcagtgaagagccaacaacaggaggatcactgagtcttgtgtgccagctggtctggctgaatctgtgggctccaggttcactgagtgaccctgcctcaaaatccaaggtagagagtaatggaggaagacagttgtggcctctgtatgtgtgcatacatccacacacaccacacacactacacatatgctacatatacactatacacacactatacacacacacacaaccacacatacaccacacacaccacacacaccacacacacatacacacacaccataatgccacacacatactgcacacaccacacatactacacacacatacacacacacaccacacacacacacacacacacacaccacacagtgcatacatacagcctggtactagcaaaaacacagacatgaaggtcagtggaatagaataaatgtaataaatataaacatagttgcagaaatgtgattgttgacaatgatgccagaatatacattggaaaaaaagacagcccctttcatagcccttgaaacttgtaatgtaatcatatacttttaggctgggaccccattgcttcctagaagttaggggttcaataaatattaagtagtttgattgagtgaacctttaagggctaatttggcagtgaatataaaaatataaaaccaggacctgggggaatggctttggtggaatattattctagtatttgtgaggttctaggtttgatcccggtgccataatacatgtgcatctatatgtgtgtccagccattgagagtgatcaaaaagcatttatattttggtagtggtgtgatggggcacactgtcctattcagcaggtggagcatggtgagtggcttagagttccacaccgtcagatatccccagtagggcaggtctttctaaactcctcctcactaaaagttgggtgtcttagttaaggtttccattgctgcaaagagacattgtgaccaaggcaattcttataaaggacacctctggcttacaggttcagaggttcagtccattatcatcaagttggaagcatggcagtgtgcaggcggccagcagtggcactagagaaggagctgagagttctatatcttgttctgaagggatctaggagaagtctggtatcctcaggcggctaggaggcagctctcaaaggtgcacttcaacagtgacacactttctccaacaaggccacaccttctaacagtaccacttcctggaccaggtatattcaaaccaccacattgggcaagcattttaattaaggtagggggttaaggcaatcgtaattagttaatttaaggcattcctccctccgtttccacatctacagaactggcatgtggcttctagttgcttgaaggatgctgattgtgaagtgttttccttctggctcaggcgtgaaggtgcttgtgggaccatgattggcagcctatttaggttgaatgaggcttgctccggtgacctactagaagactctacaaggaacggaaaagcaagccacattcccagagtcaggtgcctgactccacagagtccccaactccataattctgtgactataagtcacacagacaatgtcccaagcttctggcattctggctagactccacccccacagttacctgactatagccaggtatgctcctccccacagttacctgatagcccagcccactataaaaggagctgcttggcccctcctcgctctctttaagctctcacctttcttactctcttctctagccctccttctctctctcccttccctcttctctccacgtggctgtggctggtctccctctttctaccttctctctttcccctgcctttctacaataaagctctaaaaccatagactgtctctgctcatcaaggcccaccatgcttgaacgatgggatagtctttcctctaatgagctgcatctgaccccctgccggaaggccttcctgtgctccagccactgactggaccaaggactctcgcccgcgtaggaaacacccagtgccccctctccccctgccctttcctgccctcagccacgagactgactgagccgccccccggggcccccattctgttctcagctcttccgtggtgtccagcggtgtctgggatgctcaaggctgagaacctggtacccaagactgccccttgctcaccacccgctgagctggggtccagtggcttcacacagttggacacccaccctgggccacatggaaagcctgcagcagtccttccacatccgtccacccagagcaccgggactctggcgggacgagggttttctcccactccctctttcccccacaccactgccagcagatgctcattacatcttcttttgacttgccctctttcttctgttccttttccttccttcctttcttatctcccccccccccttggtttttagaatgtttgtcttcactctgtaaattctgtgctgagtattaatgcttttaagcacagaaaattaggttaataatgaactcactgctaaaagtgattattattgttgtttaattttcattgctgggatcagaaaaggacttgtgtatgccaggcaggtgctctgtgctcgaccattggactccagcccgaggactacatttgaccatgatgaccgttgtctttcagcatacacagagagctctgagttcagacggtgaacctctgatgggctggattctacgtcttttctgttgtagcatctttgtgtagctttgcttcagactccggagtctctttcttagcctgcttagtgctggggacagacctgtgctaccataactggtatgctttatccttctgacatgaaataattacactgtttctttcactaaggagataactggattatctttgaggtaaacaggggaccacacctcacatagtaagtggggggcatgtagaaggtgtgggggggggactgctcggagggtggaaagtcatgtgagacctctgtctctgtagggagtgtgtgtaaattcttgatgccctctagggatctgtccttgaatatagatgattatttatcatatcatttgtggttatcctatttatagattattaaataactgcctcttgcttattaatacatgtgggaagacttttagctcctgctagagcaaactaccaagccattatatcttatgtggaacttaaacatgtcgaaaagtctgcgtaaaactcaaatttcatcactagttctggaatatttgcagtttttgcttactatgtgtaatgttcgctactgtatcataatgtttgtttggaaacaagttctcagtatgtagcccagctgcctcaagtatactatgatgccccagatcagtggttctcacccctcttaatgctgtgaccttttaatacattttctcatgctgtggtgaccgccaaccacaaatttttttttgttgctactctataactgtaattttgctacaattaggaatcataatattagtctgatatgcagggtatctgatatgtgaccccctgtgaaaagggtcaacacccacaggttgagaaacactgcctgagatgttcttagtctatgtccttctgctccagtcccctcattgctgtacttacaggtgtataactgtgactggctctatagtaggtcctcccctttccctggttttgactaaaggcaaaatgacttttaaaaaagtatctggataaatacagaaatattcttagcacaatactgttagatataaatgatatacatttctatagccagctcccaagactggtaccagtgtaaagctggttgtttttagctactaggggattttttgatcaatttgtgcttgaatctgcaatctagatgcatttggctactgtgctggatagttttatggcaaattggcataagctaaagtcatccataaaagagggctacaggcacacctgtaggacattttcttagttgatgattgaggtgggagagcccagccctttgtgggtggagccatccctgggatggtggtcctgggttctataagaaagcaggctgagcaggcaatggggagcaagccagtaagtagcaccctccatggccactgcatcagctcctgcctccaggttcttgccctgtgtaagtttttaatgatgagttgttacgtggaactgtgagcaaaacaaatcctttccttcccaagttgggtcaggtcatgatgtcgcctcacgacaatggagatctaactgagcaagggactccacattaactcagaagaaaactccctttatataagggaagagcagatttaggggaatgaaatgaaaacctaagcatttgacaggtataggaaatgcctcacttatttttaaactgcgtgcgatagaacctttaaaactagcaagacacttgctaattgcattaagaacttgtcaagacattcttcacagatagcaagcagttatttttccagatgaaatcaatttctttattttggcatggaactgggggttgactctagagccttctacatggcaaccaagtgcctcacggggcaatatcccagcatgcccctccccattccctgcctttttaaagcttcatttttgaggtagtattataggatggacagcaatccagattgtgcctaatgagatttccaggctattgtgtcccagggatacatgggtaatgattgatgagcaatttccaaatgcagtcgctggaaattgaggagaaacaagatgtttgaatagtatcaaatcatttcaaatactcattaattttaaaagtcaaatgccagcctgggaggcagtggtgcataactttaatcccagcacttgggagacaggggcacgcagatctttttgagttcaaggccatcctggtctacagaacaagttccaggacagccaaggctactccaagaaaccccatcttgagaaacaaacaaaacagtcaactgatgattccaagtggaagaaaccagtagacactaatggcctccccaaatgttctggagtgagtccagatctcatactcctttgcttatcctgaggcttcctgggctgtttgtctctgtccaaccctagctgcaggggacaggcctggtgactgtggctggcttctttgtacttcctgctccagagcaccaactttgtacaggcaggacagccatccccgtggacggccatctccccagccagccccaattcagtgcactttcctggaaatatccaatgctgtcatggtgtctgggagtgttccacacaggttttggcctaaaggcctcaggtcgatctatacagcacagatgtttgcatgttgaggttagttgtgtcattttacaaaaattgtgcaatatcagtgatggcccaaataagtaagcaattgttttggcatgcattaagccaaaatgttagcttctgttttcaccccaaaggctctcattataaagaaattttgtatgcaatgattagcgtgaggataagaatgcaaacctttctataggcgctacagaggagaaacatctgccccttgctcttagtcattgctaacgggacacatggcaccacagtattgaggaccttcgtgaaaggggactgtactttgtctgaagcctcgcagagcataggatggttttagaactcttgaactcttttttttattatttttaacatctcagttcttcacagacgataagcttcacgagagaatatttgaggtaggtgtcaggatctcttaaagtgacagagcagaagttgttttctccatttgaagtaagcggtcagtggaaatgtagataattcctggattcaaaggaatgctaccttgtataaactgttgttactctttataggctggagggatggctcatcagttaggagtcctgcctcttctttttagaggactggtgttcacttcccagcatccacatgtcaagtcgcagctggctctgattccagctgcagaggatctaagccctgcacttacacgcaggcaaaacagatctactgaaagtagacattcaaaagtcttaccttctacgtagttgtttttgctcctgagaccgtaccttaaaggctaagcacgaagggtgagatttatgggaagtaaactataataatgagagaaagtccaatctgtccgcccatgacaaaacaacgacactaatgacaacagcgctcccctgaggccttgtttagtcagagtacattcaaggtgttagacaccttatgtccttgtactgcctctctctttagagataagaacaaatggagtttattatggttctgtgttttaccctgccactggggtgtgggaacgatgctgagcagacgaaatgcacagatggacggctacctcagaaagccttcagaatgagctgggtccattctaatgtcaggagggacactcgttgctccccttgctgctggaagatgccccaccatctgatgtctcaggtatagatgggattcagtgcagcctgatgggaatgtgtcagaaagatgccttcatctaatatgctacccaagtggagtgaggggcagaatagaggatttacgtaaggattccttttaatactatacagagcaaagcacgaggtagttattgagcggaataaacgtcgcttattaataggatcagatacatctttatgcatgtagtaccacagaccttagtcttacgtctgtgtggaagtgagggggtaactgcgtgatgggatatgtaagttgctcattttaatacccttccaccctgtatgtgtgtttatgagtctcatgtgactacttttttatgccctggctcttatttgtatatcattggtgtcctgggatgtatcagaaccagtgggcaggcagggaacatgcagaaattaggaaacagtctaggccgtgacccttctcttttaggccgaagatgctgcagctctgttgttttggcaacactctttcctcctccccatcttcctcttcctcttccttctcttcctcttcctcctcctcttcctcctcctcttcttcctcttcctcctcctcttcctcttcctccccttcctcctcttcctcttcctcttcctccttctcttcctcctcctcctcttcctcttcctccccttcctcctcttcctcttcctcctcctcttcctcctcctcttcctcctcctcttcctcttcctcctcttcctcttcttcttcctcctcctcccctcctctccctcctcttcctcctccttcttgacatttattttattaatcattccattcatttatatctcaaatgatatcccacttcccagttactccctccaccaacccccccacgccagtaagcagcatccctccatggcccctgcatcagttcctgcctccaggttcctgccctgctggactacaactctaagctgaaataaaccctttcctctccaagtgacttgtggttagaacgttttatcacagcaatagaaacccaaactaagacaacatgggagaaaacccaagtgcctacagtacccatttctagtcttggtccaatctagcagaatgttgatttttttttttttctttccgagtctctttctctgccactggcaaccttttttgcctcagccttccttgctttcttgtaactgttcttctgagaatctgccacacctacctcattgtttctttaattgctgtttgtagaattgaaagtatctttgctgatgcagggaaatcagaaatgtgtatattcacatgacccagttcacataggaaaagcttttgcagcagatagacagagagacctgtcagtacatgggcactcaggacagacatgccctgccccagcatgacggaggcacatctctacttgtactggacttacgactgctgaacatcttgagatatgttcagatacgaagccttaagcaataagtcacccagtttattccaacagaaaggctgacgcatacattggtacccactgtagacagaatacataacttcctggctggtagaggaaattgttttcagccattgttaaagtttgctttgattaagaaattacctatatacctcttaaattttaccgaatgacaaatctatctatatatatattcataatttatttaaaattttaacatttattttatgtatatgaggtttgcctccatgtatgtctgtgatcatgtatgtctgtgatcatgtatgtgcagggcccatggagaccaaaagatggctttggatctcctggaactggagttacagatggttgagagctgccaagtgggtgctgggaattgaacctaggacctctggaagattagccggtgctcttaaccacagagctatctctccagctcataatatcttgttaccttattatgtctttagtaaccaaatgtgatttttttaataataaaaatgtggcttatttgtaacatgaaatactttcattatagtcaatgatattttgctttttcaaaagcaatgtattatgtacggttaagcagtgcaccagtcatgtggggcttccattactctgtgcttaggctggggcagggatctggggcagggggggcggcggggggaggtggtgccgggacatcatcagggacagagtggagattatgggcttttaaggccttgattcccaagggacagaaatatccctcttgggctggatggaatctttctgttgtttgcatatatgaacactgctgtagatgtatgtagtcatgaagcttgcaaggccattcttcctggctgatctgggtaatgtatataattttcccttcttccttactaagtaatgtacccgcctttaatgggaagagcactttagtgtgttaggcacaactgcctaagcacatcgaacaggtctaaatgtctcctttaatttgttgccacaacgctgaactgtatgtagctttttgctggtcaatcaaccttagtgacgtgcgcactgctaacagaagtggaagatgacactccagtgctttcttcatgtgtttgtgatggaagggccctccactgcttcctttttcttctccaagtttgtttttattttgtattagtctttttttttttttttttttgcatgtaatctaccctgatgcttatggtcactagtactgtttgaggaggtaagcggcagaaatgagggattgagtatgcaacaagtctgtggtaaaatgaagtggaagataatggtttacttcagtcacatccctgcaaaggcttgggaggagcggaggcagggcattgttatggtaaatgtagttcaaagcgttttaaagctaatggtaataataattaaaacataagaagggggagggggccaaaagagcataaggaggaatgaggagggtggagggacagggtggagatcaaatacagaaagcaccagagaacaggtgctgacaatcagaggagcagcctaaatgtctgttcacccaagctgaatgtcgagacaaaggaattaaaatataaaagggaaaaactaaactgtgataacgttactaatgaaaacgtgataaaattaagatgtatgttgaaagaagagtggctgtcccctttctccttcactgaatgaggctgactcccctgccccctgtgttgtcttttgaagctgactctacaggtgaaaaaggagttcttgttcttcttctgatttaaaaaaaaatgcatgattccttagctggcttgacttcccagctccataggacacacacacacacacacacacacacacatacacacacacacacacacacacacacacacacacacacacacacatacacacacacacacacatacacacacacacacacacacacacacacacacacacacacatcccagaaccttctctctctcgtgtgctgtttaattggatctcctacatgtgctttcagtacccaagggctagctaggtaaggggacagtgtgtcctttgctgctgggtgttttgttgcaaataatctacgcttgggctgatggtcacatctagtgtttgaagaggtgaccaggaggaagggacagaatcaagacaagtccgacatcaaatgaggttaaagatccttgcttacttcagtcacttcccacaaagacttgggaagagaggaggcagggtgctgtggtggtcaatttagtttaaagcccgttaaagctaacggtgataatagttaaaaaggaaaaaagaaggggcccaggtttggcaacagggcatctctcagtgatggtcccctcttccctcccagcctgggacatagaccaacactggctgcttcaaaggcacaatggtcatttgtttgtgtagcattgcttctggggacatccctgtgttgttcacagcccagtgtggcacaaggttggaggaggggtttcctgccccctgctctcagtcagcggtcttaaggaagtggtgctgttggtctaacctacaggttttctgggcttggtttattcatggaggtcctctcttcccttctctagttctcgccttgtttttcagttgtaagccaggggttttcccttcagagccgtggtgatgtaggccgatggctttcctctcagttgcagcttcttcctcatggcagatccgctcctttagttcctgtatctgtatgctcacccacggtgaaagcatagatggttaagtccaggcaaaacacacaaagctcaccctcaaagtccacagactgcttccttctctggtgctgtttgatttgcattaaattgatccaattattagtaacagcctttgctaggcatgtgatgcagaaaaacaaacaaacaaacaaacaaacaaacaaacgaacaattagctttctgggctcaagtgactttgccagtgggctagacagagagacagacaaacagttgatgtaagcatgacgatgcatgggttgtcatgggaacatgatggtagagatgctggggaagcatcctaggtgtgatgtgaaattccatgcacttagaacttacctgctagtgagtcgagacgactatacacaaaacaaaacgctgatttatgattgagtgaaaggtggtgttacaggtaaatgaaaacaaagaacacaggacacggggatagggacaggactacattttaaagttgaaagccttggttgaggatccttcttgtaacctcaatgcttggatttgccctggataagcattggacacaaaagtgttggctgccaatcttagaaggtaacaattttgtcagtgttccaattgatcatcaaactgtcttgaagtctattgtttatcagaaacattgatcgttggacaaattgataaactaggaaatacttaattggcttatatctgaaaagagcatgttcaggacaaaatatattttgttttttgtggagtctgagactctagcctatagtatgttgtcattagtaagcaatttatcccaatatgatagaactccacgagaagaaaagagagtcacatgttgtgctggctagctgtataccaacttgacaagttacagacatctaagaggagggaatctaaattcataaattgtttcataagattgggctataacacacatgtacagaattttcttagtgattgatcgcgccatgccattgtggatggtactacctttggctggtcctggaatctataagaaagcagattgagcaagctgtggggagcgagtcagtaagcaacactcttccatgacctgtacaggagctcctgcctcccaagttcctgcccagtttgagttcctgccttagcttccctcagtgggatatgtaagccaaagaaatctttttctccccaacttgctcttggtcatggtggttcatcacagcaatagggttcctaagacacaaagtccctactcacagtcggggttggtttggatcagcagggaagctctaccctctgctaacactaagaagggtagagtatctgcctttcctctcctgcctccagaggcatgagtacctggtacgggtctccagtcactgcatccctttaatttggttacagacaccagagcccattcttttacactcacaggaattccaacctagagatgaagaaacagttcattttagccaacttcccttgttttgagacaagcagcagtcgtctctcagcgggacatcaaagtatattcatttggcatgttaaggccagttttaattatgtctcagaaagcagaaatttccaagagaggacatttttataaagggtaggtgacagatgaaggacactaagtagacgctacaggaggctcaaagtaaaaaaaaaaaaaatccaaaatccaaaaagataaaaataaccatccgaagtgaagtctagctactggaaccccatggattgatggagagccatctttcttctgagtctgtccagttccagatcagtcagattgtttctatttatacaggaagagagacaggtggagagtttgagtattgagtgttgacacccagttctcggggtgctagaagctgccaagaaaggagctgcaggctgtttcctgagtaagtagtccagcgcgttagccagacaatgggctttctctcggtaacacatgaatgccttactgagagggaacattgtgatttaggaattaagccaggttaattgggaagggacagatgggaaaaagactaaatatttatgacatggtgggctagagaggaaatgattctgtaaataaagagcttagtgttacaaagctgtttggctatttacgttaacattcttttgtgatttgctaatatttttcttttatttcctccttttgtctgcccccccttcctctcttttcacatataataagatatatattttcttagagaagatgtttgtccagctaaggaaaaaaatctcttcacccaaaggggatatcagtaattagtgtgagaacatctctacagctcttgcttcaataccaccgatgcagccactgtttcctggatgtttattgcacataccgaaccatgttctagattgtgggaatgcatcagtaaaactgggcatagaaaagatcctgctgctctcatggtgtttttgtcctggtgtcaagattagagaatagctagacagacaggcagacagacagaacattaagcatatgtttaacaagcgggcaatggagaatgacgggaaaagagggtaacgagagcaagagtctgggttgtgttcactgaggagatttgtgtgaggacataagtcagctgggtgctggaaagatgcgccccaggcagaggaaaaagcaagtgcaggcaagccaacatcctaggattcatgtgcgtggaggtactctcacaggaagagaggaggaaggaagaagggaggggccaaagagctgatagacagctcaagtagggagatgtgaacacttgggagtttccctctgagcaacatgaaggccactgggaaattggaggagagagaactgtcttggcttccattttggtcccgctgatttgtgtctagagggtgggagggtactggggggggtacttgtgcagagaccgttgaaatgagcatttctcactcaaatgccaggcttctgattgaatccaggaaccccattttcccaatggtcttatttgaggacaaactaaataattagtgtgagagtgggagaaaagtcaggttcccgagtctcaggagacaattcggtctgcttctttagagcccagaacatactccttgcccagagcagtcaatgctggatgggaaattcatgcatgcatgcatgcatgcatgcatgcatgtgtatctgacccacggttgctggccagaagataactgtcgcacactgtatgggtctcacttaggaaccaagattccatctgtaaacgcctgtgcatctatagattgaccctacaccctgggtacatcctcaaatgcatacagaaaccagacacatgtcagtggacagctctgggctttcatcgtacttcgtgatagacactctttcctctgcagagcaaccacagaagatttttgcaagattaatctctctgaatgggtgctgaatgctgctaggtctccttacatttaaatacatttacttagaacctagtcacagttcccactaaggcatcctcgcacagtgtttgcctgcccctccccctaggaggtctgtttcccacagggcaaacacatcttgtaacagtgcaaaggggaatctgggatcctgagcctaggatttttctgtctattttgcaaaatgttggcgatgtagtttcttctttgcacacattgtagttctgaactttgtgtgaggaaagttgggtgtgtggtggttgttgttgtttttctgctgaaaggcagttgtagggttaggtgcccaagtcctgagactttgaccttctagggccagcaaattgtgtgtgttttgcttaatctcagatatttttagatgctttcaggcaatctttgcaatatcgtaatagaaatgattgtctatattataaaatagtttgaagtttttttttttcccccttgtagtgtgttttttttttttttttttcctctgtagggctctattgccagtctcaccaaatgggcaaaatgctatctcggcgtattatagtcatcttcctgcagggtgccgggacaccagtagcgctaaatgataggacctttattaaatgtttctggggcgacttaatttattatataagcacagggggaattaggttctccccttcaaagcctgtcttgagtgaggatgatgtcagtagagatacctctgcctttgtggcgtaagctggcagagcgtgctggcagggtggagggattgctgaggtgtggggacttctgttgtttattttcttttgttttgccggagaggcgactgctaataggacactgtatattagacctcacccatgtatctcagcaagcatattttgtatgaaaacatttcatggctgtgtgtgtgtgcgctcgtgcttgcataaggcagaagaccacttgctagagtcagtttttccttccacctgtgtggaagtcttaaaggcatcaggtctgacagcaagcgccccaacccactgagccatcttgccagccctatcagttcttgcactttgctaacagctgtgtggcctttctgcccctcccattgtgagaccaccgagaagaaggtgcccgttcctcacgcgttgccggctttgatgtcagagtggtggatccagaatcactgtttgcaggtctgtggatggcaggtgtgtgaagcaaatgagttagcggtgctgtatgaattttaacaggagcagctcacgtagattcctggaaaaggctgattttacagctgagagctagtgctgcatataggtccttattctgtgatggagactccatctgcgaaaacgagactttcaatgagtgtgagaaaaattaagaacaacttcttgctgccttttaactacttgaatgtgactctaccaaatggattaaatttagtcctgcaaagcagatttctcccactgttctgcatttgggtttagaatgctcagattcttaggtttctgatactgttgttaaaaaaaattaaaaataaaataaataaataaaaagctatttttttccagtatttttggaattcacacaaaacactcaggtcattctatttctgttctggtgtctttatctaaattcccttgttttctcaaagtttacaaaatattaaaaaacttctcctaattgtacattttctttattttcccctacatggtatgtctctactggttagtaagtttatgcataattagaatgacatccatggtttaaaaaaaaaagttgtttttttttttcctcaatttgattgaaaaattgttcttcaactttggagagcccatgtatcctttaagttcctgtcaatgttaagccatgaatttctaagggaatctaagaccctgaaaagaattcatcaaagttttatatagagatgtaggaaagaccccagatttggaaagaattttattattatcatattgattagagctatttaaatttgttgatattattagtgttttctgttgttgataatgcatgtgtgcatgcagtgacaggcatgtaaaaataaggacaactgctggagttggctctctggtgctctcactgtctgtctctctttctccctccccctcccacctctccccacatgggttccgggttctggggatttggcccctgagccatcttgccagcatccattttagcaagttttataagaaatcaaagagaatcacggcataaagaaatgctcctttcttcatttgaaaatttattttttcttgtaaaggaagctatttaaatatcataattgatttttaacactggattctgagttcattttgcataatgtaaaatcacggtggctttgtcatccacatgtttctagtgtttaataatcatttgtttctctaaattatcagttggtagtcatacttaacgatgtccagaaagaatgggcaaaatggcacattgaaaagtactttgtctattgttgaattagtaattaatcaattaatcctgttgtaggtttcttcctgactcaatggtttatgttcctgaaagaaagacacacacgatctttatatttataatgccctgtacagctcaatagctgggcaactgcctaacctccatgtttctacaatctaccttccgccaataattccaagttactaacttctgtgttccatcttggccgctccagacccattcgtgcagccgtctaggtcgagcttcctaggctcagagtccagggcgctttctttgcttccttagccaatgatggcctctgtgtctttcctctgtccacacccacctaaagcctgatcccctcctttccctcttccaggtcccaagcccggaaactcctaaaatcctgcctctgtctgtcctccctggccattgcctactggcatctttattgaccaatcagaaccaactagggacaggctcccaggagctatgtgcagaccctctcatacaaacagttttttttgggggggggcataattagcattcataacacaagcagctacagtctgtcttctttattttgtttgagttttattcctttgaatatatagcctagttctgatgtgtgagtgtagtttgggaaccaaaatgtgttggttcctatacttcagcctcatggatcctaaaatgctgtggttcctaggtacctaagtacttgtgtatttaaatgtttaaaaaaataacaaaatatcactaaatattttagtaaaatattcttagccaaagagagggctttatgtgagttgcccacttcttggggaccagaattacattgccatcaaaatcactcaaagaaactctaaaaacacctgctgtttaggctacacttcaagctgatgtgagtagtaagtagcctgggctggcccgcaggcatcagtagttttgaaagatgcctagggattccaatgtgcagctgggatcaagagtcttctcttagggctgtcaatgtatttggaatatcacagtaccctatgtgttagagggtcagaatagatgaggtttggggtaggaaggtgtagtagggatgacctttataggagggagagcttgggtcatgttggaagctggcctctgtcagtgctgaagttgccaatgtcaacagatgctctgccctgctgtaaaatgtcaccccagctttcccattagagtttaatacttaattgcctcatagtatatttttaaagtattttcctacaacacacgaagagctaatacagtcatatatctattcattttgattcaagtggccttgtgatagacttttagtttgatgtttgactaaaggcttgtcaccgggaagtttgggatgatgtgactgtgaaagttgatgggttggtattgttagctagtaagggaaagcttgctaaagaagtcatagcacaagcccttccagggcaccgttaaggcttacctgagaaaacaagctgttttgacagtttatatgggtagatatgctcctcataggaggatcccacacatccagaaagcagatcttgaggcagagacagcctggaagacagggagactgaagtgaatggggatctgaggaggctgtggtagtgttggtgggaggcctggcactctttgtggggcctcttctgccatcagcctaataaacaggatgtcccacataagggcttcttgagaggctcagattctccattattcagctgttgaacacatctggtattcactgagtacctgttacagactggctagctaccttacaagggtgtaaggaagatgatgtgtggccttggagttagaagatgaatcagttcacatttctattttatttggtgtgtgtgcgtgtgtgtgtgtgtgtgtgtgtgtgtgtgtgtgtgtgtgtgtgtatgtgtgtgtatgtccttgtatgtatgttcccacttcggtgtgacagtatgcatgtgcatgtgcctgcatatgtggaggcctgaggccaacattccatgtcttcctggaacctcctacattattattattattattatcattatcattattaattattttgagatggactctctcattgaacctgaaggttattgattgaccaggctgtctggtcagcaagcaggcacgggtctgcctctcccttgttggtatttcaggtacatggtgccgttcccagccttgtacatggtggcaaggggccaaactcaggtggtcacactttgtagcaaatgcagcaaacattttaccccctgagccatctccccagctccaaccttttacattctttttgagaattattgttgtaaatttttatagcagctagttcctctgtctgtctgtctgtctgtctgtctatctatctatctatctatctatctatctatctatctatctatctatatctatgaatgacagattctaactatgtagccaagactagctttagactcacaatccttgtgcatcaatctcctaagtgcttagaggataggcgggcatcaccctgtctaagtgccaactctatgtttccatgtctctgtctacaaatcattgagtctggtcagtgagtcaacctcatgctgttatagtctttcaacatattatggctccacgtgaacttgaagatggtggtctggctttggagcctttcagactagaacaacggcggagtcttgcgttagcatttggccatttcgttaacactagagcacttgtgtttggctaatgttcttttcatgcttggcattcatctgaggtccaatatttcttttggaaaggaagataaattctttccttggcatttccttctttcctttaagttaaaagttgtcacttcataaatgagatttcaaacatctggattttgatatttgcgccatatgggatgatagagttcagcactagccacatctgtaccatggaacctgatcacacccagcacaccgtttctgacttaggtgctgtggccaaccaaaagcttgtgggatgaatgcacttggaccccatcccctgttattttacacacagtcaggggctgagtgtttttttccgatatgctctcagattgtgaccaaacggaaaaattatagtgcccctctcataaaatctcacacaaattatttgacttcgtggctgtgatagttgccatcactgcgaacctctgactcttcctgaagctccttctattggccatttaccctgtatgactcctcttaactctgtgtgtacctaagagtccaagatgatatctgtgagggtatatacaactgattatattttgtcatataatctctcttttaattgcttaaatctcttttaattaaaagtctcctttaagtgcttaaaattgtttaagttgggagttttattttaaagtctcatttcagtgaatttcatttccaaatttccagatttgtacagctcagatatcctgtgttcagtacaactaatggagatgtgggggtggggggctctatattattttataacttttcagtgtggccttcaatattcatgcttcttaggtagtagagcaccatgttttatcctgtcttatattataaaatatagattttatcatctatatgctgttatggtgtgggaagctgtcaaggttggtttgaagcagaataagtcttatagggcaagcaatgggaggaagagagcaactgtgtccttctaggacacaactgtgtccttctgagtcccgtttgctgagacctccagataatgtcagttctcacatcatcatggcatgcccctgggaggtggggtggaggaggcggggagaggggcccggaatgtcaggaacaagttgtgagcttcatgctttgtcttgtgcttttccagagtgcaaattcacctgcaccagcggtaaatgcttgtatcttggttctctggtctgtaaccaacagaacgactgtggggacaacagcgacgaagagaactgcctcctggtgaccgagcacccaccgccgggcatcttcaactgtaagtccctctgactcacccttgtggcattgtgtctcaaggtattctgaagccgacaggaggtggacgtgtcacgcattctggttaagggaagagacatgcatcttcaccaagattttattctaggatggaggatagcaggtgttaagatggagaactctgtgtggccttgcaggtgggcaccggagccttggtttgtatcgggactttgctgttgctttgagaagccccagttgattccaagaggccgtacatctgtgttcttcacatagctttcgagacctttctgaacgtataggttcagaaataatttgaaataatggaagacaggtccatacttattcacaaaaatagaaatatttacatgcgactttggaaggttctggtcacacgtgttgctatcaaatagcgaatggaaataaaacgtgtgtcaggtatttctgagtaggcttccccagggcagaagcttggaacactgtctggaactcgaaaatgtaagatcagaagtcccaagttcattggttttggatcccatgattattgtgacaaggggagggggaaatgcagatagaaacactattcagctctgttagaaagggtcgtgtattttctgattttccacgaaccaaacaaagcaggttgagggcgagattcttgtcatagggagaatggttgcatgctcttcttgctgtgttcagacacaagacccaggtttggcattcgaggcttggtctccaacccacgcacggtactgttagaaggtggcaaacttacagacttggagcctctttaggggtattctgctgttcttaaggagatgttgggaccctggctcctcctcttttttccttggctgtttttattgttattgttttgagacaggtttcttctatgtagcccaggctggcctcagactcacagcggtcctcctgcctcaggatcctatgtgtctagcttacaggtgtgagctagcatgtccagctccctttggctttcttgctgccatgatgtaagcacttttgatctacagttttgctctccagtaggatgtctgccttggcacagcctcaaaggcaatggagccagttgcccgtggatttaaacctctgaaaactgagccgaaataaacccatctgtcctttgggttgttccttctaaagtactcgttctggtgatgtgaggctaagaggtgtaatcctgtttatgggggcccccttactgtggtcaatcattccagggtacactccgcctcgctcttcagaactgtaccggtatcatttggaggcattgtgtttggggagctggggagatggctgcagagatttagactacttgctgctcttcctgacatctgtggctgaccacaatcatctctgactccagtttcaggggttctgatgtcctctcctgacttccgtggataccagcaacatccgcagtacgcacacagtatgcacacagacagccagaacagtcgtgcacataaaataaatatttctcaaatgaaaatcttgtgtgggaattagactgcaaagctcaattactgtaaaattggagagggtttacggaaacaaacaccatatacgtctttcctccatccctaccgcattgtagtatgttaggagaaaactacgtatggccccactgtaaaaataactctgctctggtgagttttaagccgactgtttgtgcttgccaaattcaggcgtctcggtgtttgttttctcaagattttttgtttgtctgtttgtattatcattttgaactttatttcaggtttaaaacacaatggttacgtgtcgtgtgtgtacttgcccatgtgagagtgggtacacttatccatacgggcacgtgtggaaggcccgaggttgttactgactgtctttttcaattgcttctccaactcattttttgttcagtgtctttccctgaacctcgagcctgccgtgctggctatattggctggctagtgagcccctgagctctgcttatctccacccctgaccacaacactggggttacagatgtgaacgatcacatctgccttttatgtggatgttgggaatcccaaatcaggtcctgcttgttcaggacgtccttgacccactgagcccacctctcccggctcctgcacttctttatactgactgcttctcaaactctatctttctatgctgagacgacacctctcagagtttagggtgggctctgcagttcccttagctagcactggactccggttttccttagattatctttgtttggtaggatttgtgtaatgcagtggctgtatggtgtcgtccagcctctctctttctgcttttggatagtctaatacatttgtcagaggacacagggatacaggagtgtgctagagggagagagggcttgggaactgggtggggacaatctccccaaagcaggcatatgccaggagactaagagcactgagggccttctgctctgccttgtgcatgaacatggaaaagtggttttgagccccacatcaaaaccatagaatgttttttctccccttcttcttccttttctctactatactgggaatcaaaatctaggaccttacgcattccaggcaggcactctgccctgagctacatccctagtcctcttttggtttgagacatggtcttgctacttagcttcctatacgggccttgaactctgtcgttcaggctggcgttgagccggcaatcttgaattacgcagcctcaaccgcccaagtagctggaattacaggcctatgtcaccaggcctggttaaatgtgctttgaataagtgtccttgtttcaaactagactgctggagtggggggtcccactaaaggctttcttagcagtcagcgggttgtttttacctgtgccccagagctcacattggtgcaattaggatacaagaatgactattgtgtaactacaggggaaacaggcaatccaagtcagtcacttcaaaccttccaaggcttaagtgcttggtgaatatgaacttgttccaagatagactggggatggaggtgaggatcctggtcctaggactctcttagcagttaggcaggttgcttttgcatgaggaagtgactcaatccccgtaagacttagatttaggtatttatgaaatgggcataatttctgccgtgtaagattgcacacagattgaatggaagacatggaaagtgtgaactacataattgtgttgtcccctccctcttctctccctcctttctccctcctcctctccccttcctccctgcccctgtttgtcctcctcttcttcagatattgcttgagcatccatccttgggaaactcaatcaccatagatagatatgatttgtcttcagtgtcatcccatatgtaatgtgtaatacgtaatatgtaatatgtttctaggtgtccaagaatgagtgcatccccagaaatcagtgtttctggtggctcactttgtctccttggaaagattccgtgggaactgtgccagttgaaggcgcctgtggactggcggggggggggggggggctacctgtatgctactgtcctgaagcacctaagggggaatggcatttgtcctgtaaggaacgctcaccatgaccttgttgctggctggtctatcctttgggattaggtatttctagagagattgattgtagctgtttctgtccttctttcttcagtcaacccgagaggataatctaatatggaatgaatgtatgcataccctcccccaacccatcatatctcacccaaagagaactcgaagcaaataagaattgacttctactaacatgtgtgtattgtgtcctagagtctctctgtttgtgagatttcagtgggcagctcgtacctcttactgggtcatccgtggtgcatttcagcagatggacaatgtgccttttgcagagggctagctccataaataaattttaccatccttcccatcttgaagaaattaaagtatggcaggaattcttgtcttgtgtggttcacgccacgtgagcatgcacacatgtacacatgtgcacttgcacacacacacacacacgtgtgcgtgcgccacacgcacacatgtgcactcgcacgcacatatgtgcacacacataaaacaaacctagtagctcttatttttgatactatttagaaacagttggctcatttgacctgctctgttcccttaaggaaaatgttgactattctgatatttgatacttaaagtgaagtgaagtgggaccttctggatatccagacgaaccaaatcaattttttgcctctgctcttggcttcaggtattcaccagtgttcggatatctcagatatctctgtttctcatttgataatgtttaacatgaattaaggttagacagacaatcccaccattgcttgtggtcagccatatgagtagtccttatcccacctttaagtagattttcctttcagtatatgttttggcacctacatctaggcatatctggtttcatctgcttctctctctactgaggtaactgtgaccagattctcatcaactgacactagtttattttgctgtgaaaccatagagtttcagacagatgtgggaggccagactagcactgattatcttaagggagagtttccagatgcacctttcagtggaggagagaatatgctgacagaccaaactctcggccttttccattttctttacttcagctgttctatcaaaatattgtagtattcctgagcactcagtatatggataagattagttattaagtgccttctctggccactgtactagccattacggcagagtgaagaaagcagatcccgctgttattagagctgagagtcagaaggacaacacagggaaagataactacaaatgaacatcggaagtgatggatggttggtccaccgtgtgtggtttagaagtgaagacagaatcggtctgcttgcactaatcattgtggcttcaggaaggaggcattctgaatgattagggaaggagaccatcggggcttcaacaggcaggaacatggaatagcagtgagggtggtgccttcctggacaggaacaaaggcagcctgacccaagaaggtggccctacagtgcctgggggaggtgcattagaagataaagttggaaactgggctgaggccagagaggagccaacctatgatgcaggtctttggcctatggtctgcattgtcccagagcctgaagcgagctggtatctatgtactacactctccacagcaaaccagccaagtgccacctcagtgtccctgtccagccgggagtttcctggagcactgtactgtcacagcagctcagtggagtgggggaggggggactgagctcctacagccttcttgacactagagtctatacctcttggaaagggacgaacgtctcagcgtgaagcagcccctaccgagggatctgtaccacggaccttccggggaagcccggaattgaaaagtaccacaggaaggatttctcactttcagttccagtgggattttcaactaaccggaaggatccgactccgggaagagtgggagtcacagcagccacgtcctcaccagaggccgcttctctccccagaggtggcctcataaaaccgacttcacaatcaaatgaaccaaggccaagggtttcccaattaagctagcatttcaacttctaaacttcttcctgaaagcaccctcaaccccaggtcagttggagtgataacaaaataagatataacctgcaccaactgctttcctccccaaactagctttctcccctcctctgggttctcccaaagacaccccagtgtctttaggcactaccgtaccttaagctttcaggtgtctttgttcatgagaactttggactctagagagaacctactatgaccagggcttacagctgctagaactatgtatttttttccctataattatctgcagtaacattaaaaacagttctccatatcaaatatcccaacagagagtgcaccggttgtctcatttgcatctgggtttctgttctcttcatagttttgttagcattgcagagttaatgggtttcatgactatgatgatggtgacgatggccatttcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatatgatcaatcaccctgaggtatgtgctacactggatggattaatttaagcatcagcaatttctctgtcattcgggttataaccgatgatattttcattattatcgggtaaacagttaaaacagctggctgcacgcattcagcttttacagtcacctttcctactccaccttaggagccgactctcagatcttagcatcttcatcctgtctcccaccacctgtcgtgcaacttcacgtttatggtatttgtgtttcgttagggcctgctggttctgagctcactgccatctgctgggcctacctggcagaccctgtactcacctgtctagattctccccagaggcccaggcctctgccctgcacagggttcctggaccactgtgtgtctctgcagtttctctcctatccagaccctgctgcagcttgctcatctccagtctcccggctgccactcactttctggatcacttgccttgggaccacagctctcccatagctgcttctgctggaatcacctgcttgttgccaaacccagtagacaattctcttccttccttccttccttccttccttccttccttccttccttccttccttccttccttgtcttatccccacagttgatagccttgttcagcttcttcctaaagctctctgttctctgggatcacaggctctggagtttgcagctgtcaatcttggctctcccacactctccgttgccctaggttttcccagaccatgccatagggttatggccattcccttgtccttatctacagccaaggacaaggctgatgtttgcaaccactcataaggcctctttacaagacccacagactctgtgtgtctggtacgcgactgcacatttctttatcaccccagaccagcccttgtgtgtctgttgtctgacttagtgcattgtcgaccagttaagtgggccactcttctccaaccctaccccatgaccagaaatatgttatcctgtttggagtaggcacttggtgccatgttggggtagcacctgttaatacattcacaggttcaattttcaaaggatattgcattcttagaatggaggcgctatgcttatcactttgtatgtctgatgcttctccctgagtgctgactgtacatgttggctgacttggagagcatcttccctcacctactccccattgtattattttatgccttcagagtaccaggcctatgaggtttctgctggagccctagcttcatccagcatatcctgtggtatatgccatagagagggcatggtcccgtaagtatttgctgagtcagtacatgaattattttattaaaactgagtctaatcagagccagaaaaggctggtgtttgcatggtgtggtattcaagtggacctgggggttggaaatatccatatatgttgtcttggagaactacataataagacaaagcaaaggtgatagaagatccggctttgccaagttatctatccttagatgtgtatttggttactatagataccaaagtaaccaaagtataggcctgctctggtgccagcatttttttttctaggactcacaatatagtagaatttatgctttatgatgagagaagactcctcaaccaggcaacctggagggacaaatctttgtttctttttaaaataggtcaacgcttatatacacaaaaatatttcatgcccagaaaaaaaatgtggaatgtttctcaatgtcataaagaaagaaatgtgtgtgtgtctatctatatatggcgtgtgtagtatctgcatgtataagtctctatgtagtaagtatgcaactgtgcctatggtatgtgattgtgggagtctgtgtgtgcgcatgagtggatggaggtaagagtgtctttgtggagtgtgcatagatgtgtatgagtgttcatagcctcagtttcctgatggtcctaccaagcagatcctctcttctgccagtatatctcttaaagaaaatcctttgctatgggcacagtgtaatagtcactgtaaacaatgactcgggcctcaggcagtacctcaatgtagagctttaggctccaattatagagtcatcattgaccatggctttaaaacagctgatgagtctctcgtaccttgattctatcctttatgaagtaaggattatagtattgatatctcactgagaaggaagttttgagggtctaatgaaatagtgcagaacaatcaattagagtaaagcctggcacgtggcaaatattcaacctgctcgcaggtcggcagcttcccggggggtggagtaaagtggaaaggaaccctccatttgctgagggccagctgttggctcacgtcctctccttcgtctctcttaagacagccctagaaggcattcctaggaacacaatgctttaagagattagataattgcttcagacccataactagaacccgctgctgcggctgggagattgaattcagctgtgtttttatttnnnnnnnnnnnnnnnnnnnnnnnnnnnnnntagtgttatcaatttaaaatgtgctgtgtcactgaatgtccatgcacccccccccccaatagcattcaaacccaggccccaacagcagagaagaactttgatcaaaaggaatgtagagccctgtacactctggtgggcactggttctgcagactgttcactctccactgttgaggcttttaatttggaagggtttagagactcacctggttagccttgccttatgaatgtctgagactcttccagagcagggttccgccaaaggcagctttacttttgtgccatagaaaataaggtcaa

SEQ ID NO: 1664 - DNA, 343 bp, Mus musculus
ccggaggggatccccagctagccggggaggagctgcggccgccgccagacaggctgcaagtcccgagaaggcgaaaggggggcggggagctccgagagcccggtggcaggtccctcttaaagagctacgccgcgccgtgtcgcgccacccggagcgctgcccctcccccgcagcccactgggccggtggccgaactgcgcgagtgcaaattcacctgcaccagcggtaaatgcttgtatcttggttctctggtctgtaaccaacagaacgactgtggggacaacagcgacgaagagaactgcctcctggtgaccgagcacccaccgccgggcatcttcaactg

SEQ ID NO: 1665 - protein, 114 aa, Mus musculus
  VARIANT (1)...(114): Xaa = Any Amino Acid
GGDPQLAGEELRPPPDRLQVPRRRKGGGELREPGGRSLLKSYAAPCRATRSAAPPPQPTGPVAELRECKFTCTSGKCLYLGSLVCNQQNDCGDNSDEENCLLVTEHPPPGIFNX

SEQ ID NO: 1666 - DNA, 285020 bp, Homo sapiens
  misc_feature (1)...(285020): n = A,T,C or G
caaactgctggccagtcccaagagcttcgcgagcgtgacccgccattgagcctacattaagttgcatggagcaataggcagagcctcgcaggcccatcccagacaacacagagtctcccctggaaatatctaagaaaagtcttactggagcatttctgtccacccccactcaccttgaattggataccgagttgtgaaaaattatataaagtggacagtttttctttgtcctaaaggaatatatattcctcagataatgaatgtgagcaaatgagacagaagtgcttcatgaaagctcagctgttccctgtgtgtttgatttaagaggcacttgtggagctggtttggagcttggtgaacaaggaatgcttaggaggctttgtgaacgcaggcgactgaaatgactctgatcgttcatttctgtagggaacattggctgttatatcgctgatcagtttgtctgagccttaaggtgtagggtgttttgctgcgtgtcctggtgtggccccgttagttagggaccaggcagccttcccctgagttccctgcactctgtgacagctgctcctggggacagttgcaggttcacaggctgcctcgcccggcagaggggcatgggagcaccctacttgtcagaagggtggtttgttgccctctctgtgccatctttcgttctcagggctgtgtggaagcttgagaggtgcatgtgaagaacttaaaaggtcagcactttaccaagggaacaaaccacacaagaaaagagacggaagaacagcagacaggaccctgcgtgatgattttccgagaaggagatgtaaaaacttggtcaaatttattatttttctttctattgctgctttttaaatgttatatttcagtatgaaaacatgaaaaaaagccaatcaaatatcaagagcctctatctttttccttttaaaggcaagtttctttcttgacatttttttcctcttctactattctaccacatttcataccaaaaacctcacccacacactttctctaattttgtatcctttctcctgtttctctctgttgttaattttagctggcatggaatgatttgagctttgatttttatctattgggaactttttaaaaaaatcaagacaaattagcagaggaactaggagatgaatctgacgttgtatcagttgggtcagatcagaactggaagagggtgggctgagccgtgttagagacgcgatttcatcggccatctgctgaggcaggttgtagtaatttgggaggggtggtaacttctccagccctcattagatctagggttttgtttgtgttttctcattagatacacaatggctccatcaggccagtgccatcattgcttccattttacagccaaggaaactgaggctcaggggctttaagtaactgcctaagtcacacacagcctagaatgaggtgaacccaatgtggccagagcccagacttttgtcctctggcccctttgtataaggctcttgtttgagcatgtttgaaacagtgtggggctgggcactgcctgtgcagtaaactcccagccacgatgtcccccatggggcacccccaggccagcagccacttgtgtgtggtgcccagatgcaggacagaggccatagattgaaaaggaggtgacctagctgaggctcagctagaattctgtgcagtacagtcagcatttattgggtacctgctgtattctagtccccatggtcaatgccaaggataatcaggaagcgttgtccagaaacacctgcagaggcagacgagacacaaggatctgggccccatggtgacaggagcttggtttgttttgctcactgctgtctccccagctcctaaaatagtgcctgccagagtaatgaccccacaaatagctgttgaaatactgaatgaagagatgcagctttggtggcgtcctgcaggccagagagcagggaagactgtgggccggcacaggtgtcccagggaagcctgctgtgagctgacagcaaggagtggcttggcaagggagatgaaaattgtttcgtacaaacagcttgtcggttcatattcttttctattcccaccaaagaatgagacagctccccctcccttcctgcccacacttgttagcctatggtctgacccccttcttgtttgcctgtcatgcccattttaagctgattttatctgaagaaagctggagtgggggagatccctgggtgtggaggattgcagaggcctgcccctgcccgccagccccctgcccgccagccccctgcccgtcagcccgagccctcacgccaggccacagtgggagcagaacctctacgggggtggggctgggttgggaggggcattgccgctgcttggctggtggccacagtggaggtgtctgtgatgtgctcagaccgggctcagaccagaatgcacgtctgctcagggatcatctgcccctgggccaagccctgaccctttcccattcccttgtgcatgtgggtgctgtgggaatggcctggttcgggccctggaaagcagagatcttcccagtattccctgattcccagcgagcggctggtgcaggtgtgcacggctgtcttcctagcattgcaggctctccctcctgagccagtgtctcctgtggccgctgtgtgtagacagtggaactggaagcttgggccaggatccagacacctggttccagccctggcttgcattcctcccacactcatcttcaacctgtcccctctccctgagcctctggatcgcctcctccacaaagcacaggggtcggatatatgactccttgcggcttcctctgctgctagatcatatgagtcgataattatagacttactaatgcattaaggacagttatcctgtttattttagggggaactctctccaacttggtttgaatatagcctcaggatttatcaagtgttggatttgtcaaggtgacattttaaagaatgttctaatataattattgcttttcctgtttgcagcctgtgtgtgtctttgaatcgatgttttgggttttgtacttgcttcctgaattggtgacctacagcaaggcactacgctaccctgaactacattacgctgaacaagtaaccagatcccactgagctacccagggtgaggatggcttggaggttgtgttacaaaagctacatgttattttgcccccccacatcacagagatgaaaagtagcatgaaaaattcatcacactccaactcagtcgtcttccctggctataggcagcctgtttctctgacttgctctcagatttgcatttccatgtggattttctgtgcttctgcactgtgtccctttcttttgtttctctttagttttttttttttttttgaagagacagggtcttgctatgttgcccaggctggagtgcagtggtgcagtcacagctcacagcagctttgaactcatgggctcaagcagtcctcctgcctcagcctccccagtataggtgtgcacagccatgcccagctaatttttatatttttagtagatatggggactttctatgttggctaggtgggtttcaaacacctgggctcaagcaatcctcctgccacagcctcccaaagcactggggttacaggcgtgaggcaccgtgcccgcccactgtatccttttttatgcccatttgccctctctctcggccagagacatggccataggggactttttggaatgggagggacctccagtttcacctcctcattgtataaaagaggagatgggagccagggccgggagtcaccacgggtaccagaagcagagtgggtcccctacctggggctctctgcctacggctggctgcctggaggcagaggtgttttatttgtagcacctccttttctttactgttaggagatcttgagactgactggccgttgccaaggtctgcactatccatgagctctgaggcactcacatggagacgtgtgacatctcccttggtgggacacctggtcccagctcaagttggaaatagcttctcaagggtcttttccccactttttctcccatctgtctcatgacaagccctttgcctctttgatcctaaatgaacatagggtgagatgatgcataggtgagctgtgccgtgcagctctcaaacatggtcatttttattttttttaaattttgcagcagagccccagtttgccgaggtttagaatgacctctttggttggcagcgttcctttctccctggaacttctctggtgggtagagtggccagggatcggcatccacaggccggggctcggccctgagcgtctgtggggcctggagcagtcgccatggctgtggagctgtcacctaggtaaccgacattccgccagcgaaacagtctgtccacagcaggaggaaataaaaaatgaaactgcagcgtcaattctttatgcactacggttttttgagtgctactttgattttggaaaaaaggctgtttcacttctccattggattttggcctccgtgcccctgtgtgaccctcacatttcctgaaccccatgtatctgtttttacagtgtcttttaatgaaagatataatacggacacagttcagtttgtattcctgaatgactctgaggaggactgcgtttcatataagtttttgtgaataactggtaaggcagacataccctgtaacttacttggttaggtttgtgagtgttcatgtttttaaaatgtcccttcctgtgggggtgtttttccatttgacgtgctctatttccttagtaactgttgctctgttatgggagggacttaatgacatttttcaagtgcaatattgaattaatttatttcctggttagtcctgcccatcttcccagtataaatagaacctccatgtgtgtgtgcgtgtgtgtgtgcgtgtgtgtgcgtgtgtgcatgtgtgtgcgtgtgtgtgtagaatgatgaccatgtgcttgctgccttgggggggatcttgactgtgaccttgcgtcctgggtaagttgcctcttcctgtattcccccctctccttctctcttgatttaagctacttgggtttagggagcttcctgggcctcaggagtagcatgggaagcagtgccttcagggcaagaggcccagggtcagtcctgctctcctgctgccagtgttgggcgcagttcttgcgcctccatggggcagcgcttgctctctctctgtagcctgagggcatttaagtcaatgacctctgaaggcctttgctggataggactttgtgggaagtgtaagtgcagcaggctcaccacttgtaatcatcatctcaactcttctagtggggtggtgggaaaaccagcccggagggtcccagccaagcaggctgaggagcagcacctccacctgggaaatgccccttgccaggcgcagctagggctgggttaattgtgtaggtgtttgctgagccttctctgcgctgtgtatagtactcagggaagcttcacgtaagtgtcttccttcactcatgtgttcgctcaggaaatacgtatttactgggcacctgctgggtgccaaggggaactggaggatctgctggccactgcctttgctctcatggcacttgtgggggagacgggcaggcatggtgcaatcaggacacccgtgtggagtcgcaactgcagatgttttgggaagccgaccaggtgctgcgggttgtgtagcagggtctggacttagactgggggccatcaaagaagcatctccagggagggttgtttgggctgagactggaaagctgagtggcagctcatgagcaggaggctcacgagagcagaagattggagggacggccggcaagcagcgtttgttcagctcctccaacttttacccttccacgtgtttgctccacagatgcccagcatggctgtgctgattgctggttggtttctaaactaaaagcacacgtcttgtccagaacagggcctgcaggcttctgctgactgtgctggccctcagagttttctctgggtcctgatcacccaccctgcgctgcctgttggtcacctgacacacttactgagtgccgctgggttctggccccttctgggtggtcacagtctttcactgagcagaacgaagcttgcacctctgctgcgtattcctagaaagggtagctaatctttgttgctagcagtgagaaagaagactttttacagcatttataattgcattttaccttgaaaattgcattgggggagactcagagtgtatataggaataggcacgttatccattgatgcggtaacacagctgtgttcaccctgcttttgttgggaaccgcacacatcactgtcctaaaaatcctggccatgaccacgcttagacctcatgggagctattacacacctgtgtccaacctctcttttagaagatgtaaagttaaggattggtgggggtgattaagccagcataagaaaactgggaagttggttgtttcttctattttgatccacattggcctcagtctttcccatagccttttgacatgtgggatgtatgataacttcatttttctaattgacattttgacaaataataactgcatatatgtggggtacaatgtaatgttttggtatatgtatgcatggtagaaatattcaattcaaatgaattaatatatccatcacctcaccaacttatcattttttgtggtaagaatgttaaaaatctattattttagcaattttgaaatatgtgatactttttttattaactgtggtcaccatgcaatgcagtacgtcactaaaacgtattcctccagtccatctgaaaattttgtatgtttgatcaacatttcccttttcttcatcgttcttcctcctgcctctggtaatctcctttctaccctccttctgtgagattgactctttcagattccacctataagtgagatcatgtagtacttgtctttcaattcctggcttatttcatttggcttaatgtccatccgtttcataagtgagatcatgtagtatttgtctttcaattcctggcttatttcatttggcataatgtcctcccgtttcatccatgttgttgcaaatgacagaattttcttctttttaaaggttgtatagtactccattgtgtatgcataccatgttgtctttatgtgttcatccactgaaggacacttaggttgcttccgtatcttggttattgtgaatagtgccgaaatgaacacgggagtgtagatatatttttgacatacctatttcagttccttggatatgtactcagcagtgggattgctggatcatatggtgattctatttttagtcttttgaggaacctccatactgttttccgaaatggctgtaccagtctccattctcaccaacagtgtacacgggttcccttttctccacatccttgccaatacttctcatcttttgtctttgataatgaccattctaatgggtgtgaggtgatagctcattgtggctttaatttgcatatcccagatgcttagagatgttgagcattttttaatatatctgtcagccatttgtatatcttcttttgagaaacatcttttcaggtaattgcccgttttaaaaattgggttgttttcttgctactgagttgtttgagttccttacatactttggatattaggccctgatcagaagtatggcttgcaaatattttctcccagtctatcggttgtctcttcattctgttgattatttccttatgataacctgatttttaaaaaaagtgaggtagcataacttctgcaatgaaacaaatagacaaaattcccacaataaaacaacagcaaaaacctccctgcagtttggttttctctctgagtttagagaatgagaacaaataaagtctagcatatttgcacaccaaaagcatcatcgaaaagggcagagaaaaatcaaagctttagggcaggtgggcttctgtttttatctggcaggataaattccatttcccaaagttcatgatgctagtgcaactagttttcttccgaagttcctgtaggacctgcatgttggccatttttagatggaatgttagaattcagagaaaaaatgttttctcacattttcaagcacttcaaagctaccatttacacaaataatttattttttaattaaaatgttacctgttctttaaacttgaggactcctactgggccataccttattaactgagaatgttactatagatacatgaaggtaatagaattggatgtcttagtatcattaaagtacttcattaatttataacatactccttgtaattagtacgtatcagtgatgtgttacttcactaccttctgtttatagcaacatgtgattaacagagggctcctttctgttctgtgctctgttctcttaagttctttttctttagtttgatgatgaaaaagaagaatgagattacattttctaaaagttggttataaattgattaggatgaagtgataacataaaagaggtttcttttcctgaatattggagactgatattcaggattctgttttaaaagtctgatcctttgggcttctgtcattcttgttaatattgctttatgtttaatggaacattaaaatatctgaaaaacattttgtaaaatgcttttattattattctattttttttttttgagatggagttttgctcttgttgcccaggctggattgcaatggcgcgatcttggctcactgcaacctcgcctcccgggttcaagtgattctcctgcctcagcctcccgagtagctgggattacaggcatacaccaccacacttggctaatttttttgtattttcagtagagacagggtttctccatgttgatgaggctgatctcgaactcctgacctcaggtgatcctcccgcctcggcctcccaaattgctgggattacaggcaaaatgcttctattgttatgtaacatatggagcagtttatagattaaatttgcttttccttcctattctcactaaaaagttaatgtgggcatttgttttccttttaagaatccatttttaggccaggcatggtggcacatgcctataatcctagcactttgggaggccaagccctttgtgaggattgcttgaggcaggagtttggagaccagcctgggcggcttagtgagaccctgtcattcatagatagatagatagatagatagatagatagatagatagatagatagatagatggatggatggatagataagatagatagatagaatcacttttaaaaactgctccatgcaagtcctgcattttcttcctggagtgctgaccagtggccatgcaccacagaccccagtctaaggccttgggaaccagcttgagaaatgagtttcttccccgaggtgtctgtgagggcagaatggcccaggagggacatttgaaccttaagaggagcatagctgtggccttgggggcaggtggatctcctcccaccctggcagcccctgtgggagcccccatgcccacagtggggtcgtggaggcagctccgtggcttttcctttctgtcctgtgtaagcctgttaattgtaatgcttctgctggtcatcaggaaagtgacctcttgcttttcagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggactcggacaggctaagatggaagtgacctgagcctcgcccggcggcttcctcgacgggacagcgcaagagttggagcacaggcttgtccggggagcagtatgccggaagctggttttcaggccacaaatgctttcacaggtgagcatgctccaggtaatccgaggctttgcctccactcctgggaggcaataaactcccaaaccactgcatgcagtgaacctacctttgcagtcaggagctgaaggccaacgcagtcaagggctcaggctgctgtggtgactgattctgacaaaataataatgtgttttccttcgctctctcaatagcagtttgaaaaagtgtttgacactttttgcttctgtttttgttgaatgataggatacacacaatatcctgcagtattcgcagcgtcttccaagtctctgttctctaaggaaatatgtcacttgctgagcgagggtaggggaagtgtggtttctttacagaaccgggaagattctccgagggaaaagattaattgccgatgtgtgcttggtgcctccccatctttaatttctcacatttatttgtgtgcttggggcaactgggcagaactcgtcttgcagtgagcggggagaagtgggacaccccagtgtgctggtgatttggccctggctggcagtttgtagggaaccacacagtctggctggtgcccagagccctcgcccaagacacaggagattttgaatttggatcctggctcttttgtctgattcatgtaacattccaggaagccacttaatcctctgggcctctggctcctcgtagacagactgggctccgtgacattgaggaacttcatggaatccagggagaatgtgtttacataaaagaggttttgtggaggttgcctttcatttaagagaaagatggtagaaatagtcacaagaagtgaccctattctctggttccgtgagtcccagaagtttgcagcttttcagattttgtggagggagcaggtcaggctgttgggatgcctggagagaggggcaggggctcaggcttgattggcatgggccttctccttggattagatgtcagctcctagacagccttgcactcctccgcagtcgccgtggcttcggcgtgaagagatggagcgccgctgtggtgcctctccaaggaagaacgaggggacgggtcttcccaacctcggccgcttccgtgcgcacctgcaggcgacctcctgaggcagcttgcaccacatagtctgtgacatggggtctcagtgacagtgccttccccgagttgtgggaggtgggtcagggcccgtgctggttagcttggcagctgtgtagatgtctccctctggattgtgaggggctggttattctctggcccatgtggatgagctccgcagctgtgtacaccttcctcccaggttgtggtgtgcgggtcatggcccatgtggatgaactctgcagctgtgtagacgaagggttgggggagcacgtgcaaagctaagctctcttgaaccatcttcatacctgcagcccagctgtctagaaaccctgtccttcctcatccttactgtgtgtgcttcagctgtttccgtctcaggagcagctccctcgtggatactcctcccctccaggcagggatgggcagctccctcatggatactcctcccctccaggcagggatgggcagctccctcgtggatactcctcccctccagtcaggggtgggcagctccctcgtggatacccctcccctccaggtgggggtgggcagcagaagcaactgagaagtggctgggtgtgtgctcagcctccttgtcccttctccccacaccccaggaggcagctggggaggagcggcacctaggatttgatgtaaagaagctcttcagagtagttctgggaggaagagggaacaagaaaagaaaaggaagtgagcatgggacaaaaagagcccgaggaaaagtggcacactcttaggaagctgccctgaccatggacctgacggcagggtggaggccacagggtggcccacagaggccagggttctggggccgtctcctcaccctgctgcacctgatggtggtccacgtggctcccactgagacacccacgccatcctcacactctggggtgctggggatacctctgccccaaaggaaagggaaaggccaaactgaggctctgtttagaatactcagaatcctgtggttctgcctggaggattcttgcagataggacagtacctctcacatattaagccaaggtatatgtcagctgctacccctggggcctgtgtcaccccaccttcctccccacttgctcacagtcacccacttgtagctcctccccagctcacgtttttttttatttgtaatttatgaataaaagctttctatattggtaggttccagtgagatgttttgatacatgtatgtgttgtagagtgaacaggtcaggctaatgggctctgctcatcactgcacattttatcatttctttgtgctgagaatactttggctcctctctttcagctcacatttatgagtttcccaagaatctgtttccttactttggcctcttccccccagtgtcagcctggctgaggaacaaggtgtgccagcggcagtggtggggtgttcgccacagccgccgttttggagccacagtgtgccgggagccgtgctcctgctatgtgtcctttgccaggtgtcacaccaacacagcgccgcgcggggcacactcagtgcaggcaggaactggctggtgccagtggcctctccagattgtcccacgctgtgtggccttgggtacacacgggttccctggggagcttccctaccacctgggtctcaccctcagagactgaggtttaattggtcttggcatcacctagacctgctaaatcaggactctcatcctcacaagatcctaggtgcttggctcactttaaagtctgggaagcactgggagctggcacccagcagagcagtgttcagagagaggccagggtgcttgagggggtcatgtctcaaaaaaaaaaaatcacctgacttgtgccattccttcagcaggggggatcaaaataatgggtctgcctgttctcagaccatcatgtgttgaatagtgttcacactgttgggtgcgccagcacctgcagggtggcagttttagcttccccatctctctctaggaagtaaccagcagtgaaataaggagatgtgagcgcctggccttctctggagctgggtccctggagacttggctcatcatttttattcttggtctcccttcccatctgtctgcccacatagtttgcaagagtccctgtgatgtaggatgcaggggctgacacactctgcctgcccaggcagctgggtgaaggtgtagctttagaaggaggcgctcaggagtccggtgcccagcccactgccttagttgggttgctgttcttaaaattttggattttgctgattctctgggctaatagaaaggagtcttgccttagataagacattgaggcatcttccctaggctttaaattttgttttagggccaggcaaacatcactgggcagttaaccatatgtccactaaaatttgtcactttatgttccaattctcttggagggtagaggctcagaattcctctttaagagggttttgggcagcactcgggctgtgggggagggctgggagacctgccatgaagctgcgtttgtttggagcgtgtgaaagtaccatgaagggggtgggagtttggaaggcccctgtccccatgccacgttggcaatcctgtgtgatggagttcactctgacctcgtgcctcctgggtgagtgtgggtatactcacatagatgcgtatttaacttcttaattatgatcttaggtgaatgcttgcatacaggaattgatacattatttttagttttctcagcatatgcaatttagaaatgattttagtcatttagatagtattttatatcaaaaattaattttttccttttacaagtagcatctgctcattgtaagcaaactcggaaagcgcaagagtcaaaagaaaaataatttcctacacgcatctttgccatgtgactctttcttcgggcaacattttagtttacatccttccagttttgtcttttgcaaatttcttcctacagaactgtgttcataatagtatttaatatggtaacttgatcattcccttttaacattacattacgagcatttttcttataaatacgattttaaattgctgcataatattttcatgtacatgtacttgaattttaaaattgtgttcctgttgttggatagtccactttttgacggttttcacccttatgaataacgctttgatgaacacctttgtgcataaaagctcttctgtatatttgattatttccttaggataaactccctgaggcaaaattattgggtccaaagatgtgaattctgttacagcttataattaaatttccagaaggattgattgatcctaacttttgaggctgtgctgaaactggtttccttctgttgccagttgcctgttcacagtgactgcgctcagaattgggtgtgtcctccacggttcagctgtgcgtggagcggcccccacctgcctcacagggcatttgtgaagctctttgcagcatgcggctctaaaggccgcctgagtgccatgtgttgtgtggagcaccttcatgttacacttgagcatgtaaaaacacagatgtcctaaacttactgtttttgtgcttccaggccctctttctgcctggctgtcattcattgagcaatgatataggtgaatggacttgggaaagataagactctggctgtcctaaaaacaaacccccagttcctctgagcagagggaagcagggacccttccgggctgggtccgccggcctctgtcccaggtgccgtcatagtggtggagatttcacctgaggtttcttgtggttttgactgacttggaatgcatcctttctgggtgtcaccgtacacatcctaaagaggttgctggcttgagattctgcctcttcccggcccatggtaccacccttggatgctgcagaggttttgcacaattaattttcttaggctttttaaattattttaatgttagagaaaaacatttaacctcaaataactaggtaagtgaatcaaattcctatagaatttatagcgagtctttctggtgaaaggagaatcagatctaattgttaaataaattaaggttatttcgctcataaaggaggaggagggcagttagtagtctttgtctgaaagtgctattttgtggatgttggtgaccaggttttcttagccactaatgagactgaaaaagaatcacttaaatggaatagttggagctgtttcccctgtgggctccgagtgaaggatgtaggcttgctgggggtgtgactgggctgctgtgttcaggagcagctcccggcgtgcccttcccaccccacagaccttccgcgcattcctcatccctctcctctgcaaggttgcacctgtggctgacccacggatgccctcagcccccgccttccagagctgcccagagaatgctcgctttaggagatattgagagctgttcctccataaaaggagtgggggtgaattaatggccaaagcttggaagaagaaacttaaatcagtttctttactacagaacttttcagtctttaatatggggctgtgcagtatgaaggtcccaggtgggcaggcagcgggcagtgttttccaaatgacaagacctggaaggcattttagagagaacagcaggcagggacagcttctcatagcacgcactctggagaagccacaaatgttttgggggtcgcctcctgccatctgcagctcccgtgtgcctgtcccacctgcgccaatgcagtggtccccggcgggctgcttctgttgagcaaatattgacggagctcttgccaggtgtatgtcaagtgctgcagagaaacagtgtcatgagaccgtctccctgcctccgttctctcctctctctagttctgccgatgctctttagagtgaggttttagtgataagtttcccttgccccaaaactttccagggctgcttcttgcttcataacaggagtccaggcacctcttcctggagttcaaggcccccagagttgccttccttcattcttgtgttgtgaccaaagttcctgacacagtgactgtgagcccacccatcaatcatttgtgcagtttttaatgggatgctgttgctgatgctttctcatttcctgcagagtctctctttccaccaccttcctctccatcttcaggatctgtcttaggtccatgtaatcttttgtgatgtgtacaggagaagcctagacagtctgcctacttgcaatttagtaggtgtagaaatgattgatagtggctttttgtaaaaatatcaaatgctttttctgcagggaagttaagtttgctgagagagccatttgcacattctgtggtatgtgtacttggtttttccttcatgctgttagcctcgaatctagtcctcagttataaacctaaccttaattaataacgtttctgtgtgtaaataacatataatttatgttgttattcccataagcaccaaactcttctccattttcttcctggtaaaccattctatactgtttcaagataatcaaatgtgattatcttttttttagaggcatcgtggtagtctcatgtcgagatgtgtacttacccttttaaataaggatgagaaataatttcagtattgcctgaaattatatttattttaaggttacttgagtgtgtacaacataaagatagttataaatatctttttatagctgttaaatagctaaaatatccaaagcaattaaatataaaaattataaagtcagaaacattccaattaatatttaatgtgacagatgagtttgtttgctgaaagctttcattttccagctctttttatttatgctcagagcatcctgcagggagacttcgtgatggtgactgctcattgctgggtgttagggctgatagcacagccaagaccagtttgaatgctggctctactgtcagtaagtatgagcattgtttgagatgaatcctctgccactgagtatccaggatcaaagcaacttgcatgtctcattaggttctttggaaaatgggggcttttgttcattgtacatctgaaacttggatgttgtagttatccctgaaatggagccacttagctctggagaaatcaaacatgtgcagaaagcaggtgactgcttccatacgtggcctcttgtagtttcttgggtcctagcctcttcctctgttagtgtatggatgtctctggagtccttaatactggattctcctgtgctctctgttggcagatgagctcagaggctggggaaggcattgcttccaggaggagcagcctgccccggtcacgccccagttcctgctctgtgacactgatagatcagctgacctctctgaagtgcactctttaccacactgaggtagagataatggccagtgagtaggttctgtataaagattaagtgaaataacatttgtaaagtaccaaaacacagtctggcttatagtggtgctcgataaatgttcttccccgtcttctttcatagtcttcttgaagttgactatacagaaaggcctcataaaaatcaggggttcatttaataaatatttaatagttgtcatgccatacttctgtcccaggagtgtacagtctgagtgtcatcacgatctgcacagttagctgccatagctctgatgacatcacatgcaggtgtggaggtgggggctggcgtgggggtgggggctggcagggtgggagctgttgtgggggtgggagctgttggggttggagctgttggggggcgggagttgttgtgggggcaggagctggcgtgggagcgggagctggcgtgggggcgggagttggcgtgggggcgggagttggcgtgggggcgggagttggcgttgggtggggagctggcgtgggggcaggagctggcgtgggggcgggagttggcgttgggtggggagctggcgtgggggcgggagctggcgtgggggcggaagttggcgtggggtggggagctggcgtgggggtgggggcatgggctgcagaggttgaggattttagcttagctcccggggccctctgctcgtgggaatcaatctccagcacaagacatcccctctggttccttatatccggtttgatagggcttttagctgaacttcagccctgccacctgcctgtgctgggctgataatcgcctctcttccagagtctcatggagtcgtcacaggccaagggtcttcaaacttggctagaagtcaagtcccgggtctctgtgttttttcaggatactatgtttaaatgggggaacccagaaatgggatgcaaaaataaacaagtgtaacgtctgggtagtggtttatggttccgttaaaattttttaaccaataatagtccgtatgggagtatggactctttttcctctcaatttatgttggcatttgtagaatactccagggtggtgtgagaaagacatctcctggttcaagatttcctaggggcaaaaaaagaatacaaaataataacgtggtgccctagctgggcgtgtaattctgtgctctgttagcacaatcagccttgctgtcctttgtggatgctcaagtccctgatataaaatgatggtgcatatacttagaacacacagacatccactcatagactttacatcatctctagattacttatgataccacatacaatataaatgttgtgtaaatagttgttatactatattttaaaaatttgtattgttttttattttttagacagggtcttgctgtgtcacccaggctggaatgcagtggcgccatcgtagctcactgcagtctcaacctcctgggctcaagtgatcctcccgtcttggcctcttgagtagcttggactacaggcacatgccaccacatctggctaattgtttattttttgtagagacggagttttgccatgttgcctaggttggtctcaaactcctgggctcaagcgatcctcctgccttggcctcccaaagtgctaggattacaggtgtgagccactgcgcctggcctattttttattgttttattgttatttgtatttttgcctcaatattttcagtctgcagttagttgaatctgcaaatgtagaaactgtggatacagagggctgacggtacagctgtagagattgtacagaagaaaatacattaataaatgtttctagatgccatattgtattttaaagaattcctttaaagaagctatattccagttgccaagtagacaacaggcctccagactccctaaggagatgggggtgtgctcatttcacacgagggttctgtcctaggcttgctgggtccgccaaccctgagggagagaccagccacagctgctgttgggtttgcctgacttttatttttttgtttttgtttttttttagacggagtctctctctgtcgctctgtcgcccaggctggagagcagtggtgagatctcagctcactgcaagctccgcctgcctggttcatgccattctcttgcctcagcctcccaagtagctgggactacaggcacccgccaccacacctgcctaattttttgtatttttagtagagacagagtttcaccctgttagccaggatggtctctatctcctgacctcgtgatccacccacctcggcctcccaaactgacttttgtttttaatttttaaaaactttaatgcccttttgcagcaatagggtcttactatgttttccaggctgatcttgtattcctgacctcaagttatcctcctgctgtggcctcccaaagcactgggattgcaggcatgagccactgttccctgctgggtttgtctgacttcttaggaaaatcatcctgagatcagtgtttctgaatcctaccacctgtctcttgttatcttgtctgtagagccctagagcagcaggacccatgtccttggcactcactgaaaaagccatgggacccagcaggccctgccccaggacgacaaagcacggtgctaccacggcgcagcactcctcgtactgggagttggggagaaaaccaggctggtctatcatctacactcatttttttcttttgtgataaaattgcagaaaattcagggtgttttccctgcccttttggagggatgctatcttgatctcagcgcacgctgtttcacagagctgacataaggagtgaagattaattgtctgccacggcaggtgctttcgcatatgtggccgtgtgtgctccctgagacagccccaggaggtgtgggcgtgatccgagtttgtggctcaggatctgcacaggcccgagagaccctccttgaggacgcagtggccagtgggggccaccatgtcagggttgaaagtggggctgtctcagatcctcccactgtggcgtttccttcagaaccgagttggggcaggaggggacggagggagagaggcaggaggctgaagcgccgaacccaacgcaaatactaagcatttgatggggttgtctgtgttctaagttggaaaatacaaacttttccatgtgtaccttagataacctcactggcgtttgtcattctgcttttggaatgcttaggcgtgaaagcagcacagcgtcacggtggtgatgcttgcgtagcagtgtgagagtgcaaacctgaaaatgggaaaaaatggggcattttatgttacgtacattttaccacagtgaacataaacagttttgaaaaaaaagaaaattgctgaaataccattgagcttatcagaagagctcagatttgagtgtgggtcttgatgggaagtaggagagcagaaagatgggtgggaaagtgggaatgactgtgggtgggtaacgagggtctcagttttggcttaaggacaggtttcgaaggagatgggcggcccctccctctaacaacttgatatgtagtgatcaatgctctgttgatgtgggtttggcgctcacagagaggataggcagtgtgctggtgggctgctggtgtcctcacagcctctgaccaccagcctggacgtggggatacgtctctgcagaaccaggccctgccagtgaccagcccaccctccccgggggcactatagcaaccgtgtgttgttgcctgggactcacttccctacggggcattggttccagtattgtgtccactctcatggagtatgctcgtgcgcagagatgcagccacccagatcttcatctttgtaatgatgatcggggctgggagcagtggctcacacctataaccccagcactttgggcggccgaggtaggaggattgcttgagcccaggagttcctgtccagtctgggcaacatagcaagatgccaccagatgtggtggtgtgtgcctatagtcctggctactcaggaggcttgagccttggagtttgaggctgcagtgagctgtggtcacaccattgcactccagcctgggtgacagagtgagaccttgtctcaaaaaaaagagaaaaaaaagaaaaaaaaagacgctgtatgtattttgccctaaacagagtggacagtgatgtgtttatacacatgtgcatgttcctgggctcaaatcctggctgtaccacaccaccctgtgtggcatatggtgagcaacctaacctctctgtgcctcaacttccttatctataatgtgaaaatgacaataacaataggtactttagaggtttgttggggaaaatacatccatttatgcagataaagcacttgcaacgaagccagacacatgtgtaaacatgcaataaatagttattgttatttcaggcacactgctgctactcaaacatgactttatggcaacaggcagttgttagccatcgactcactttattgaccaaacttggcccccaaatatttgctaactctgagaccccagctcgctatctgcagagccacatgggcgtcccatttgccagtggcatctgaggacatccttagaagaacagctcctaagggtttccagggatggcagcattatcggaattcctgctgtaaactcacgtgaacatatgctcttctattaatagttcatttttaaacaacaacaaaacaagcctcggattcttgaagatgccttggtaagttgatcttatgtccctgcatgatgaattgttctgaatgtattccgtgaagatcgatttccccacaggaagaccctttattacctatttgtcatttagatgcaattattttgctgcattttataacaaagtggaaatagaatttaaacaaacatgtcgctgagcagtttagactccatatctttatcgttactcttccctgttgtttgtctgatgcaaacatttctgggcctggagagccagtcggcgttagcggttattgactttcattgaattttacgctgggcactgggctaggtgcttggaaatgacaaaactggaaaatatttcgtggaataaaatgctacataatttgcttggatggcaggcttctttggggcagctcatccatgtcacatacacttgcacagttagtttattctttagcgtggggtaaaagagagggaatcatgcaaggtgggacgatttcatttctgcatataaaaaagtgccacggggtctttgatccacctccttgtgtctttttaagatcctggaggcctaaagggatttctgtttctggcaggaatttgggcttgggtcagagtccaggggtgagggtaggcccacctgtcatggcactgggactgggctgctgggtgtggggcccagacctgcgggctccagacggagccttctctttgtgcagtccgtgcacacatgagcagccctgactcttagaaacgtggtgatggggaggagacggtgaaaagagtgtttatgattggagctcaggactggagaggaaccggggcagtgatgagcccagctatgttcacactcgtatctgtcatatcacaagtgagcccataagagggagcaaagccttctctcgcacattctttcaaaatgctttgaccagaagaagccttgctgttggtgtagggatgacggaggaaaggacgtggttcacttacgggccatgaggtgagccgcggaggcccactcctagatttattgacttcacatgtgttcctggagcacttgctgtataccagacactgtagtaggcactggggacacagggctgagtaaggtggaggcagaccccatgttcatggaattcacacatgtctggggagacagaatagagtaatcaaatgtatcctgccatttcagacagcattcaggtcccgtagaaaatcaagtatgggaaggagatgggcaagagatggggggaatggccgttgctgataggagggcaaggtgaggcctcgctaaggacaagggagggcaagggcacatagagagcagggagtgtgggctcaggaaagagcagccagggcagaggactcgggctggaacagagttggtgtttggggaacagtgtgtcagttgtccagaggccacatgcccaggagcagacaggcaggtgggcagtcactgtaatttcattcatttccaaaggaagggagaagctgggtaagactgtcagttttggctaggaatgtttgctatatatttaatacatttatattgtctttttctaaatcatcgctttgaaaaaaaaaaaaaaaactgtccctttctccaacactgagtttcaccacagtagaagggctttatatttagggttactgcactttatgtatttcctggctccttgtaagtgcattgctcagatgtgttggtgtgagcgtgagaggagcaggttgggggttgggcggactctcctgtgcgtccccgaggccctgggaaggaagtcacccaccccgtagtggagaggatgccccgtgctcaggtctggacagcctgggcctgtcttcaggagagtctggtgcaggaagcaaatgatgatgttttgcttggtctttgtcccccagatgcaggctgcagccatttggggtcagacacgtggagaatggggtctgctcccagcctgggttcacttctaagctggacccgccttggggactctgaggctttttccttctgtgtggtttcagcccccctctggcaggtgaccagtgccaccaggccctgctggaagttatcctcatgcttccctgaggtttgtggactgacttccctgctggaagttactctcacgcttccctgaggtttgtggactgacttcacagtttccaacggtggttcctccttatccgggacgatggcaggatgaaacagcgcagagaatcagtggtggcgctttgccaaatcgctctttcatctgccatactttgtctcttctcacctaaaatgagaacatctgatgcacttttcatgatatttcagcattaaataccgtcttttaaaaagataggaaccaacaacgtgcttttcccttcttttccaacagatccttcaggctgtgggccccgttcctttttgtttgtgcccctgggtgagtcctggtttctgtgcaggtgtcagcacagccccttgccctttcttcacaaccacagctgctatttggttataggaccctgctaccctgacccgaactcacacttctcttataaacgtcccattttcagaaactcacttctagcgttaatggttccccagtagctcaatcttgaattacaggattgttgtctccaataacttgaacaatttttataatctagattaccaaaacatgttttggcacctgcagggctcttcttttaattaaaaagagacttacgaaaaattaaagatctcttcgtttttaagtgaaaaacattacatcttttgggatgctgaatctgggtatgttttgtgaccaagagtcctaagagttctcatttctaaagtctttctaacacgttgcatttgtttccgtagctcctaggtcagtgctgcttctatagacagcaattagtaaacatatgttgaatgaatgaaatggtatttgtgatgatttggggactcttccatcattcaaattccaaattgcgaaaaccaaagaaagttgaatggataaatgtcaaccaggaaggaaatctaacagttttgtctcgagattttatcaggaacatgggtaaaggtgatgaaaaacatgcttatcacatttgcgaatgacaggagattggaaggggttgctctcccactggccttcacaatcaaaacttagaaacaacaatattaaaacattaagccagtctccaaatgatatgtggttaaatgataatagcacattcttatgctgaaatagtatgtagctattaaaatgatattgaaaaacagtatttgctgtcctggagaaaggcttacgatacatttttaagtggaaaaaagtacatcctaaaacaacgtgaagaggatgattctgttttttaaaatgaagaataaagacttaatagacggatgcatgccagaatgctaacagggaccacccctgagtaggagcatgaggcaatttttactttcttacccttgttcatttataaagtttcttttttaaagtaagaatggaagtgttttatcaaaaatgagttaataataactgttcttttgtggtgaataaaataaaacatggggactggagtctctcttctgtggtgaaaaatatatcggcctggtgcagtgtcatagactgacactaggacccatgatcacttcatggcgttattatcaggaaagagtccatctgagaacagatagcaaaactctctttgctttcagaataaatggcagtgagtgtatgttggcagttcctgcattgtgaaacccacaacgctgtgtgaccttgggtgagttacttcacctctcttggcctcagtttctctgtgaaatcaggaattaacatggtctctgagacccccttctgatggtgaatgtgtggtttggtgattttgtggccctgcatcatgaccttatttagttctctttcaacaggggatgttttactgccttgtaaaatcctcgtgggactgcgtgtctttataggagccagggtgtaaatgaacagaattcagattggttctaatatattttacctctaaaagaaagggcatggggaggccatgaccttaaagcaggttttttctgttgtctgtgaagcctgtgatgattgagagtggctgggactggcgggacgatgtttgggtggaagagggaggccatctggatgcgccctgtcccggggaggcacccagcctgtaaggaggtgatgtctatctacactgagcgcaaggaccctgaaccgggggaggctgaggcggggcctcttgattcccaccctgtcccccagtggctaggctagtgtggcccgggaaatgacttccatctctccctccaggcatatttaataagaggccagtattttcagattctgccgcttctggacgaatgtctcagagagctgggaggcgccctggaggatggaacccttccttgagcgttgttgaggtgtgtcgggggtgccgtggcacaggccccttcccctggggggcatcactgttcccttgctctgcatccccgctgtttcccctgcccctgaacaggcgtggagatgtgcacgggacactcggaggccggatgctcaacagagtggagtgccgcgacggtgtggccgcagcctggctgtgccttcacgacgcagctgcaatcagaggagctgtgggacgctgtcccacgtggacacagcccactcactgggtgctgctcctgtgctgggcgctgcacttttattgtcgttaaaaatttatattaagatgcggccgggcatggtggctcatgcttgtaatcccagcaccttgggaggccgagacgggcggatcacgaggtcaggagatcgagaccatcctggcttacatggtgaaaccccgtctctactaaaaatacaaaaaaattagccgggtgtagtggtgagtgcctgtagtcccagctactcgggaggctgaggcaggagaatggcgtgaacccgggaggcggagcttgcagtgagccgagatcgtgccactgctctccagcctgggcgactgagcgaaactccgtctcaaaaaaaaaaaaaaattatattaagatgcttaaaaagtaactgtacaaattcaggccctgttttaatatgcgtttcagctgtcggtggtgtttcagaaatgcatgcaaaagaattgaaatcgcaaatctctgtaggtcgtatgaagaaggaaagaaaaaagcagtgtgagcgaaacccaatgaagaggtcgtaaaagtaggtgtgacctctgtgaaccctgaagcagtgggaacccctgggaaggtcacggatcccctaagggaagctgcacgtttgctattttgataaacagaaggtagtaatgatgaacaaatacaaaattattattataatattatgtataatattaatattattagttagcatttaattatataccatgggtcaggtgctgtgctgagtacttcatatatagcatctctttagtctccacagtgacttcaagaagtaggtattgaacctgttttatacccaaaagactgaggcttagagagacaatacatcttgttggtggcagagttggactttctacccaggttatctgacactgaacccaggcccttaacctagtatgtgtgatcttaaaatggagaatgtaaactacaagttcgttgccaccatttttttattttgttttgttttgaggcggggtctcactctgtcatccattttggagagcagtgatgcaatcatagctcactgcggccttgaccttctgagctcaggccatcctcctgtcctcctgcttcagcctcccgagttgctgggaccacaggcacaagccaccatgcctggctaattaaattttttttttttttttttggagagacagtctcgctgtattgcccaagttgttcttgaactcctagccttaagcagtccacccgcctcagcctcctaaagtgctgagattactgcaggcatgagccaccgtgccgagcccctatgcgagcgttttcaccattggaattggaagcgcttcactgtggactgttgagctctggcgtgcagggccctgtcctgctctgagctgagggtgtctgagtgccacagaggtgtgggtgagcacccaggctcctgggcccgctcctgtcgcagctcactttctgtcctctagagcaggcagcttatcttgctgtgagagacaattccttcctaagtccgtttctttaaactcagtaaaggttccacggtgattcttcctgtgcaactttgaaaacagcgatatcacatttcttgatggccgagaatgttgcctctacttttgcagcatattttactctgtcatctaacagtgctgggcacccatgctggcagccccagtgctaggggacccacgcccatgctcttgtgttatgcctgggccccctggggagcactgtcctggattcctgcctactggtcctctcggctgatgacggatggtgaaattgcagcccccaagtgaccttggtgccttctagctgagagagtcacggatctcagttgggaacacatggtgccaaggtgccatgggctggtttctgcaagttgtttgcaagtcctagaaatgacagtgacctgtaagcaagaagcttgggacctctatatgtcaggaagtgacatgtgcagtgctccctgggcattttctttgttccagagaagctggaacacctggcatcatgcagaacaccaacacgaggatatagtcaggaggacctcattctctgccccgtcgatgccgtggtgcgcatgattattattttgtttactggggaagaggcttcccctttgtgctgggcctgcctgctctggaattctcagaggagcctcatcattctgactatctctgagcgggagctacagtgggagtgggcaggctcctgggacctggacagggtgggaggctgtttcccacggtgcaggctggggccgactcctactaggcctggttgcacttgctctcacttgccatgggtttttagcacagtggtcccctcatgcacctgctgaggggcctctgcacactcacgggaggaagcctgtcctccagggctgcctgtccctgagtagaaatgcaactgtcagggtgcttaggatggtgtggtgtggcgggtgaaggtggacttgagtccataacctttgtagagcagacactgactcagcaataaaatgaggtgactgtttattaatggcaatttaagtccaggactgtcggcctctgccctttcatatgtgcgataaacttagcacggcgtggcgggctgcaggacggaatagtaaacaaagtgcgtggcggtatgcattttaagcttttcttttgatgggttctctgtgtactgtgtgtaggatgccccgggatatcagctttccctacccttgctgtaaacttgtgcatgagtgtgcgacactgctggatgtcacctgcgcgactctggtgcacccctcatagaggctgctctgaatgtggctccagagcttctctcatctcatttattattagagacataaaagtaatttagctgataggaaaatgtaattttttcttcatcatagcattagattaattgacggtgatgtgattatcccgagtaaatctacccagtgttatagaatgcccacagtgcttaggcgctatgttagcaccgcagttggaggcaaagatgaacaagacaatgcattgtgcctcaagtcacttacatatgttaactgacttttctaatttgtaccaaggtctatgaccataccaccctgaacacacctgatctcttctaatttgtaccaaggttacctgagggtactaacaccggtaggagctgtatgagtgcatcttgtccagggtttcacccccttgggagcagatggccattcggagctcagagaatctttgcctggccaaatggtgggcgtggacctggccagcttctgagaaagggagccaggagctgatagggcagtggaaccacctgtctgccttggagatattttcttcacagccctcaccattgcttttaatgacatatttgtgtgtttcttatactagggtctgtcccaccacgttcctgagggtaggacctaggtccctttgtattaattgttctaagaactccatgtttaagaaaccataattagtcagtttgacaaacggcacccccctgcccatttccacatcttcaaaactggaatttggtttataattgatcaggtcttacaactacaattgtttgtattttctttttctttcttgttggcacacaaaatatagtgtgttacaattactgtcaccttatattcaattatatatgaaatatgaagtccaggcacaatggctcatgcctgtaatctcagtactttgggaggccgagatgagaggatcacttgaggctgggagttcgagaccagcttgggcaacatggcgaaaccccgtctctacaaaaaatacacaatttagccaggtgtggtggtgcaggcctgtagtcccagctacttgggaagctgaggtgggaggatcacttgtgacttcaagtttgaggctgcagtgacccatgatcatgccactgcactccagtctggctgacagagtgagaccctgtctcaaaaaaaaaaaaaaaaaaaggtgagagagatagagtagtagggtgtgagccgtagaaaaccagtcaatagaaggcacacagctttttttttaaattttttttatttttatttttttggcgatgaagttttgttctgtcacccaggctagagtgcagtggcgtgatattgactcactgcaacctctgcctcctgggttcaagcaattctcctgcctcagcctcccgagtagctgggattacaggcacccgccaccacacctggctaatttttgttattttagtagagatggggtttcaccatcttggccaggctgatcttgaactcctgacctcgtgatccacccacctcagcctcccaaagtgctgggattacaggcaggcacacagcttattaatcgagcttccttttggcttggaagttaggatgccttttcttcttctctcccgtagctccttttttttctttctctttctcgtctttttcttccttctttttttgcttttagaaagtttgttgggttttgtaaatcccatacagtgaatatgggttactttttaagcaatggaaataagtttactgaagtgatgatgattacatcatttggctttgtgtgcacagggtgaaggtctctaagaacatcttactgagacttcagaggagctgtgtgatcctgcctttgtgtcacagcccacccctgacccccaaataggcctgcccatgaagagctgggttctgcctgttttccacattacctccgtgacatggtataatcacactgtttattgttttttgtttgtttgtttgttttttcactagggaagtaactggctagtttcataatacagatgagaccaggcctcatggcagtgagtgagtgattgaggagggcctggaaggggtgggtaggctgctgcctcccctcccagggaagggggagatgtgtgggggcccccttggggatcctgtgtaaaatgcttaattgccctctagggatctgtccttaactatagatgattcctcaccatattgtttgtggttaccctgcctatagattattaaataaccttgtctcttatttattgccattagacacaggaagactttaagctactgatagataggtcagactattaacctattgtatcttatgtgcaatttacattcttaaacatttctatcttcaacctgtatcttatttagtttctagaacatatgccaattttgtattatatctgacagcatgaacattctctaaactaattcttaatggactgtttcattcttagattagggacagcttgggccattcgcaagctggaggagaagagtttcagatgaattccagttagtacatgtagaagaattgaggaaaatagaaaatcaccatcagaacatcataataatgatgctgtaggtgagacctgatactgggtgctgaaattagtcaatgagaaaggagaaacaagatatttgaatagtctcaaagtgtctttccaagtataaatgtttattaattatgaaaagaaaatagtaggtttagagtgaaggaaactggcaaacactgagtgctcaaggtcaacatcagcaacaataaacatacccacacgtggtaccccagggcacgacgcactgagtgggcacactgcctctgtggtgttcttcccagtaatgcagaatcttattctaatcgtgataagacaccgcacagacccaaatcgaaggacgttctgcaaaacactggaccagcagttttcaaaagtgtcaaggctctgaaaggcaaggagggacttccgacctgacatggcatggggggcgctaaggagacgggacaaacacaccacaggctcctagatgggatcctgatggggggcgctaaggagacgggacaaacacaccacaggctcctagatgggatcctgggatagaagagggacattattcagaaaaactggtgaaattcaaataataataggagtatgccaatttaatttcttagttttgatgattgcactgcagctgtcagatgtaaacactggagaaggtgggttaaggagagtagacaggaactctagtgattttacaactcttcctcacatttaaaattatctcaaagtaagaagtttacagaaacctttatgggtatgtatacccttttaattgacattcagttttgctattgtttacacagtgaggcttaatctgcattaatggatggaaacatagcatataaggagtccaggatgacagataatggcctacactggactttgaaatatgttgtgtatacatttctcctccttcctcagatttgccttgtgattaggctaacaatctaagagataaggccaatcaggttagatgctggcaggaaattcataaaactgattatttcttgggaaactgaaagctctgtttgtaaaaggctagcttgatttcagtggatggctttttgttagtgggaagtggagattcagggcaaaatgcaggaatgggtttttagggtacagtggctgcccctccagttgaaggtccatggggtgcattctcatggccaccagagaagatggcagttagttattataagtatcaatacgggccaggtgcggtggcttacgcctataatcccagcactttgggagactgaggcgggtggattgcttgcatccaggagtttaagaccagcctgggcaacatagcaaaatcccgtctctactaaaaatacaaacatttagctgggtgttgtggcatgcacctgtattcccagctacttgggaagctgaggtaggaggatcacctgagtctgggaggtgaagtttgaagtgagctgagattgtgccactgcacttcaacctgggtgacagaaccagaccctgtctcaaaaaaaaaaaaaagaaagaaaaaaaagtgcctctatagagtcctaagagcaaaatcatcttttgttagtatgcttatctcatagttttgccgtaagtgcttaacaaatgcttgaacaaagcatttgctattagactaatatgttactacttccaagtattttacttggatactgatatggtttggctgtgtccttacccaaatctcatcttgaattgtagtttccataattcccacctgtcgtgagagggacccagttggaggtaattgaatcacagggatgagtctttcctatgctgttctcatgatagtgaataagtctcatgtgatctgatggttttataaagggcagttcccctgcacacgctctcttgcctgctaccaggtaagacgtgactttgctcctcatttgccttcagccatgattgtgaggcctccccagccatgtggaactgtgagtccattaaacctctttcctttataaattatccagtccctgttatgtctttattagcagtgtgagaacagaataatacagatacttttgttgaaattgccatcatgagacccaacccagtagtctgcacccaagttcttttttgtttctttgagacagagtcttactctgttttccaggctggagtgcagtggggcaatcatggctcactgtagccttgacctcctgggctcaagcagtcctcccaccccagcctcttgagtagctgattacaggtgcacatcaccaatgcccagctaattaaaaaaattgtttggtagagatagggtctcactatgttgcccaggctggtctcaaactcctggactcaagtgatcctcccacctcagcctcccaagtgttgagattacagggatgagccatcacgcctggcctgcactgagttcttaagttagtatttgctcagggcaattccctaactctttgacagtagtcagatcagtggcatgactttgcctcagttactgcattgtctgctacttcctcatatgtaatctctggccccatcacactgcctactattcctagagcatgacatgtcctttacacccagcctctgttctttccagctcttaaagtatccttatctttcttttctctctgaaaaatttctgctcattttcagcactcaggtcagctaatatctcccttataaagaagtattatcataaggttccatatttctctattataacatttaccatggtgtttctatttgaatgaatgagattcattcacttctctctcatccattcatatgatattgatcaagtgcctattatggactaggtacatgaggaactagagagacagcagtgaaggttcagacagggtccccgactttatgggcctccactccagcagggcaggtggactgaactagctatataattacggtggtgagaaaaggatttgtttacctgttagcatttctagattatgagctcttggagggcatggatttttgtcttccttgtttttgaagccccagtgtcttagaatagcacccggcagccagtaggcgctccgtaagtgaacgaatgaactgagcacttaatgtaccaatttgtacatgatcttatggacgatcactttgctcccagcagcttctcaaatttttattgatctatgaaccgagctgagaagttcatagttgaagactgtcctgagcttcctggatgcgctgcttccttctcctggtacgtagtaagggcagcgtgtgtgacctgacaggatcacagcaaggctgtgcatcagtcaggattcttcttgcaggcaacagccaccaccagcaggaaaggctcctcttgagccttgctgtcttctcatgtttccagtgccacgtcaagcccaggatggtgctttgagtggagcttgggtcgcatgactgtgcttggctgtaaggaaggttggaatccagtgctgtgcttgtatctgcgttttctgttgcaaaggcactccctttcccacagacctatcaagtggggagggaaggaggtttcagtgcttggcaagaaatatcactgtacatgttcactactcactgacatgtaattggtcaactgttcgtaaattccggctattttgtgtttaagctgatagagaattctgacaaagtaaatgtgagcttctgcggaagtttctatcacagtatttttaaacatgcatcaatatctttgtaaattgaattgctccgtttaacctcatctcatagtgtgatcaatcgaggcctcaggtctctgaccaggcacttgcagtaatttttcaagaacactgtatttgacagaaacagcctggtagaatgtgatttgggaaaagggataatgtcttcaattgagtacggaaattatgtctttaaacgtctgggaattctattcaatcattcagtcaactgtcaacatttactggatgtccagtgtttgcagtgacctaacgattgctgtgtagtgatttgcattctttagtaagtttttccaagaagttttatatcttctttctaggagagagtatggttgggctgggcggggtggcacacgcctgtaatctcagcgactgtgggaagctgaggcagaggagtgcttgagcccaggagtaggagtgcagcccatgcaacatagagaaactccagaaattaaaaaaaaaaaatttttttttaaatcactgggaaaagaaataattataagagagtacctgcgtttctacccatacccgaggttttcttgtttgtgatcattaaataagtggatggtgttgctctggtggtgtgctggacatattttctcaaaccagaggtgcactatagtccaccatgctttgttccaaaatttgtagtggaggtctacctcatgcctcgttttgtgccaggcacaaatgaaatccagagatgaacatcttggggtgcctgccttagcaggcaagactcttggttgaagggacagcaggtgggccttggggccaggcatccttgggagatgcctccatccccaccattgcttggctttgttgctttgggcaagtcacatgacctcttggagcccgtttcatccttgtaggatggggttactgatacccacctcattgcactaagtgggccagtgaatgtacagttcagtaccttcctcatgcagttggcatctctattgtcactgtcacttagaggccagaggacaggcaggacccagacactggagtgcatttgatgccaggctgtggaatttgaattttacaaagaggagtcatgtttccatttactaattacacgattaactggagaatatgctaaagtcccccattgtcacaaattacagtttctttcttacttttgcatttctgtgtttgctgcagcccagcaggaggtccattaaaccaaaaggactcattatctcctcaggacagggatggtgagggaggaggctggcttgcagacacctgcccttgctgtcctcagcaggaaagggtggggagctcgagaaggagaagcccacacgcccttctgtccttggactgtgtagaccttcttagggtggcttcattatttgccaggcagtaaactccctgattatcagacacatctgtatgccaagcgaagtattaaaacagactctttgcaaagcctatggaagtgttttttgggcaaccactcttggtactgttttcatgcatgaccttggataattgacatttgtctgtggttcaaactggagatgtccagtgcttacagatacctaaagattgctgtgtagtaatttgcattctttagtaagtttttccaagaagttttatatcttctttctgtgagagtacagctgggctgggcagtgtggtccatgcctgtaatctcagctactctgggaggctggttgtgggggcatctgttgcctggaggtctctggaataatacaacacagggccctgagccccagaaatgctggcttattcctcttgagtttcctcctcagttaagggattattcaggtttccaaaacacacagtctcttatgacctgagaaaggtctctcatttgcatttgctcattacggtgggtaatagactggaagtatgacctttctccagttaacgacccttccccacagacgaggcttgcgtgcctgtgtctatagcacatagtgcgcctgagctgatgatgtggctcttctgaacagctgcggtggcagccctgaggccaaggccccggctactctaggctgggtgtggggtgggaggtgtgctttcccaccaaaggaagtctggttgtataggcagacttgtctccccggtggttagggctgtctgaggagctgctcttgtttccaagagtttcaggtacgtagtgtactgaggggagcccccaggattaatacacaaagtggatgacacctccaggttactagagaggcaaacctcacccccccaggacggtcccttgcaaacccttgcagtccgccatatccatctttcccactggattccagttctccaaggaaaagccagggcctggagccagggccacgctgcccggtgtcccagcccagcaggcatcagggtgggtggggagcctgggctgcccggaggggtgctccctctatgcccttgtaccccacgtggctccttctttgaagctgtgtctcagtcccaggggagagccttccaggatggaggttgagaggaggggaacgtgcatggctctgtcttcatctctgcggtgacttgcgtcgtaggagagctttggtgtgggctgtgctggccagtcatcacagtgccctgcagggcgcagggctgagggcaggctgaccagaccttccatgaagagatcgggctggcggggacactggagtcctcaccctgctgagtccagctctgccacacgtgggctattctgagctatggcgagtcatcatcctcagtttccctttggcgaagtgggcccagtgatgcccaggagcaccttttgagggttgagtgtgcagctttaaatgcgaatgcccacgattctgtgttctccagccaagtgtggggtacccagacctcttccagttcttgcccttcttttaagtggtttgcatgagatcctccaagcactgtcactttttgaaaccctggcttttgtttccagtttccttttccaacaataacaggaactttgtgtttagtggttggtggttccaccttcacttaatgggttcgtcatctctctgggcatgtgagcagggctcgggatcacgtctctgctatagagacacacggtgaaaacaggcttcagcagagaaccaccgtttgaattatatgatggcttaaagaaagctctgtgtctacttctgacgtctgtgtttcttggtatgatgctggcaccttaaaacatttttgcccgtgtctagtaatataggaattcattcactcatttatttattcaacaaaattttctttgctatttgcaaaaatgttatttgctatagcaaataaaagctatgctctatgcaatggaagaacacaggtatgaactatacaagattaattcctttacaaaactcttaataaagggaaaaacacttatgaaaatagaaggtatcattaataattatagcatacacttacataatactctctgtgccacactattcttggtgctttctatttatattatttcaattaatcctcatagcaacgtgtgaggtaggtactatttctgtctcctttttatagctaagggaactgaaccacagacaggttaagtggcttgcgcaagattgcacagccagtaagtagtagagccagcttcgaaatccaggcactcttgcagcagtatccactcttaatcacctgtgctacactgccttggaaagcagttgttacattagaaaagtgaaggcagataatcctgtggggaatggcttgtagcttgagaggttccagagttcacatctcactgtagtagggatacacccagccaaagtctgaaagttagaaaaattattttaagaagtatgtttgcataagttgattccttctctttcaggtttatctgccataattcataaggctcatacaaaaattcaatgcgaaagttaggtcttaaggaaaaccacgtgatttgtttcactttggtgcggtggtctaaacctctctatttatttgccagtagaacaatgctttattagtttgctgtttttctttttttttttttttgagacagagtctcactctgtcacccaggctggagtgcagtggcgcgatctcggctcactgcaagctctgcctcccgggttcacgccattctcctgcctcagccttccaagtagctgggactacaggcgcccgccaccacacctggctaatttttttgtattttttagtagagacggggtttcaccgtgttagccaggatggtctcgatctcctgacctagtgatccgcccatctcggcctcccaaagtgctgggattacaggcgtgagccaccacgcccagccagtttgctgtttttcaaactacataatcatgctcccttacagtggcctggagatgtcagtattcctttttgctcaatcagtttattgtaggtaaatgtgtgtgtgtgttgtgtgtgtgtgtggtttgtgtgtgtgtgtttctttttatctaccttctttgctatatacattttgccatatgaaaaccctggtaaccactgggcacaggtttctattggtagacaccacttatccacggaggaagtgaggacccggaggtgggaggcttccccagcaacatggctcacatctcgtttaaggtgctgacagtgctggaggctgggctgtttaaggtgctcagcagcactgcacccgcactgagccctggagctcccgctccccacccgccctctgaggccctcccaggctggctcctttctccctctgtagcttcctcctcaattaggctctcttccaactcccaactcaaccctggttgtgccagaagtgaactcctctgtaccccctccacctgggcagggctctacactgccaccccttctggtcacctgccttcagggcctggctgggcgccatccttatagggagcctctcatggttccagggacccaaagtcctttgatctgcctcgcccctgagacttgcaagttcataccatggggtctggcctgaggcaagcctcttccgggtcgttcttcctgcctgatggacccttaaagctgcatctcctgttgctgccctgaagactctggttgtgttttctgtgtctccggcctcgctgctgttggcttctgggtctttattccattgcaggccctgttgctgtagacagcccttgggttttatgtgttcaactttcgaccaacctgcactttggcacattgcatgttgtgacacataaaccatttttggtgtgctaagttcaaagttttgaacaacagctgatgaacaaatattttgagctatgatttgctggcactgcttgcaagtttggtttctgaagcatttatttattcagtctacattcattccaaaatatttgcaagtgcctatggagatccaagcattgctccagagaatagaagctaagccgccacacctggttcccacccttgggaagctttcagcccagcctcacctcctttaaaatctttgtgcattagggactgaaaaccaggaaatagagattttatataaatgaatacatagatgattgaatttagtggtggcttgattctaggacacagaatacttcatgtacttttatcaccaatgatgaaaacttgcggtgagtgcttcaattggaatgtatttgcttggctttacaaatgaccttagggctatatttatagaatcattaagggtctgaaggagttccttaaatttttagttatactttgctgcattttattgggaacattatttgctataatggcatctatgcagttggggatccacataggttttgggacaaggacatctgtacgtagacatctacaacccagaggtatgctcgttaatgttaatttttgtgtcattttacaacatattgtgccatataaatgatcatccaaaaaaggaagcaatgaatttggaagtcatcaagccatagttttggatcatgattaggtccaaacttttgcagacctgatacctatcttggagatttttattttttttattttttagagacaatcttgctcctttgcccaggctacaggaggctggggtgcagtggtacaatcatagctcaccacaacctatctgagagtcttttaagttctttacgtgaatgatttaattttattgttaaaatatccacacaaatagagactgttaatatctgccgtttataggtatccaaactgtgacccagaaaggttaagtcactttcccaagatcacacaggtaataagtagttgcaccaggattcaaacccggcagtcttattctagtgccaccatgttatagcctctcccttctttgcacctgaaatttctcagctctaaaataagggaattggtttatataacctttagggtctcttccagcctaacattatgtggtctctgacgtattagctggtagaagactggatgtaccctcacgtgcacatgttcacacacacctccacagacacagacgtgagcctggtggacctcccggaaggcgtgcagcaggaataaatcatgccaagagctatgggtgaggagaggacctcggcaccattctgcaggcactttcaggggagcaacacctgtgtcttgttaactggctactacattttgtgatttataatggaaaaaagtgacacctacaatactgagaacctttttaaaaggggggttctcaggacacagcctagcagagcacagaatgtcttcacatctccatttttcacaaaaataaagcacacgggccttaattgaagatgagcttcatgaaagcatatctgaggttggtggcagattgtggaaaactgacaaagcattgctttctttattataaacaaataatcaacaaatacaaatagtggattatgaattagaaattgcttgtgttagattgtccagaatatcaaacactacattgatgctgttgctcctgaaacatcactcttaagataagcaacaagggtgagattataaggaggaaattacataatcatagaaaataaaataacatcgccaccaataaaagatgccagcactaaataacagcccctgtctagccctgtctctgccaagccccactctgagcgttctgtgggcattatctccctgcatggcctctggaaggaatcttactgccattttaagcataaggaaaacacagcttaaatatgtggcccagtctagcatttattttgtagtggaatcagggtttaaactggagaccctcagtactgaaccctactgtttatcctgctggaagaagttcacggtgaaactttactcaggctttggggcccaagtgcagaccttccatgcatgggcagagaacaaagtggtccctggtcagccctgaatccctgcttcctgggcttcacagagggtaacaaatgaccacagaatactcacttcagaacggtcgcgacactgcagaagactttagtcccattcactggtgctggaaggcacctcaggactcagcatctcagtgcacagggagcctagggtagcttggggtgacttagttcagcaaggtgccctcatgcaagaagccgcccagctgtggtaatgggatggggaagcctctaagtctcctttttgtacagagaaaggcacgccagggacgctgagcaaaatagtcacggctccttaaaagcagggagaacatccttccgcgctgagcactgcacaccctcttctgcagtctctgcgagggagagccctgcagggcggatgtccaccaggctgccggttccagcccttgctgcccgtgtaggggtgtccatgggcgcttggttctgggcctgtgtgggaatagttttgtatagtttgactcttatttccagatcattcgtgtcctgggctgtgtgggagccagtggtaggcaaggggtgtggaattaggaggcctacctggcttccacccctctccctgggtctgtggaggctgcagctccatcaggccatcacccgctcactgcagctgggtgtgccaggcaaggaggtgagcatgcagggtggcctcccagccctcccccaggtgacctgtgctcatttccgtttctgagtccccacttcctcctctaaggtcatggcaaagagccctggcggctgctgcatccagtcccatccctgccctgcctgggagtcctcagggttccctgagtctccctaggcatctggtagccgagaatagaagcttctggccttcacgcgtcagaaggcacccgtggctgccccttacttctgcctcccagcgttttgtagacattcttctcctgagttccccctgccccccacccaccgccctgttgtttccctaagtgccgtttgtagaattaaaagataccgtggacacttagaggaggcagaaatacaggtattcctacaaactgggtcccctgcaggaaaaaacgtgcccttcagagtgccagaaagctagcctgggggacgggcctggggctggggtgggcaggagtcctcgctgcacctgcagccttggggcccctgccgtgcctatgctgcagtcactgactccttagacctgtgcctagtctcctactgaagggctaccccatgcttctgatgctcattacacaccagctacggaactcccccggggaggagctctgtttcaaacacgttaatttctgttgtgaggggtcagttaccgtttatctaagtattactgaattaatagcaatttttggccaatatgtgtttctcggattcattccattattgtgccattcctttggtcactgaacattcatgattatggagcaagaagctcagtgcacatgtcacatgggcttacactgtgggaggtcagagctgcaggggagactagacagagagaagactagaagactagacagagagagatggtgatgtgagcttcagccccaaatccggagaaatactctgtctagcctaaataaggcttagtcattgccacttgcaaataaagagagatattcctgcaaatatatgcttgttaaaaaccagtaaggccaggtgcagttgctcatgcctataatcctagcactttgggaggtgaaggtgggaggatcacttgaggccaggagttcaagaccagcctaggtaacatattgagacccccatctctaccaaaaaaaaaaaaaaaggccaagtgtgatggcctgtgcctgtagtcccagctactcgggaggctgaggcgggaggatggcttgagcccaggtgttggaggctgcagtgagccacgatcacatcactacactccagcctgggtggcagagtgagactctgtctcaaaaaacaaaaccaaaccaacaccatcaccaaatttaaaactatactttctgctttctgtttatctctctgcatatctccagcaacagatctgttttttcctcttctgtctcagcaagccttgctccagccttcatagtgccatgtgctgtgccaggctgtgggctgtagctgcttgccgctcaaccttggtgacatgctctccaactagcagaggcggaaagctggtgttgggaaggagtgtggcactggagctggtagcaactccctggggagtctagcaggctctgggttaatcctggcagtcctctcaggctgggcacaacttagcctgcattgagcctgggtgaatgaatgcctgccacaccactggtgtccagaagcctttactgtatttccttaatattgatgtaatcatgatgagccaccacttctagaaaactctgaacatttttggcctttaagggaacaagtttctaattttaagactaaagaaggccgggcttggtggcttggcagggcgtggtggctcatgcctgtaatcccagcactttgggaggctgaggagggcagatcacctgagtttgggagtttgagaccagcctggccaacatggagaaactctgtctctactaaaaatacaaaaattagccaggcatggtggcgggctcctgtaatcctagctacttaggaagctgaggcaagagaatctcttgaacccgggaggcagaggttgcagtaaaccaagattgcgccattgcactccaacctgggtgacagagcgagactctgtctcaaaaaaaaaaaaagactaaagaagaaccccatttactacatttctcactgtgctgtgtcttgagcatcttccagtaccgtacctgggagggctgagtccacgaggcgctcgtgctcactcactctccatttgtgcttctagctgctgacctctggagtgaatttttctgcagaaatccttggctgctccccatgtgtgcacctgaagagttatagaaagccctgttcacgtttctttcacacatgtcctttatgtcatgggcaacctgtgttcattgaaattttatgatttctttgtatcacgtgtgtataattttcactgtacaagaaacttatatacttaaaacatcttccagtgttaggcctggtgcgatggctcatgcgtgtaatcccagcactttgggagacgaaggcaggtggatctcctgaggtcaggagtttgagactagcctgaccaatatgatgaaaccctgtctctactaaaaatacaaaaatcagccgggcatggtggcatgtgcctgtaatcctagctactcaggaggctgagacaggagaatcacttgaacctgggaggtagaggttgcaatgagccaagattgcaccattgcactccagcctgggcgacgagagtgaaactccatctcaaagaaagaaaaaaaaaaacttccagtgttttattggctactgatttggacacttagtggagagaggcagaaatgctggtttgtgtgatttatacagctgtaatatttaatggctttacacgactaatgggccctctggttcaaggtgaaaccagaggagcaaagtgtgtgctgattcttgtccatcttcttctttagcttgtgtgtctgtgtggacgtctgtgacaggagcacagatatcaggtacaagtgaaagaaacaaaactcagccccaaagtgcactgacttctcttttcccctccctttagcgcatttgagtccatttaagttgaagcaactattagccacctactgtgctggcccctggggatgcaaagataatgacgtgggtgagcaaagagacaagcaatgacagcaaggtgattagcactgtgttgggggatgcgcgggttgccatgggaacatggaagcggtggtactcagttcctggatggggatgggaatactggagaaggcttcacagtcttggcgaagggtttttctgtttttgttttttgctaaaaggtcagtaggcatttgtcacgcaagggaatgaggagcaagtcattctaggcaggaggaaccgtgtacatgaaggtgcagtgatgggaagccatggtatgcctgagaggcattttggcctccagggggatgtgtaggatttaggaaagactcaggaagatgctcgggaccacatggcgaagggcacgtatgcctcgctaatacggactatgtcctggaagtgatggaatctatggaaagatttgaggtcgaggagtgacatgacatttatcatccagagataacagtttgcttaatagaataaactttcattcattcagcaaatatttttgagactgtattacatgccagaaactgttctgggacccagggaaataacaaataaacaatactgtgaacattccttgtattcaggagaacttacattctagcgattgaaggcagtaaatacaataaaagttaattatatgatttattgattcatttgtttttgcttcatttaaaggtggtaagccttataggaaaaaataaggcaaggaacatagtcctggacctgggtgtggagaaggccccatttatcaataggtagctttgttatacttaaatataaagaaaacttgctttcatttatatttttatgaatttactttcagtgtgcattttgggactaagcttctgggttacatttgtctcatttatgccaattattcttgctgttttatgcacttttccacagagatagtattgagaaaacctggattggctgtggagcagaattaaagctcagctgtcagcctactggggcacttcctccctccaggaaggtggaggaatatgacacgtcggggctccagatgagagctgtgttcagaggaggaagtggtttttccaggtagatgtggccatcccttctctctttaatgatgacagaatgggacagagcagagctggcctcagcaggagcgttcaggctggagtgaggaccagcgtgagttttccgtgctggggttgacggcctggggaggcagctgcattgttctcatcctgtgcttcccgaggtcgaggctctgacaccatcctgctcttcatctgactgacttgggtccagcgatggcatcagtgaatgagtctgtgggcggggcctgggtggtgtttgaggtttgtctgtttggagaaggggtggggacagaagggaggctggggtgaggggtgagggtgattcatacctgtgagagggaggctgagattccccgagggcaggacggtggaccacagtgaccctgtgggaagaggtctggggacggatggcccatggcggcagggtgcgcagagctcctgggtgctgggccatcaggccacactgcacaggtgaaaccggctctcaacaggacatgccctcggggaagaactgaacagaaagacagatttgttgttaattttggaaggtaggggattttatcagccagtgttccattgaggataatgggttttaagcccctgctcctgtttgttgaccacgttattttgaagtctcccaagtctactagaaatattctctttttggttactggggagatagacaaaggaatttaggaaatccttaactggcacttagtactataaagaagttctttatgaaaggtctgaaatgggcatgttcagtcaaaaaatattttgtctttgcagagcttggaattctggcctggcataggttgtcagaaataagtagtttttcctaataaagctgtaactttcagggcaggtgagaggttcccatctctctgcccagtagcggggctggttctaggtcagcctggagctcagcctcctgctgagaacccaacagccccacccgtgcctcttcctactgcagcttggtgtacaggggagtgcacgcaatagcttgccacccactttgatcccagccttgagtgttatcagttacaggagccaaaagccattcttttaagtaccaagtctccatctgggaaggaagagacagtttagttcaccagcagaccttccttgtttggggcctgggacattctcctgcagtagaacatcctgccatccataaaagaggtatgaagatgccatcacaaaattctggtgtgggttggttgaagaatacagggaacatgggtgtttatgtagcccacgccctatgaggtcagtgaggtttgagatctcagaaggaaggccaggtgcagtggctcacgcctgtaatcccagcactttgggaggctgaggcgggcggatcacgaagttagcagattgagaccatcctggccaacatggtgaaaccccgtctctactaaaatacaaaaaaaatgagccaggcgtggtggtgcacacctgtagtcccagctactcgggaggctgaggcaggggaatcgcttgaacccaggaggcggagattgcagtgagccgagattgcgccactgcactccagcctggcaacagagcaagactccttctcaataaataaataaacaaacaaataaataaataaaacaaaaggaaagaaaagaaaagaaaaaagatctcagaaggaagacgttttcaaatttcataaagttgggaaggattctaggcagatgccatgagaagctcaaggcaagaaagtcaggcagtttttacccaagtgggaaaaaaatagcaagctgtgacccacctgagggcaaggctgggggcagccgggcagccatacatgggctggtggagtcttgacttatccctggctctgagctggttgcagatattaagaaataagacaggtggagaaatcagcactcacacccagttctcagggtgccggaggctggaagggaaggagctggctgtttcctgaatcaacagtccagggcttcagccagacaatggattttctctccaaaacacacagtgttgtgctgagagagaacattgtgatttaggagcacagccagatgactgggtagggacagatggaaaaagcctagctatttatgaccttgaggacaggagagaacgattccataattgaagaccacaggtaactaaaaaaaccatgtggccagtaactttaactaattctgcctttaaaaatctttcacaatttgctaataatatattatttccttcttttatctccttcctgcctcattttccatatatttatttctagtgaggatatttactcagctagagaaaattttcttcacccaaagggacacccatagttaactgtggttcctataagaacctctccacaggcttttacatctattcattgatttctttaataatattgattgattgcttacagtaataatactgattgattgctggccatgtaccacactctggggactcattagtaagaccaggcagacataaatccctgccctcatgtagtttatgctctaatggagaaaagaagacaagaaatatgatgtgtatatttgactatcatgttagatggaaatatgagtaggagagaagagtgaagcaggaaaggaggtaggaggagccgggagtctgggaggtgagatggggagtggagtgagggaggccacggcgatggtgatgtttgcacgaaggcctgatgaaagtgagggagttggctgagcaggggtctcaggaaagctctgggcagaggagcagcaggtatggatgagccctgtgtgcagggagcagcgaggaggccaggcatccagagccaacctcgggagggcaaggggaggctggagagctggtgggagccacatcagggagggtcatgtcaagttcattatgaggacttgggttttcactctgagtaaaatgaaagctgttggagagacctgatctgacttccatctcagcaggaacatcctgactgctctcttatgagtaaaccgtggtggaaggacaggggaggagctaggagatcaccatggggaggggagattgtaccttggaggagggtgactgtagtgaggtggtgggaaggggtccatttccagtgggttttggaggtggagccaacagagtgtgtggatgggttgggatgtaagggaaaggaaggggttatggatgactgcagtggcatctctatccccagtgcagtttctgagatagggaaagctactgggggagtgactttgggtgggaaaatgaggtatttggccttggacatagtaagctgagatgtctattatacattccacaaggatatgttgaacaagtgactggaggagtctggggtctagggcaaggtggaaaggtcagggataaatgtgggaattgttagtgtgagacagtgactgctagagatggcaaaggaatggtgtatgcagaaaagagaatggagccaagggtgagctggagcactccaaggttaagaggtcagggagtggaggaggagctgagaggtgtggagaggagtgcagtgccatgtgcgtcgggacatgggaaggatgcggttccctgtgggagggagcagaggtgtcaactggggtctggtgagatgaggccaagttaaccacatgggggtctccagggacctggccaggcggtgttggtgcagtgatgggccccaaagcctgattcggatttgtttaggggagaatcagaaattagacacagtgagtacagaaaacttgtttgcagcattaaactgtgggagcagagaaatgggccatggggcccagagcatctttttataagaccagaagttagagcatgttggccttctcgtgggaatggccgtgtggagctgttgttgatataatcagtgtgtgtcaaaatgtccagaattcaggaatccatttttaaagttacctgtcatttgaatgttcattggaataattcagagcaggcgacggaagtaccaaagaactaatgtgggattttatttttcaaaatccctgtcttaaaaatttatagaatcactgatcataagaatcgaaggacttttagaacataagacttttaggtgtgagaacgcaaagaggctttcaggcctttcagccaggggatgcccttgttcagtgaaccctccaagggaagcctcccctgcatgcagacctgagccagcgctcagggttcctgacgcagctcccgcttctgccgcaggtcgcgaggccccacagggagcactgaagttgttcagaggaaaaatgaaaagctgctggtgtagtccaggcacctcactttatcataggaatctagagataaagagttgcctgaggatacacagaatattgagtgtaagagctggaaggaggccggtatcctgggtcctgggtctcggggcggtggactgtccacttctcccttgctgcctgtggccgtgctccttgcccaggcagtgacgggctcttggtgggtggatgcatgaatgaatgagggactgaccagagggaaagagcctcccggcccagccttcaccacacctgaggataaatgctgccaggcactcttgtgcttcccattttggggcccacgtttctgctgtcaacacctgtgcatctgcctctgttgatactgccaggtggatatggtcctcatcacccacagacctccaatacacatggaaagcacatctgtcagtgggcgacgtggagctcctgttgcgcttcatgattgatgctgctttctctgcagagcaaaatcacgagaaggttatgcgaggttagtcccgatgagggtgtattaaaagctcggcacagttgactttccatcactttcactaagtttatttaaaccctgcagattgagagctgtgaatgggcctcagcaaggcatacaaggctcttcacaatgggatgccttggcgcccaaagtctacctaccacgttgtacacagtgagatcccggaacaagcaagttagggcccccagaggtgcctttctgtgtcttgatcagggtgctggttacttgggtgtttttcggtctgcatagactcattgagctggactttctgatacacacacacatgcatacatacacatatgctgtatttcaatcaaatattttttgaaaaaatgaagtatatttgtccttgaattcaaaatcctttaatgcctctggtctcacacaaagtaaaagccacaggttgtccagaggcctgcaggctccctaggccccccagccccctcgctgacgtcaccttctccgctgccctccaggatgtgtccctgctgagcaggacccctgccactccatgctgatggaggagctcagtacacatttctcgaaaggaaaggaaatgtgtctgaagtaccattgatcctcatgaagaaggactcatgtgtcaggatttctgtttagatgatgccatagggaattaggtactttattagtgcctttaaaattatgaattttaatggctttagagttctatagacatttggttttcagagattttccctgttaaaataggatttttattgtgcctgattataaaatcatatataaaatccacaagaaacttgaaagttattaaagtgaccccagcatcctcagagaaagccactgttgatatatgggtgacgtcgtttcaaactcttctcccatgtccattgcacttattgatatttctgttcttccaagagtttgaaagggggttcttacctactttcggtactgttctatgtaagaagtgaggaagaatgcctcctcgcatcttacagacagaaaaccacaaaagcaaattcattcattcattggttataaacatagacgggaatcactgttatccaccctttcaagccctgaaggacttttatgactttaaaatgccaggtggtgttttgatggaaagttgggtgatttgttcaagctgctctgaagggtaattgcaggtctgtaagtccgaagcctgagagtactttggacttttaagagcacgttgttgcatgtttcacttatggttctcatagaatttgagacccattaaaatcatcttttcagcaccataatgggagcgacaaaccatatcataaaatggattgagtttttaaacattttttattactctctttgacgggaggctcttctctggtaatcttattacttgggcagatttccttttatcatgtcatattcatctttctgaaggacaactatggtttcagcagcaccacttaagataggacttttattaaatgctttggggttaacttaattcattaacacagaatataaaccttcaaagtaaattccactttgttccaagtttatgaacgggaatgtcagcccgtctttgagtgaggtcagagcgtcaccagtgaggccggtgcctttacgccgaggttggctgagcgtggagctggcctgtgacaccaggtgaggcatgagcactgctgcattctcctccctcaggttcccagagggattcacgttgataacacgccggtgcagtctcgcagcctactcaacatgtgcaccttgcactgcaggtttccccaggggagtgagtgcgtgcatcatccccacggcattcccatgctgtcagttcccatgctgtcaaaagctgacgtttaagaagaatcgccctaaggatcgacttttcatttctgaaaactctcaaagctttatcttcataattagctaaagcactactttctggatgctgtgttttggcaactttgtggaaaccactttatggaatcgaatatttcaacctccctgaaggctgatttaggaaattacaagatggggagtccttttccctttttgataaaattggtgtctaggatagcctcctccttgctgaacagcaccctttaataaaaagagtgacagatcctgttaagttttagaagcaggagagtggctgtttctggttgattggaatgcctgcccaagggccagtgaggtcccatgaccatgcctttggtttcctcttggctgtggtggcttgtttggttggaattcggtttagagatgagttctttgcagtcagttttcctctcctctttcctctgcatttcctgatttatgttttgtgttttactcattattttccatcttcactgaattttacttctatttatttatttaagagacagggtctggctctgttgcccaggctggagtgcagtggcgtgatctcggctcactgcagcctcaaactcctaggctcaagccatcctctcacctcagcctcccaagtagctgagactataggcacatgccaccaagctcagctaattttttaattttttgtagagatggggtctcaccatgttgaccaagctggtcttgaactcctggcctcaagctatcctcctgtcttggttgcccaaagttctgggattacaggtgtgaaccactatgcccagcctgaattttccttttattataggatatcttacaccttgcaggggaacaggcagtgagtatataaattaataaaacattgttgtcacctctgtactaggaaatgtaaacttacattgtttatggtaatttatgctaatcttagaacccattaattcttggcttacacgtcactggcagctagatttgacctctttgctatttacaatgtaagtacatggaaaaggcacccgtacagagagcaggttctagactttaatgtcagaaatgatggagccagaatcactctccattttcaggtttgtgaatgatagaagtgtgaactaaatgagtcagtgttgctatatgaattttaacagaaataactaatgtagactactttgccaattcacaaaaaaggctgattttacagctgagatgtaatgctgtatataggtccttattttgtgactgagatcgtatctgtgaaaactaaggctttaaaggagtgtaggggaaattgaaaacaactttttgttgcctgttaactagtagaatgttgactctaccaagcagattaaatttagtctctgtgaggcttgatttgtcctgcttaagattgagcatttatcattgcatcctgaccgagtttaggtttacattattcaaatttgttaagctactggtccttaaaattttttttaacatagcctttttgtatataagtttggaattcacagaaaaccttaagatattccatttcccccctagttttagggctcctaaaattccctgttttttcaaaggttataaaatattaggacattccctttctctgaatcattcttttcctttctcctctcgcacatggtataacccaactggctgatgttagtttgtacacaactagaatgaccttcaggacaaaaaagggtttcctctcgatccgatggaaatctcgggttttatgttccactacaggtaatttgttctccagcttcgggtaagtcaggcattatccctggcctgcttcctcacctgggaggtgaggggtggatcagtgtgtctaggtccctctcagcattaagatttgatgactctgggataactccacaacacagaaaaacccatcagaagctttatgtagaaatgcagagaagctgaataccctaaatgtggagaagattgtgttattaccagaagtgtttacagcgattctaaagtctgttgttgactctggaagttgtttctcctaagttttttttttttttaataagaaatcaaataggaaattttggcaaagaggaatgccactttcttcacttagaagggcatgacttttttttaagaagaggagtgatttaaatcttataggttataatacgtctatagctcctggaggagacactggttcctgagcaactcattctgtattccagtccagtattatacatctgaggttgccatgaatttgtcaccaaaatgtttctaatgtttaacaatccatgatttccctcaacttctagcttggcagaaatactcaacaagttccacaaagaatagacaacatatttttaaaaattttccattgtctttctctgacttgagttttacttcatggaggaccctctctggttctagtctgtcaaagtgtagtttaggggtcaaaactacattggttccaaagtttcccaaatagcccattgacagaacagagctctagcgactgggccctgtagtcagcaattatccaaatacctgcttattttaagagattgtattttagttttcttctttgtaaattagcaaataccaaataaacattccaataaaataccattaactaaagaggaggcttgctgtatgtgagctacctctttctcagtagacagtggttctccatctgcgctgcccattggagccaggccagagggtgccagaaaacccacgctgtctgactgcacctcaggccagtgagataggacctgtctgggactctgaccccagcagtgctgaaagacgtccaggtgatcccaatatgcagctaagaggagggcctttctcctagggttatcagtttgtttgaaatatcacaataatctcgtgattagaggacctgaatgcactgggcttttgggtggcacagtgtgctggggacagcctgtccggagttgggatggaggtggaagcctgcctctgtcaacaccagttttgttaagttggacagatatttactgtgctctgcagttctcattccagctttagcattaattcttagcacttaatcacattacagcaattttctagtattttctatatcacatcaagaagccaataaattaaaattctcaatctggtcattctgattccagtggccatgtgatggaaagaccttactctgatattgggctaatgactcactgctgagatttagattttataaatttgattttttttaatttttaattttttagagactggatcttgctctgtcacctgggcttgggagcagtagcatgatcatagctcactgcagcctggaacttctgggcacaaacgatcctcttgccttagcttcctgagtagctgggagtacaggagtgtgccactgcacttggctaatttttaaacttttttgtagagacagggtctcgctttgttgcccaggctgctctagaactcctggactcaaatgatcctcctgcctctgcctcccaagtgtggagagtgtaggtatgagtcactgtacccagctgaatttgaaatttaataggttgatgttgtttccgttatctaagaagtaagagccaagcacattagtagcacaagccttgttagtgtttcctgagtaaggttgagcctacttaagacaacaagtgatttggggaactttgttatgcatggggccatgcccattacaagtgagtctctcacattccttaaagtggatttggaaactgaggcagtgctatgagatgaggcaaaatggaataaaatgggaagaataatatctgctctaattatttcacagggttcttatgaggctcagatcaaattattcatttattcaacaaatgtgtgattcaccgagtgcctgtcacaggctgggcggccctctagattatgaaggagataaagaagggaaatgtttggccttggaaggagcagcaaattagtcactgctcatatttttaaaatagttcatgtcataagctctttgaagagggctagctcattcacttccgagtttccatgtctcagtacctagcacagaacatagaagcggctaatatattggttatatgaacgaatgaatgagccacagaattcatttccttgcaagcatgtcgtgtctccccccaacaagttaaaattagtgaagtgtggatgtggtttcatttcttgggtagtttaatgttccacaccaacttgaatatggtagtctaaccttggatcctttcaaaccacagcaatggtgaactttttagttaagagtttgattcaattcagattagtattcctttttcccaatcactgttttagcaacacagggagtacctgttttcggttaatgcgcttttcatgtttggtataaatccatagtccaatatttcttttggaaaggaagataaatttttcccttgacatcccttttttccattaagttaaaaaaatgttacttagtaaatgtgatttcaaacagctgggttttaatctttccaccttatggaaagagagcgtttggctccagcagcacccccaccacgtggcccagcctcactctgcacacagattttctaacctggatggcgccgctagcgaggcgcttgtgggtgtgcatttgggctgtgttcacatgttattctaaactaggtcagcagctcggctggtttctttttctatactcttttaggagaatgtgaacaaatggaggattataatacgctttttatacaggttcacaaaaatactttgaggactcttaagttgtgtttctttacaacaggtgaaggttattgtcttgcgggccacagttcgccgctgagaggcaggctgggctctcatggggtagccccacacatggttagcatcgctggaagaggccttggtgtgccgatgcccagccttttatttgaatgattgaaaatctgagttgaaaggaccttggacttgatccaggcctgccacccttattccagacagacagaaccaaggcctggaaaaaggaagaggctgtgacagtcagtggcggtgaggaacccgggactcctccagagactctgtcttcccgctgtgtactgagtgggccgtgctgtgtgaatcctgccagcttctgtggtttcctagggccaagcccacactcagaatgcaggatgacagtcactgtaagatgtaatggacctttctgtgctcaagtgtatataattgtgtaacttcctttattcttcattgcttaaatggatagtaatgtgttaagtgtgcaaatttattttaaagtcctacaaaactgaattccattttcaaatattgattcgtacagactttagggagcctgtgttcagtgtggcctataaggatttgggtatgggacctgccctatttttatagttcaccagcatggccctttagcagaaagcacacatgattttcccatgttttacattgtaaattcactgctacccatgcctggtattatgcctgatttttcttaggcatgagaggaatgaacatcagagaggtgaaatatgttgtccagattctcaccacaggacagtggcaagtgggagataaaatgtctgagtgttcttttgttaagccagcgctcctgagttctgatggcccctgccacggctggctgcacgggctcccccattctcggaagtgtggagaactgccaaggatgttttcaaaccgaataatagagccccacagctatgacttttgcagagcaggttgtggaaagaaagagagcacctgtgctactgtgtgggcagtgccgtagagtgaggcgtgcaaggtgggcctcggtgcccctgtggagtgcaggagggcaccatcctgtgtgtttcagacgaggaaggtccttacccagatggcccttctctgagtttagtgtcctgggctctccagatagtctgagctcccaaacaatcatggcatgcaaatgggggaaagaaaaaccaacgacagtcacagctcaagagcaccaagcttgcattgactgctccatgctttatattgtactttttcagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactgtaagtctctcctcccacctgggtggcactgtctgatgtggttctgaaacggttaggaggtggggtcactgggacatgggaaggaggttgttttctggttaaggaaagagatttgcattttcacaaaggaaatgttttcttcttttaggatagagggacagcatgttcaaaagtcagaaatttgttctgttctctaaagtggtcagcggagctgttttgaaataggcttttgctgtttgtctgagcaatgcctggattccaggaaatcatgtattgatttagtattcttcataccaacattactacttcagaagtaattttaaataagcaaagaaagatatgtggaaggtacataattaatcatgcaactgaaatatgaaagtagaaaaatttacatgggatccttgaaggttctgatcatgtgtttttctattagatactggatggaaacagcttgagtgaggttttgacatgtgtgaatccccaaggctgaggctttgagcatttcttgaatttgaagaagtggagtcagagtttgaagttcgttggttttcgatctcatggtttttgtgacaaggaaagagaaagaaggcagctttgaaagcccgctgaacttctcttaggaaaagtggcttactgttttctgtgtttctctgggctaagtgaagggggttgaggctgaggatctttctgcagttgcacaccttgggaagagcgttggccgggccgaccctcctcacacggccttcttactgagatcattttatgatgcattgagcttctctccccagttttactgacattattttgaggagttatatttgagacagattttaaaatttttgttatggaaattagactacataaataccagtgctgcaaatgtgaaaatgggaggggatttaaaaaaagaaactattttctgtattcctactgtatttttatatggggggcaagttacgtatgtccccaatataaaaatgactgtgctctagcaaattttaagcctgctatttatgcttgctaaattcaagagtcttatagtacaaatagtttttctcaagtttttctattgtattcccatttgcattttctcctaccaagcgctctttgagtcccatctctatactttgcaaagacagttcttggaggttcaggctgggcgcgtgcttgcctggcattgggtccgtgttttgtgcggtagtctctgtgtaatacagcttgcctctcacctggagtcatctggcctgcaggcccctgctcccccaaggcccaggatggcccggaggcacttgctctgggtgtgctacttagtgcatggaaccagggctgggtgcaggaagagggaggaaggctgcaggtcaggatgggggactgggagctgggtgagcacctccctgaggatgagcaggcagcaggccagagggtcgggagccctgaggaaccctgcttgttggcctttccacatggatggaacaatgatgttttcatctcctgagcctcagtgccctcatctccacaatggggacataagaatggttattggagtatcacacaggacaatccacagccagcacttagagcagcatattccaggcgctaagcactcaagattacctcaacccaggcttggggtcttagaaggaggtgagtacaagcagcatcttactctgttttctctggacttgactaacagcagacacaccacggtaagctgtgtagagaatatcaggaccttgtgtgctgccttgactgggttcagagttctggagccccggcctctgctctggggcgctccacaggcctcttctggtctgcgggctcctcctttacttcagggcccttttgccgagggcttccttgttttcaaccctccttcctacccttccctcctccctcgctccctttcttgtcagtattctttccggtttttgaggcctatctccagatcgcttttccactcattttttaaaatgcgagcactttaattctgcctagaagccgagggagcagttacatccatcagtggctcaactttgccctaacagaggagtcttacgatcctgttggcaaactcttggccccctactgttcagatatgactagaacttttgtctttatagctaaaatgggatattatttacaatatactctcttctaagaagactggagagccaggagacggaatgacaaagggcaggactgtggctgtggcttcagattgatctgggttcaaggttcggcctaggggagtgacagctcctttcagcttggtttctctccctgtggaacaggcacacttcctgccgtgtaagcatctaaaggaaagaacgtccatgggaaacacagtctatgtcatcgtgttgcagttgccatctccactccccacgtggcccttcctggggagtgcactgctgtgactttgtatggtttatctgtaatgtcagagccattgtgtacacggagcaggaattcacgggtgtccacaagtgcacttgcccagtgatcctggatgattctccctattctgtcccctggggaaggctgccacctggcctgtggctgccccctacgttcccctcaggttctctgcaggagcccgagggagctgggcgagtggtcatggggagacgctcacggcgcgggttgcctctggattgttctgtgtggctgggagctccggggcaggtggtggtttctctgtcttctgctgcagctcacctctgccaggtgtgtggcttcccaggggaggaggccagagggtggcctcgtattgaatggctatatattctcttccccgtattctgttgggcagcgaacagggatatttcacttcctgttaatagctgtgaacaagccttagagcctcgggtgttagtggatgacactttttattggatccttcaccagcccgtttcctacagcaggcagacagcctgcctttcatggtgtgctgctctgacggtaaggtccccttcctctccacctggacggaatcagagtatcccacgaactcttgtctatgaagtgccatgcttcagaaaggcgatgcctcattcttcttcctgcttaggagcaggattggcttgtgtgatctatgtcaccttgttcccacctgggggatatactcagtgttccggatctgagggcactgaggctgaagcgaggtgagaccttctggatttccagatgagctagaatcagtttagtttcctggccgtgccgttagctttgagtatgctccatggctcagatgtcttggccatatctcccatttgatatttgctaaatttcagcatgaattaaagttaacaagaaaatgttactgttatttgtaaagccagcaatactaagaatcacagaagctctgaaagttgctctaagtagcttttatcttcaaacaaaaatgtgtttggagcccaggctgaggcatagtgggtttcatctgccttttgcctctcctcaccatggtcaggttatggttggaccgaggctgctttattctgctgagagaccaaagggttttgcatggacgtggaggtctgggctgacatccattatctcctggggaatgagttttcctggctgcatctttctgtggaagaggaaatatgctgtcagcctaagttgccaggttttgtcacatcttttctctggctgctctatcaaaatattgtaccccgagcactaaacatacaaattacacaaacacaattatttgttatttacacaaataaaataattatacaaattattccttatacaaacaaaattatttatgaagtaccttctctggtcattgtactaggccttgtggaaacgaggaatgaaggaaaatatagaccctgctatcaaggtgctgagagtggggaggcgaattcacacctgcacaaagataactaaaaatgggcccagggagtgagggccgagcgggtccagtcattcgtagttcaggggatagagagattcatcctggttggattagtggtcacagtggcttcctggagtaggtgtgctggatggcaagaggagaggacagagtgccagggcccagaagagcatgagcgtaggttggcaatgagggtggcgctgtcttgggacagaaggacatggctggggcccgcgtggggcacggctgagaaagtgggttgggcctagagagacagaagccaatgtataaggctgcacctcctgccctggtcctaggacgggccacctgctggccggccggctgcggggagcctgaggctggcatcccacttggtggacctgccacctcattgttcctgcccagccaagcacgtcctgtggtgctgtgtttccaaagccccttggccacatcttagtgggggacagcagcgttccttcgaccgtccagaagcgataattgagtggtctgtgcagcctggcaagtgccacgccctccgaaagccttggtgagcacagacccccgaagccagcgctgctgagggattctcaccactggaccttaagagtaaggtcagcgtcgacaagaagccacaactttccctttgagcttcagtggaatttccacttaactgagagaatctgattcggggaaagcagggagaggagcagctccccctgctactggagggttgggaggaagctgcttctctctatatagagacctcatcaaactgaccccaaattaaatgaactggagctgataaagtacacccagttatgccaggattatgactttaggactttttcaggaggcaactttttcctcccattgccatttagggtaataacaaccaaataaaataaaatccaacttattaaaatctgagctgattattttacttccgaaaccagctcttcccaccttcgtcattttttctcccaaagagactggcatcctacttgtcacctgtaggcaccaagctatgactgccctccttcccttaagccagcaacttcccacctcccaagcattttgtttattgaggacttggggatcaggctcataaccacatagccacataggtaacctgtgcataacctgggcttgcaaatgccagacgcttctattttttccctataattattgcagtaaaccttaaccataattctctatattagagaatagtcaccaaatgtccttttcgagttcatatttctccagttgtgttataaacatgtgtttcggtttgttctgtttatcatttgtttgcaccaggatccaaagaagccccaggcatcgtagatcgctttgctcttgaaggatctctgattctgtaggttatccctccatatctatttcccctccctccctcttcctgtcgtcgtcgtcgtcgtctcctcctcctcctcccccttctcccttttgtgactttgggtggaggggtctggcttgcttgttctgcagtttccgtactctggattttgctggctgctttcctgtggagtcactgaacgtgcttctctgtcccacaccattcctgccacgtggtaggtaatgcagaggtctggggagactcaggtgtgaacgctgtgtgtgtgaaactaccgcctcggtacagctcttccatcaggagcacattgtgtctgctggtttcttgtgtgataccgtcaggcatttggggttgcaaaacagtcaaccaaattctgtccttttttctcaagtaattagtggggatacatctataaagagaaattccccatcaacgatttgattaccctgaagtgtatatcatataggatttattaacttaaggatgggggttccctgtcactctgcacaggtgaccactgagatttcctctgtgtgttatgatgaactgatgaattgaaatatgtttgatgtatacacttaacatttttaggaaccccctctgctacacttggatagccaactcccaggtcgcatctggaatttggggattgtcaatgacctgtttaactccaggttaaactccaggcgtgcaggggctaagccctctccccttctcttccttatgatctttcttaacattttcttttctctagcttgctttattgtaagaatgcaatatatcataaatatgacatacaaaatgtgtgttaatcgacttcttatgttataggtaaggctttcagtcaacagtaggctattagtagttaagttttcggggagttgaaagttatacacaaattttccaccacacggagatcacagccccaacccccaaattgttcaaaggtcagctgcacatagtggacactcagagtgttgactggagactgttgatcctttctctgctgcctcccagcatcctatgagcatggctgccaggtgaacagtgcccatgaggctctgtggtagacttggtgcctgccacggtgcctggcgcatgtagcatatggggcatggccctgtaaatatttgctgagtgtagggatgaatattattattttagaaaactcaagcctgaccagaggatgaaaaaggcttttgcttgcaaggcctagtaccttgcaagtggaagcagggattgaaaatatccacgtgatgctggcagcctgcatgagaagacaaaggaaaagactacataaggctggtgcccacaaactgcctgtccttcccatgtgtgtttagactgccataaacacccaaaccaaccaaagtagaagcctactctggtaagcatttattctgggaccagcagtgtgataggcttttactgtgcgtgtgaccagtcagggcttcccagtgctgcagccctggagggacagacctttggcctctaaatatccatctgctgtgtaggaaggaccagtcctgccaagcacagaggaaatgtggagtgcttctggccggccctaaagacatgtaagtgtgtgagcaggtgtgagtctgtgtgtgtatgcatgagatgtgagtatgccagagtgtgtgggactgtgtgtggtatttgtgcacaagtatgtgtgagaatgtgtagttgtgtgcacaagtgtgtgggtgtcagagagtgtgtgtgagtctggtgtgtgcatgcatgtgactccatgtggtgtgtgcatgcatgcgtgggtgtgccatgggtggagtgtgtatgcaggtgtatgaatatgtccatgtgtgtgagggtgagtctgtggtgcgtttgtgcatgaatgtgcacgtgtgtgtataagagtgcatctgtgtacatgtctatgtgtgtgtttgtgcatgtgtgtgtgtatgcgtgagggtctatggtacatgtattcatgagtgtgtgtgcgtgtgtgtgtgagagagtctgatgcatttgtgcatgagtgtgtttgcgtgtgtgtgcatgtatgtgtgtaggtgagggtgtgtgatgcatgtgtgtgtgagaatgtgtaggtgcatgtatgtgtgtgggtgtgtgcatgtgtgggtgtgtgtgtgtgtgaggttgagtctctggtgcatatgtgcatgagtgtgtgtgtctgtgtgtgagggtgaggctgtgtggtgcatgtgtgcatgagtgtgtcacctggagtcaccaccactcactgcctgtggctttaggcaagttgttcagcctctgtgtacctcgattttctcatttataaaatgaggataatattggtatctctttcaaagggttgttctgaggatttactgaaatagtgcaggacaggcaattagagtaatacctggcccacagtacatgctcagtaagcatcatctattggagggtccactgcttcctggggattggaattaggtaggaagggagctgctgtttgccgagtgctcactgtttacatgcatcatctcattcatctctcaaaagcaccctagaaaggtcataagaatgcagcgctcagggcggtggggtgatttactcagagtcacacagccaaggcgtgccgctgctggggtgttgaactcaggccatggttttgtttgtctttggaggtgctattttcccctcccatggtatttttccagtaagatagggatttactcatcagttcttaaaaggcttgaagggcttgggtggtggggatcaaaccaaccgtcttctgttcagaagggccacagaggatgattgttttcaattgatacatagttgacgatttttggtttcatgctggattttcaaacagattatgaaaaattaacctaagagcccctgtgtgtcagggatcattgattctgttgattccttgggatttcctctacaaactgataagctatcccttcttcgattgtgtcctgtccaggtagtactcgtatgacccagaagccagctctcctctctgactcactgtcttgtcaggaggatggagatgatgacagctgccctggggaggcgagaggcagcgtggcttcagcatgggggcggctctgtttctgccatcaccatccccgcttcacctgctgcgggcgccaagagcccgcctcagccacatgtgggcttttagcctctgatccccagtttccctctgactcttgtctgagcgcattggctccttcagcatctccagctgtgctgggaggggtggggcctgcctcgggggccttctggcattcagcagattggacttcccatgttgacgttgctgactgcagggggtgtgggtcaggggtcttccaggttgtggtgttaccttggagcgaggctggggtgaggggctctgggtttccacagacttaattctggctggcctccatcaaggccatgttcaatgaatcaggctgttgtgcagagcagcctgtgtgctttggacagggctccccgcccgcccccccttttttttgacttaaagaatctatggcaaagcaattactgactgtgacagtgacccaaggtggtatttaaaacaagatgtggagggcaatatgcctctctctgggttcgccacgggatcaagttgcaggggctgtcactggcaacacgcttctgcctgaacggttctgtgggatgagccccagggaggcgctggcagcctcacaccctcccctcccagtcccgccccttgtgttggctgcctttgtttctccaagacggttttctgatcaattaaaatcgtgtagggtcttaaatggtaattctgccttttcaaataaacaaaggcggagaacaaatgggagggtaagttttaataaaccttaggcatcatttcctcctgctgtgacactaaatttacttggataaaaacaacctcttagatttacattttgattctgttactgctttcatgtgtgcggggctgtcccacttcagatgaaatttatccacttctttaaatatttagtagtctagcgtggatgttaatgaaagtctggcggtgctattttgagaattgcaacaatgatagtaattttcagtgtcagattcctgcttcgcaaagggaaagagggatgggagaagggggagggaaaaatggtttcagttctaatagagtttgccatccgctgggccgtgccagacagatgggtcatgaatactgtctagacgctctctgcctgagcgaagccctggtctctaaggacacgcaatgagacgccggcttaagtaactggggaaagtcagggcaagctctcctgtaaccagatagaaatcaacgtgatcctgcttcctgggggaggccaaggggtggccgggaggatgtagggagagggggtgctaagagaaaaggcccgctgttactgatcaattttagtgcaaacttgacaattattaggcattagggagagcgtgaaaggacagttgtaggatgataacactattgatttaagccgtactgcccagaatgcagaatgatatatttcagacccaggcttcaaaggccggagaggagctggggtgaaaaggaggatgttgtcgtgtgtgcttaagacgggaatgcagcccgcggggtgacctgcgttaattgtgtatattaacacactcagcactgctcttgtggaaaccgttggtcttgactgttcatttagcctcttaatttgcaagggttttagaggcttaccaggcttgctttctctttttatgaatttctgcgaatttcttcatgctgggtctcttccgggcagctccacaactggcagagctgtaggaaagcgggtaaaaaaatccccagcgcctgcctggctgcgcttgggtgcctgcgtagtcgtgatgcttgtcttcctaattattttctgagtggcggggatggagtttatgtgatgtcagaagtgagtttctgctcatgaagactcccagtgtaagtgtggtgggagtcgggaaggagatattgaggtaaagatgagattggggggcggaggctgggggaccaccgataaggcgggaggtgatgcagcagcttgccgttcggctgggaggtgctttgtcgcttggtttgatggccgctaatcacgtcttggtcttgaaaaaaattatccaaaagggtactacggtgaaacttggaagggaccatctttgagtaactgaagaaataaagctgaagtctaaagctgccatgagatacgtcgtggactgcagaggtgggtgaccctccgagggctggacttctggattcatcctctgggctggtgcctctttcagtcatggcagctttaacatgggaaagaaaccccaacaacctaaactttgcagtaatcattttttcactccttcatccattcttgttctgtcccaagagctaataacagagggaaaagaagatattttttgcttccttcccagaaagaaaacagagatcaaagataaaaaatattttcaaagtagacaatcactggagagggaagaaagaaatcttgtttcaggagtttgcagtagtgagcagcgagtgagtctgtcctttttccagacagctcctagaaaaattgccgtggtcctccggaaggtccagctgtccttagaggggcaccttcttgccctagaccctttgcttgctgttcacaccaggaccatccactcagggcagaaacttttcattccctgggatggcctgtagggaaggggcacatggcagggggctgggctgtgggtatcagcacttctcctgccagccatgaggcctggaaggggagccttgtgctaagtgacacttaaaatcttgggaccataaagtgcatctccccatttcagagactggtggctcagtggggtgacccccaggctcatacgtgtgcttgggagaggagaatctcagattgccctgcctccttgagaaaggcccctgtcttcctgcgggcgtgcacctgttccggagagggcccctgagccaggctgtctgctgtggatggctctgccatggcgctatctccttcatccttatctatctcttcattgttagtggagggtgttgggcatctgttatttgctttattctaaaaattcagagaaaaaggaacttgagctacacttcaggccttttacccttagatcttgggggaaggtcagctatggttccaggtagggtgtaccgccgcaggcccttgcatgccagctgttctgcctgtctgggtttgggcaggtggtgggttcaggcccaaccgctctctctgtcatggggccggggtggtggctgagccaatcaagcaaaatgatggaccttccatcacgggatgtaagcccgtgtcttgacttcacgtgactttttgtggaaggacagccaaaggaacacattaccgagagagttcgctcttccatttgcataggctttggagatagaagtgttgagtattgtttcttccttggtgagaggggttggcatgaacccagaattttaaatgccaatctgaccttaaaaggctggcagagaccctgcccttccaggcctacccgtgcctcccactgaagccccatgaggcctctagatcagcggctgctgcctcctctcacccttctggttcagtgtctgctctcatgttaggagacgttaactggaaatgacaggacctggggccagtgcagttagcttctctccccccaccccccccccaaaaaaacacacaagatcccaagactgattagttttcataagttgttgaaggagaaatagttgttgaaagattatgtctggacagggggctggagggtgttatagagaaaacatgtttggggtagtcacttgtggaaaattatatgctgagtaatacaaaacatcccatctctgggatacttcatggaaggtatttttctgagtattgaatgcgtgagaggcatgggctgggctctatgggcaggtgcagggctgcaggggctaggtgacatgggagggtgcagtgtgtgtgagacggaggctttgcctcccagctttgttctgtccagtgctaagtggtgtccttgagaaggcccacaaagttgtggcatgtatctgcagtgccagtatgcaggacagaaggaacatcttactaagcctgggtgctcagggaggccaccatcatgggctggcagggtctggagaacccctgctcttcagggggagtgtcgtggggagacgcctgggcagggatgccacataggcttgtcatggaagcttgcggggaggggagggctgactttgaggagcaccactagaaaggtaggtggggtcagattctagaaagccagggatgtcaggccagatcgctttcattctctttcatgaaggaagtcattgaaggtttttgagcaagagaggctacgacacaaagctgttgtatagccggaaggtccttagagatggcttagtttagttctgcactcaggaaaggaaactgaagcctgagattacgtgaccacttcaaggtcacaaaaatagtctttggcagaagtcctaatatgtatgtttctagtctgtctgggctactattaccaaataccatagactgtgatatggtttggctatttgtcccctccaaatctcatgttgagatgtaagccccagtgctggaggtggggccaggcgggaggtgtttgggtcatggggacggattccttgtggcttggtgctgtccttgaggtagtgagtgagttctcacaaggtctggttgttcaggtgtacggcacctcccccctcactccttgcttctgcttcccagtgtgagataccagtccccttttaccttgcatgatgagtggaagctccctgaggctccctggaagcagatgtcaacactatgcctccttatgtagcctgcagaacccagagccaattaagcctcttttctttataaattacccaatctcagatattcctttatagcaatgcaagagatggcctaatacagatgggatggcttataaacaatcaaaatgtgcatcttacatgtctggaggctgggaagtccaggatcaaggtgctgccggactcagtgtctggcgagggcttgcatccaggctcacagaccgtgccttctggctatgtgcttacatggcagaaggggaaggaagcactctgaggtctctttcccatgggcatgaatcccaatcctgagggctctgccttcatgactgaatgcctcccaaaggtctcacctcctaagcttgtcactcaggggttaggatttcaacatatgactttgggggtggggagagagtacaaaaactttcagagcctagcagtgcttcccatttcttaggacagttctccttccactagaccctgtcctcacaccaacttgtcaggttaggcagtgtcagggtggcaggaggaaatcacccggaaggaccctcccttgcagagtaggcagcctatggtgaacgtggcgtgtgcccctgagagtagggactgggcctagctaggaaggctgtcagaggggcaggtccccagtagctgtgcctttgggattatgtaaaaaagggtttggaggaatccacatgaaagccacagcaggagatgaatagggagggaagtcagagtgtgcccggcacagcagggtcccagtgtggtgtccccagttttggggttcacggtggcagcggcggctcctggccaccctccttgcagcgcttggaggatgcagcgggtgcagactgggtgccgtggaggggggcgaggaggagtctggggctatctcctggcagagggatagctcagcaaaggtggtgggtgcactagagagagaggaggacccctgtgagcaagtctctgcgagggtaggatcgagcctagagagtggagatgtggacggaagaactccagtgcacaggaggagactcttctgaagctggaaaggaggaaggcgggagtccttgctcctgggcagagctgctgctatgagtcagcctggggctggggagttggaaaaataccgacataggagggatctgcagtcctgacagtcagcatcttggtcatgctctgcagtgttcaaaagagctttctgcgtgtatgaacttctctccacaattccaccaggtcgcgtgtttactaattgctaagtgctttacttgagtcatctcatttaattgttagaacaaccatatgtgataagaactcatcggacccctccttaggattaaggaggtcagtggcaatgagtccagcctcagcctgaggggtgacccccagcgagaacctccaggaaggccagaggcaacgtcctggggcaagtgagggggaccacgggggatgctacatggaatgctgctttccaagtgcaaatgaccagggagagaaagggcacagagatgggcttgtgctctgctcagcatggggagcaccgcaggggtgcacatgagcgagcgtgaggtcacgggatttgcatcatgtgcaaatgaaatgcaggaatcacagggacagtcatcgttttaaaagaagcaggaccccggtatcttgccctttgaaaacagatgatggtggactttgttttgcattgctcctggtgtgcctgtggttgcgtgcacgtgctcgcgttttggaaatgaggaggcccgtgaactggtgtcctgctgtgtgtgaacttggggtgtgaggttcgaaaggagcaggacccttcatgatgtttttcttggaggcccagccctgaaacttgtttgtgtcatacatgacaatggatttgtgcactttttgtatcacaggaatgagttaaaatcaagagtcagcagctccgctactccgtagtgaccttggtttattaacacctcaagcctggtttttcgcagctgccggcaaggaaggcaggtttgatccctggagtcacttgtgacgcaaaaaaaaagcattctgaaatggtgacttgacctctgttattaactttaatgagataaatattagatggaacatttagccaagagaggtgtttctttgtaaatagtgttattattttcaggtgtctgagagagacgttgatcagggcatgcgatgtctttgagcccccgctgagatgagagccccagctctgagcagtgcccacccatcctctgcagggcgcccggtgctccacctgcccttccctctgttgcccctcattacctcccagccccgtccccagtactgctgtgtaatctgttcagtggggacaataatgacgcaatgtgtgatccagagtctagcacctcgtggcgccttgatggaaatagaaagctgtgatcacagcattaaaatatgctaacaggctgcgggagctaatgggcgccgtgttcacactgcagatgttcattccggcgctgccgccgactgcggggacagagccggaggctgcgccgtgcacacccagcttctcatggtggttttgtttattgccggggtgttctccaaaaggggcatcctgcctcctttataaggtgtgctgtctttctggctctgcgatgatataagacccctttttgtctgactgttagatgcgcaagcagactcagtgttcacgtggagggaatgttagcaatgataacagggtgcagtcgtttgatgaaaataaattggattttatcctgtttgtggttaatgtttatctagttggagtttctgagcactagaaaggggttccaaatgcattgtctaaatttgtgaaagaattccagtataccacatttaaagggatgatttaagtgcattatattaagttgtgaataatatggaattttgagtgtctggcttgcagtgctgtcttccatttgcttcctgggtcggcctgggaaatgactccattctcttcatcatctttgcccttattactagccaggcacctcactccttattttcgtgctcttactttggggaaatccatcggatgaaacatacactcagtgagtagacaaggcagccagaggctatctgcttacaggtgggtggctttgtccacgctgaaggatgcctgtctctgcagagagggtagcagcaggacatgcctggcccgggatggccatccacctgagccacaggtctgggcacaggcacagatgagctgggaaaggggctggcctggtccagaaggtgctggagggcagagaggcactgtgttgctgtgacagtccctgatgaatggggatgtgtgggatgtcatgttgcctttggagatcagaccactccaagccctcagcagcagccttggtcctgatgtgttcattcatcaggcatcccacttggctgcgcacagtgctggatcacctgcggcgggagcagggcatgcgccctggtgggtgctcagtccgcgtttgttgagtggatgatcacaaccctgcaaacatgtcactgagctaggcagtccaaagggtgtccctccaagggaggcgaagctgatggatgctggacacctgtatgtgcaggagctgggggctggggagggggcataggtgctgcctgggagaggcaccaggtgtcctggcaccaggaccagggatgttcctcaggctgggctggcagacaggtcattttacccagtgggcacttaggcaggaggcctggggtttccaggctttttgggggcttatgcaaatattgcagacctgaaaaaaattctgcttccaagataggcagcgaaaactgccaaattaaaatgcacacatttaattaaatgttgacaaaacgtgatggcttgtcaaatagtcacctgcaattcattgtctcaagtgggatgtggtgctttttcctgggtttgatgtgacatctatgaggcccgtaaaggtcatgagatgcccttgggtagccatggtgagaagaggctggaggctgcaggggcacctgctcctgctgagcaggtagaggagacactaggagcagctcagcatccccccacagcctggacggctctgagggtgggtcgtcattccctctgatgagctgggccggatcacttgagatacaggcagaaggtggagagggggccaagtcatgtcctccccgtggctggggcagagctgtgcatctggcttcctccttccacacagccccagggaagatatccgggggcttggcaacctccccttcagctgcattcagccccacaccgggtgccatttctggtgatctaacatacaattgagcaactcttggtggtgctaagataaatggatgataaattgcagttgtatatttttaagattatgaagaaagcaaacatttaaaatacaagcctgtttattagtctgttttactcagagccccagcttccgaagtctggttgccctgaattccatgtagaagtcctgccgggacttctggcaggagcgcccgccatgtcccgcgctgtctgcattgttaggaaacgtgtccttgcttggctcccagcatatggaggagaagtgaatgtgtcactgctgtggcaggaacacatcttccaagaactaagggacatcttgtcacggactcctaggcaggaaacagggcagagttccaggtgtcaggtgctgtggtttgaggtgtgaataaataattaccaaaatgactggctgtggtggggaacgaggagcatgtacacgttttgcctgaaagtgggagcctgagtgttagcatggtccccccgccgtctgcctgccttcctgagcgtgccacatctacacgggggtgccccttcctgaccggggtgccctctctcgccttccctcctgctccctgtgcaccttgccagggtttccctgggcagctctggtgaagggcgtgcgtcacgctatccaggccctctccacgcctcagtggccagttgcctttcctttctttctctttctatgatgctcctgtattgcccctggattcctctaacccacatcatgttggattttaattatgtgtttaatgacttctctcttactagattatgagtaaatccctccaagggagggtctgtgttttgtttatttttggtccctgaatgtccagtgcagggtccatgtgcatgcacatatacacacaaatccatcagatacacatgtattcataataagtttgctttttaaaagggtattttatataaatagaaatgggaaactattatatttgcagacatgaaccaatgtatgctatcagtgcgggtttgagccccagcttcaggctcagtaaatcataggtcagcagaacaatgccacccatttttcttgggatatgtggttttttctagattctgtggcttacagtgctatccaaaattccttccactcctccttcacctcctttctcagctcccaggatttctgtctgcctggggaaaaccctcaccctgtgtttttcctctggtgtgagagcagagaacagtcatccacatagaagaacacttctgtggcctagtgtgtggggcttccccacagcccagcagtggacacctgctgtagtgtcagctccacaggccggggggtcagtccccaaggctgcccctcagactccagttgcaagtccaggcctcaggaatttctgaccgactggcttcaggttggggttctcacaacccccttgctatgtttgattaatttgctggggggtgctcacagaactcagggaaacacatgtttacatttaccagtttgctccaaggatattgcaaaggacacagatgaagggctgcgtggggcagggcatggggaagatgtggagtcctgtgccctccctgggcacccccctccaagagcctctgcatgttccgccatccagaagctccctgaaccctgtcctcttggatttttatgggcgcttcttgatgtcagctttcttccccgctggtggggatggggccttctctgaggaggatcgtatgagcaacaggaaaggctggaggagagagatgttttgcctggcagctgaaaggcggacagaaaggacaggagaaggttggggaagttctgtttcctgaggcctgacgcacccgaccttctaacagaagactgtaacagggctgtggggtacacaagccaggtgccgtggaggaaagcctgtagatagatccacatcacggcaccaccacttctccccgtggttcacaggccctccccaagcatcccagggccctctgctgtgaaggcggctccccctgcctcgctacctgggcccccgctcccctgtgcagtgtgcttatttcagtgctggtctgacttgctcttcgtggtggtaagctccatgaaggcaggaccatgctcagggagtttcctgtccttcactgccccagggatgtggcaaatacttaatcagtgtttgcctatggagtgaacaggtccatgaatggtcttggaaaatgatgtatcccagcaccatggtggtggtcattcatacgtgttctcatgacttctttgcttttcctaatggtgagttcggtaggccaattcatttcttgctgaaaagtgtggtaaaggcaagtctcctaactggaccaagactacagcctgcagaacgcgcagggcctgggcatggggaagcacggatgaggagcctgctgctgatgctgagcaggagccgtggaggggtctacaccactctgctgactctgcgtgatgaggattcaaaatgccattcacgcaaaacaaatttagcaactaagaagtagagcggcgcgctgctttagaagcactatgtgttagcaggtgtggtacacacctgactttgcttctgtggctgaggaaggggaatgagtcttctgtgcgtaaatctttccacaagcaccatcctgggtgtcctgcctgaccagacttgtgagccagggccaggttgaagcatgtgcccaggtgaaaattatgcattatttattcatgtgagcaactctgcgcctattttgaaacattcactgctttgttttgtttgttttgtctaattgcatgaaagatgtggtaggcagaataatgccccccaacaaaaggtgtccacttcttaatccctggaacctgtgaatatgttaccttactagcaaaagggactttacagatatgactaaggctaaggaccttgagttgcagaaattatcctggaccatccaggcaggcctggagacatgagtcctctaaaaacagagactctttcccagctgtgctcagaaccagaggtgaccaccaaagagagatcagagccatgccatgtgaaaaggacttgacttgccattgctggctttccagatgatgaaggggcctcaagccaaggaatgtgggcagcttctagaagatggaaaaggcaaacaaatattctcccctagagctctgggaaggaacacagctctgccacctccttgattttcacccagtgaaattagttttggattcccaacctgtagaactgtaaagtaacaaatttgtgttttaaggccaggtgtggtggctcacgcctgtaatctcagcactttggttttggaaggccgaggtgggagaatcatttgaggccaggagttcgaaaccagcttgggcaacatagtgagactccatctctacaccaaaaaaaaaaaaaaaaaaaaaaaaaaaaaaaagccaggcatggtaggttatgcttgtggtgccagctactccggaggctgaggcaggaggatcacttgagcctaggagcttgaggttacagtgagctatgattgtgccactgcactccagcctggtaacagactgagacttagtctgaaaaagaaagaaaaattaaaaaataacatttggtgtttttttttttctttttgtttttgttttcctgagatggagtcttactctgtcgcccaggctggagtgcagtgtgtgatctcagctcactgcaacctccacctcctggattcaagccattctcttgcctcagtctcccaagtagctggaattataggtgcccgcaaccacgcccggctcatttttgtattttttgtagagatggggtttcaccatgttggccaggctggtctcaaactcctggcctcaggtaatctgcccacctcagcctcccaaagtgctgggattacagctgtgagccaccgcacccggtcaaattcggtgttttaagccactgagtttgtatagcttgttatagcagcaatagggaagagatacatatggctttgtctatagaaagatattgcttaaataaaaagaagaaaacccttccaggtctacattttctcaggcagtgcttgcgctttaaggagcacgtgcaggatatttacatcagcagcaagtatatgaatcgtagcctagtctcatcgttagaggtgcataaactcaaggtaagcataccctaagtttccgctcaaggtcataccctggctccagccctgtcacatggttaatgttccacagccagtgactgagctggagccagggccactgcccccacgtcgtcacgccatggtcattgtcatttcactgcagtttctccagcttccttttgaagaggaacacaaaggagaggtgctttgcaaggatacagtatattataagaatagggacatgtttgaaactagtagttaatgaacattattttcctaaattcatagcttttattttgttttttttaagagacagggcctcactctcttgcctaggcttgagtgcagtggcgctatcacaattcactgcatctttgaacttctgggctcaagggatccttctgtctcagcctcctgagtagctggaactacaggcacacgccaccatgcctggctaatttttgtgttttttgtagagatggggtctcaccgttttgcccaggctgagctggaactccgggcacaagcagtcctcctgcctcagcctcccaaagtgctgggattacaggcatgagccatgcacccgtccttaactgatagttttagagcagtccattagagtggacccatgtcatctgacgaagccatgtgtctgttttgtattttctaagagatttggtgctgagtaaagaaaaagaaaattcttcatatctgatgagaaggtagtgctgttgagagagaccaaaaaaggacaattagtgatgagggtatttaaggcagacagttcatacctcctgagtttttggaacatgtgtctctctttggtaaaatattttggggataatccctattatatgtgtatttaattattttaatattatatacatatactattataaacttcctaagataaacacaaaattatagattttgctgaagagcaaaataaaaataaaattgttctccccttttcttccaacaccaaatgaatcagcccactggggtgtagtaggcagctctgcctggaactgcctgccatgccgccctctgtgtgcctggaacagcctgccatgctgccgtctgcatggccggggcccttctgcagcccccactgcaccaacctttgtccgcctttattgttggtgaacacagtgcccacctcaccatgctggggtggcctggcttgctgtctctgagtaccgtgggaactgaggcgggctggccttgtctccccagcgcctgctcacagaaggtgccccatgatgtctgtcgtgcagatgaatgtgtccacgcgtgctgggctagtacagaagatcggtaggcaggggtcttcgtggccagggcctgaggaggaccgatagccttggggactgcatgggttttgagagtctgggggaaccagggggaagtaggaggacatagtaaacaaaggtcaagaagagcgaggaagacgtggggatggggacacgtacctgactgaggaaaatggattctaggaacacaaacgtcattgaagaaggagagtgtgtgttactggttgagggtgtcctggtccttggcatcttgaacaaataatcagacaaaacacacaaacaaagcaaggaaagaataaagcaacaaaagcagagatttattgaaaacgaaagtacactccacagggtggtagcatgccctagcaagcggctcctgagcccggttacagaattttctccgctttaaagactctctagcggtttcccattggttacttggtgtacaccctatgtaaattaactagtggcctttgatcagtctgattggttgcaggaaggggccaatcagaggctgaagcaaagttacaaagttacaccctatgcaaatgtctgattggttgcagaaagtgaccaatcagaggctaaagtgaagttacaaagttatactcctatgcaagacttggcccctgaccagcctgattggttgtgggaggggtccagtcagaggtactttcaatttttcatctgccacacagaaaaagtgggagggggcagggttgcaagggagtagcctctggtccttgtgttacttgggcatggaaagttggggttttccttttgatttagttctaggaagtcggtgtgaatcggccttaggttcccttcctccagatcctattctcctgcctcatggggtcactgcttgcctgggtggatgagctggagcttcattctgtgaaagcagtgggctggcttcagatcccgtgacagctgcaagcacagcagaaccaaggcaggcacttgtggacttcttcactgtcctcaaaaaagcaggtggtgttgtcaactgtggttacactggacagaaagaacactgttaccaggggccaggtgtgcaacagttctgactagggccgtgggagtaaggccgggaagcaaggggtccatgcagttactctgagctgagacgagcaggctgaccgctagactgggggccacagggggacgggccagggatgcatccaggtgtcaagccagggtgcatggtaatgtgactctccagaccacacagccaggtagggggctggttttcaggatgagataccaactttggtctaagagaggtgacttctacatagggctgtgagacaggcactgttcaataagcagttggaactaatttttttggattttaatgattccaaaaaagaaatctgggagctacagaattagcatttatcttcttcccttaactgatacaaattcttctatgccaagccttgaagagcgcccaagaaaggcgtatatcaatgcggaaggtgggagtccaggaggccagtgtgggctcagtcatggtggctgtcacgggcggagcagggacagcaaggatgtctcccagaaatgcagagagcctgagcagagccccgcctgggagcttttctacaacaatgtagccagagaggttcagcctttccagtggggggcagctcgtggcctagactcggtgaggatagtatactctcacgcggagatgttcctggaagcctcacacacctgtggccatgctgtggtggcctttgcagggctctctagggcaagctgaaggcagatcccgactgccaggggcagcagccagggatggcttacagggcaagcagagcattttcctacctgtggtcccgctggggggcccgagaccaagaatctccacgaaacaattggtgacccctgaagatgccacaccgggtttctagaatcacacgtgatgtgtgtgtgcacctagggaatgggagctcttcctgggtgtggccatgtcccccctggactcctaaaggttggccttatgggatgggtgacaaccagctgccaggctccctccctgtcccccagttctccttttctctattcccttcctgtacctcttttggaggccatgctgcctgcccacccgcctccctggaggtgtgcagccccctgagcctggggttcagaagagcaaacccaccggcatcccagggcacctgcctgacgaagggaacaggatgccttctctgcattcccttcgttgccctaagttaacactatagctccattctgttatttttgtgctcaaacaggcttaaaaacagttgttaacacatattctcatctcccaaattgtcatttttttgagatggcaaggaatacatcacgcctttggatggctttaatttacatcatctagtgttcacctcattcacacgattctgatacttatttctaattctgagtaactaacggcaggtgacagggcagtcacccaacagcgtatagcaccttggggcttcacagaaagagccctgcatgaggacctgtgtgtcacccacacttcaggccagcttgacagccacccccgcctttagggagctgcagcagctaagaaacatgtactgcagaataagagaaaaggacccaagattgctttttaaaaatgtgtttcttaacttgttctttggcataatttctgcattaatggatagtacttctcagcctttcatgaaatttctgcctcttatatgtggagaaaacagaggctgttttaaattataaaggaaagctttaatctagtccaagaaactgggggaaatagacttcttttctcgctttcagccccatttccctacctaatgttaaatatggctatttctcccaatttagagggttttctttgtagaatatgaatgagctatttactgggtaacaaaaagacaagcctttcaagtacaaatggagctttggagatctctcaatttgaaagactaatctctgcataaacacaactgtttctccatattgctgggaacactccatctatctgtttggccacattttctattatggtttttataaaatgaaacgatggctaatagctcagcagagaagtatttgggcacagtagcaatagggatgtgtttacattgctttaaactgtgttgtgagcaaagaatagtaattttctatagaaattgctctaatctgatcagtagaattaggcattgcatattttcatttctgtacctttatcggagcttatgtcaactaataatctcatttagatacttgggtttttcatattaaatatctggttatacctgctatatctttcagcctcaaaactcttagatcaggtcttcctttttctttacacaagtggatagcagatgtgacaataccactgtctgccacagggaataatttgaggggccaccgtgtgtctagaaccttccacagggaagtgcacctgaatgtggaaagatggtgccattgctcttagaaatgccctttagggctgacagagcctgacttttttttttttttttttcacatcgctgtagatggggcttttgaaaccctccttcccttcagcccccacccccacccccaccccaaggttttaggacaaaatgggatgagtgaattcatggcttgacagactgaacagaaaaatgaggctccgtgctccatattcatgtgcatctgcccctcatggtgacatgctaattggttggccggtgcacaagacaaggaagtgcaggtttcctgttgctcacacagtgcttcctgtctgctgtggcaggagccgggaggaagggagcgagccaagaggggtgctgcccaccggaaacgatggcgcgaggccgcagagctaaatgggggcctctccagggagtgctctgttcacggctccatcgctgttagtaagtatcttgtgatttcggaatttaaatgaggttgtgtttaacctgcataacatctggcttttaaaatctgactttattttccttttatttctgtgcatcggctcaggcacacttagtggttgcttaggtgttgaagtcaggttaccaaacagcacgtcctctctttattctcaggctgcgtgtttcattgattctgaaggtcagatggctgtgttcaagttctgttagtatattggtgtcagaaatgaaaagatgatgtaaccctttataacttcttaaaggctcatatcatgtcaggaaattaacctgtaggagttatggacaaatgcccatcctgatgattttcagccatgaaaatgagtaaaggggagatgggcatacgaaaggctgcatgtgttgagcatttgattttggaggaggatgcatttgttgtttgatggagtctacgaccttgccctcattccaaagggcagcctttggccctgggcatgccctcattggctcacaacacctacaaaccatacaacatttggcatcagggttgtatctgttggtggaggacacaacgccaaaaggaaatgggatttcctggttaggcctgcggcttggcagatgattgttatgggaaagacactgagtctgtttaggcaatttcttcctctttactaataaagtgttcctattttgaaagcaatgctgagttgtggacatgtgtataaaccgtaatgctgtaagttaggcctctcttgtctagaatctcagcctcttcatactctctcccccttttttgccatattattttccttatcactaactatatattttacctgtctcacttactatctgtctctcctctcagagtgttactccaggagggcagagataactgtttagtccaggctgtgccttcggtgctcaaaataatgcctgggtgcaaaataaatatatcttgaatgaaataatgaagtaatctttaaaatggtgctccgagcataattttcatatagtaacacatagtttgcaattagttgtctctttcagggataatggaattgttcaacataagaaaatcaggcctgggcacggtggctcaggcctgtaatcccagcactttgggaggctgaggtgggcagatcacttgaacccaggagttcaagactaacctgggcaacatggcaaaagcctgtttctacaaaaaatacaaaattagctgggggtggtggcgggtccctttggtcccagctacttgggaggctgaggtgggaggatcacctgagcctaagaggttgaggctgcagtgagctgtgatcatgccagtgcactccagcctgggtcacagagtgagaccttgtttcaccaaaaaaaaaaaaaaaaaggaaaatcaaacaatataatataccacatttatagaatgaaagaaaaaaaatgagatcttctcaatagacacagaaaaggcatttgacaaactcttaaccttctttgattataaaaacacacaaaaacctagaaatagaaggaacttcttcaacaagataaaaggcatgtcctcgtccagctgggtgcctctaacaaaataccatatacgaggtggcctgtaaacaacagaggtttatttctcattgttctggaggtcggaagtctgagatcggggcaccaccagattctgtgtctggtgggggcctgtttcctggttcatagatggaacattcttgttatatcttcacatggtggaaggggccagccagctctctgggatctcttttataaggacactaatcccatttatgagggctccaccctcatgacctaatcacctcctgaaggctccacttcctaatatcctcacattggtaattaggtttcaacatgtgagttgtagtggggcacaaacattcagtctatagcagggtatttatgaaaaacctactaataccatactcagtggtgaaagctttaaaccctaagacaaggaacaagagaggatacccacttttaccaatgctgttcaacattgtactccaggttctagccagagcaactagacaagaaaaagaaataaaaggcatccaattgcaaagaaaagaatgaaaactatccctgttcaaaaatgacatgatcttatgtatagagtatctccgagatgccacaagaaagctactagaacaaatagatgaattcagcagaattgctgggaacaacatcaacatgcaaaaatcaagtgtgtttctatacatgtgccatgaacaatctgaaaaggaaattaacaaagtcatttcatttaaattagctctaaaagaataaaatacctagaagtaaatttaacccaggaagaaagatttgtacactgaaaacaatacaaaatattgctgaaagaaattaaagaatacctaattaaatggaaagacgttccatattcatgggtaagaagacttagtatagctaacacataaatactacctaaagccatctacagatgcaatacaatccctatcaaaattctaacagcctttcacttttgcaaaagctgatcttaagattcatatagaatttcaaggcacaccttacagccaacacactcttgagaaagaacaaagtcagaggactcacacttcccagtttcaaaatttacaaaagtactgtaatcaacacggtgtggcgtggacttcaggatagatgcatagacctatgaagagaactgagagtccggacatccacacagctatggctggatgattggatgatttttgataagggctccaagtccatttaatgggaaagaatagtcttttcaacaaatgatgctggggcaactgggttcctgcatcaaaagaagggagttggaccctatctcatatcaggtacaaaaattagcttgaaatgtatcaacgacttacatttaagagccaagagcataaaattcgtaggagaaaacataggggtaagttttcatgatgttggatatggcagtggattcttagctataacacccaaagtatgaacaacaaaagaaaaaaaaacagataaatttgactttatcaaaatgaaagacttgtgtgcatccaaagacattattaagagagtaaaaagacatcctacaaaatgggagaaaatatttgcaagtcatttatctgatgaaggcttattattcagaatatataaaggactgcaaatcaaaaccccaatgagataccatcccacaccagtcagaatggcgatcattaaaaagtcaggaaacaacaggtgctggagaggatgtggagaaataggaacacttttacactgttggtgggactgtaaactagttcaaccattgtggaagtcagtgtggcgattcctcaaggatctagaactagaaataccatttgacccagcaatcccattactgggtgtatacccaaaggaatataaatcatgctgctataaagacacatgcacacgtatgtttattgcggcactattcacaatagcaaagacttagaaccaacccaaatgtccaacaacgatagactggattaagaaaatgtggcacatatacaccatggaatactatacagccataaaaaatgatgagttcatgtcctttgtagggacatggatgaagctggaaaccatcattctcagcaaactattgcaaggacaaaaaaccaaacactgcatgttctcactcataggtgagaattgaataatgagaagacatggacacaggaaggggaacatcacacaccggggcctgttgtggggtggggggagggggggagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatacatattatacaggggcggggcttatacaccagatccaaattcaaacactttctttttgagagacgcaacctcaggccccaaagtgaagttcctgagagcctgtggcatttgtctctgatccaggaaccaccttaaccccagacaaataggacccatgctcttgctgatgtggtttggctctgtgtcccaccagatctgttgctgaattgtaatcctcagcattgaaagtggagtctggtaggaggtggttggaccatgggggtggtttcttgtgaatgacttagcaccatctgtttggtgctgttgtcgtggtagtgagttctcatgaggttcggttgtttgaaagtgtgcagaacccgcctcgtgctctttctctcctgcattagccattaagatgtgcttgctccccctttgccttcgccgtgattggaagcttcctgaggcttccccagaggcagaagccactatgcttcctgtacaggcccctgcagaactgtgagccagttaaacctcttttttaatataaattacccagtttcaggtatttttgatagcggtgtaagaacagactaatacagccgctaagccgtgaggaatcctcaaccagcccagcccctgcagcccttgggctgcacatttcctaggtcagcctgcaaaaaccctgagtcagacatatccatcccaacctcaggagttagacacgtgtcagattcaaatggaagcaacattgggaagcggcttccagcccactgggtgcagatccaagccattgctccctccatgcaggacagaaagtgatggtgtggccagtgcagcagtcctgataccccagtgaggacttcggggccaggtgggtcttgctcccttcctcctggacccagaggatggtctgcaggggagcagaggaactgggatggaagtgaagccagtgcctggccagagggagaggggccacaggtgcagatcatgagagtgtctggagactccagaagtagagttgattctaccccacacctacctggcaccttgtctcaaagacaacaacaacaaacaacaaaaggtctttgtctcccgaggttaggatggctgtgtctgactcgggatttttgggtggcagttagagaggactcaggctgacccaggaaatgtgcggcccaggggctacaggtgctggggttggtggaggattcctcatggtttagcatgagctgagtcctgcttatctggggttaagatggtttatgggtcatagacaaatgccatgggctcccaggagccacagtttggggcctgagggtgcttgccctgggtctggggtggctcctcttgattgctgggaagcacccaaagaagccttagtcacatccagtgttgacgtgactccagagggaagtggagcagacaggagcctcaagggtgcaaacgttaagtttgctgttttcagtctgtgcttggcactttcctcactagatctttttcacttaggttaaacaattctttctcccagtatgaggaatgccagattcacagtggtggctctgttttttgttttgttttaagagatgtctcactctgtggcccggagacaacaggatccctggagcccaggagctcaaggctggttcactgcagctttgatctcctaggctccaggaatccttgtggctcagcctccagagtagctgggactctggtgctcgccaccacaccccgctgatttttttttttttttttttgtaaagacaggttcttgctgtgttggccaggctggtcttaagcagtcctcctgcctcagcctcctaaagtgctgggattaccggcatgagccactgggccctgcctggctgttctgttttgtatcaattaatgcagtgtgttttgtggccaatgtcctgggtgtctttgtagcttatggtgcacacggactcccattaccctaaaacacaagaaatcttgtgaacagccaacaagacctggcctcttccctccagaattcacagcctcatcaggagtacatatgaaacagctagctcacaataagcagccgtgcatgactccatgctaaactgtgtggtgcaaataataaaagacacagtcatcaaaggagtcaaggacaatggtgtagaaaggtggggtatgactgtgcttctgactctaaggaagaagaaaggacattgcagaggaacgaaagaatttgagcaaagggatggaggaggaaatggaaatggtctgatcacaggtgcccaggagatcggcctcattggaacagggtgtttgtcaggggaacgggaggtcagcctcattagaatggggtgtttgtcaggggaatctgagatatagtttggattaatccggggggaccagactgaagggtctgtaaatctgtaacagatttaaaactcggtatgttggcacatggatgccttaagtgcctgtggcttccttatggaaggggctctgctttgtgggtgagaggtggcaaagtcacgttcaggggtcacatctggtccagacgcatgtttaacttggtgtgtacacctcactgttttaaaaatgaagtcctcagtgtttaaaaattagaagtaaattgccaacattaagactgaattaggagacttcatgttgaaaacccagcctgggccggtggcccacatctgtaattccagcactttgggaggctgaggcaggaggatcgcttgagtccaggagtttgagaccagcctgggcaatgtagcaagaccccacctctaaaaaaagttaagaattagcctggcatggtggtgtgcacctgtagttccagctgctcaggaggctgaggtgggaggatcccttgagcccaggagatctaggcggcagtgagctatgattacaccactgtactccagcctgggcaacagagcaagaccctgtctcaaaaaaaaaaaaaaaatccagtcatatttcttgcaaaaaatgggaagatgcagtagcaggtgggccacgtgtcccctgtccctaggccctctctgtctcctccacacagaggccaagagcctctgcaggatcttgaggcccatgatgttgtttgctcacagcccacttcactcactgtgggacctgcttggtgcctggtgaggactgttcctgcccctagatgtggtctccagcagatatttgcttcagcttatatttttggacaaaggaatggagtgacatggataatatttaaattggaatggactatgccttttatctgaaaaagttctctaattatatttttcttatcctttttgatgtctcaagaaaactcactaagatccgtttatacaaacatgtttgaatttgacctcacaatggactaggctttgtaggagactgaactcatggtaatgaatattagtaattttggtggaatttttctgtggtaaagaatgaaacaaggaataccaggaggattgggccctaattttccccagaggggtccttcttttaggcctcactttatcttctagcaagacagctgtggtgttagacttctgctccttggcctaaaaaaagctggggccccgaccttcctgggcatgggcgtttgttgatggaaccatggtcagaagaacaaggaaggaggtccatgaggtgggaaatgcacgctcacccgagaaagcatccagcagcaggtcctctgtggccacccagctgcctccatgacccatgagaaacagtagcagaatgcttctagaagagccctcccacctgcctctatcaggcgggatacttgtcatgcatttctcttcagtactggcagaagcccaagcggagaaaacctgactctgtgcaggcagcatggcttggatgttgatctttggaaacaaagaggaggctttcaaaggctgaggggagagctcaggtcatgggattatggaaaggcaattagaggtgttttctagaccaagcccctcttttcatagctgagaaaactacagtttggagagcaaagaagtgagcccaggggatatctaagtgcttatgtgaccccgcacctctcgctccttttgatgagccatgttcgcattttggaaggagaaagggggtgcagaagaggcgtctgatgcaggccctgctgacaggcagtcaagggcatccctcaagtcgatgtagtcaagggccagagctgcaggaaaaatccagcaggcacatctcactggttaggggaaactggcggcttttccgtggtcccgggctcggataatgcatctcagatcaacgaaggataccaaaggcaggtgctttttactcatctgctcccactgactccttcgtccccctccttcctgcttcggacctacttctgatacagtgagggagaaagacaagagtggcaagacagtgtattttctctggaacatagtccatcctcccctcctcacggtctctgcctgagctcagagccccatctgctttcccccagaccctcttgactcggggttgtctgagagcctgcagcattggcatcacctggggcttgttggacatgctgactcttggattccacccaggcctgctgtagcatatcttctactgtaacggaatcgccaggtgatgaatatacacatccaagtgttggtgtgctgccctagaaggtcaggattaacagttggtattttcccgttgtcccaagcacctattctcctttaatccattctgaacatcaactgggttctagtttgaaaacaaaattcagctgtgtctgttctttgcctaaaatccttgcttggcttcacattgcttttttcctatatatcaacaataaacaagtggaatttgaaatttaaagcacaaaaccatttataatagcatgcaagaaattaaatacttaggtaaatctaacaaaatatgcatgagatttatatgaggaaaacgacaaaactgattaaagaagtcaaagaagtcaatggagaaatattccaagttcatggataggaagacttaatatagtcaagatgccggttcttcccaaattcataaatggattcaatgcactcctcataaaaatcccagtgagttgttttttggatacggaaaaactgattctaaagtttatatggaaagggagactgcctggagtagccaacacagtactgaagggcaagagcaaaggaggagaaatgacgctgcctgccttaaagacttaccataaagctacaggcatcaagataggttggcaaaagaacagacagatggatcagttgacagagcagacagcccagaagcagatccacataaaaatatggcctatgaatcttgacaaagaagtaaaggtaatacggtggaggcaagattatcttttcaacaaatggtactgaaacagctggctctccacatgcacacacaaaaaattgaatctaaacatagaccttacacttttcacaaaaattaattcaaaatagatcacaggcttaaatatgagacataaaacttaaaactcctagaagataacataggagaaaatctagatgacctcaggtttgatggtgatgttttagatataatacaaaaggcatggggcatgaaaaaaataattgagaagctgcacttcattaaaattaaacatttctgccctgtgaaggacacttttaagtcattgaaaagagggctgggtgcagtggccgacatctgtaatcccagcactttgggaggccaagacaggcgaatcacctgttgtcaggggttggagaccagcctggccaacatggcataaccccatctctactaaaaatacaaaaattagctggacatggtggtgggtgcctgtaatcccagctacttgggaggctgaggcaggagaatcgcttgaacccgggaggcggaggctgcagcaagctgagatcgcaccatggcactccagcctgggcaacagagtgagactccatctaaaaaaagaaagaaaagaaaagaaaagaaaagccacagactagaggaaaatatttacagagacaatctgataatggaccaaactatacgaagaactcttaaaactcaacagtaagaaaaaagaaaaaaacctgattaaaaaattggccaaaaattttaatagacacctcaccaaagaaaatatgcagatggaaaataagcatatgaaaagatgctccacaccatatgttatcagggaaatgcaaattaaataatgagatcccactgtatacctcttagaatggccccaatccagaatactgacaacaccaagtgctggggaggatgtggagccaccggaactctcatctatggcggggggcagccacattggaaacagtttgacggtgtctttcaaaactcagcataatcttaccatatgatccaacaattgtgctcctcggtatttacacagaggaattgaaacattatgtccacacagaaaccttcacatggaagtttatagcagctttattcatcatggctaaatcttggaagcaacccagatgtccttcagtaggagaatggataactaaactgtggtacatccagacaatgaagtatattcagcactaaaaagaaatgtgctttttcttttcaagctatgaaaggacatggaggaaacttaaatacctgtgactaagtgaaagaagccagtctgaaagctacgtacagtgtgagtccaactgtgtgacattctggaataggcaaaactgtagagatagtaagaagatcattgccagggtagcggggagggagggacgattaggaggagcacaaaggatttttagggccgtgagcctattctgtatggtactgtagcagtagatccatggcaaaatacatttgtccagacctgtgagaatgtacaagagtgaaccctaacgaaggccacagactctgggtgatgaaggagtggtggtgtccgtccatcaagcgtaatgatgcgccactctgtgtgggatgtgatcatgtgggaggctgtgcgtgtgttgggggtgggaggcagagagcacgtgagaaatctctgcatgttcctctccaattttgctgtgaacctaaaacttctctaaaaattaagtcataaattctgactggagcttcattaagtggaagaatgcttttaaagttagatttgggtcatgatgacaaatgttagaaataagtgacctggagtaggaagtggaaggtcatccagcctcacagacacccatgactcccagtgaaaacccacgtcctggctgtcagccgtgtcagccagagccttgactagtgtgtcagcatctaagaaacatataacattgacctaagcaaaagtccagcattctggcctgatcgttgtcttcctgggaactctggtgtgggagctgtggatgcacatgtcctagggacggacatggggtggggcagacatgcatgccagacagacagacacgccagtgtgggctgcacaatggctgagcctgacctggaagctgagagcagtttggaacatgtgtggctgtcctcccgtcatcttctgccctatcagaagatgggcaaattcttctgccctgttgagagtgaacaccctgctttgagaggttgcctagctggggaagcggggacaggacacgtgtctggaagaggacagagtcttgaggcagacacttccctctcctgtgcctcagctctcaccttgatgctccaactttgtggatggcttcctctggacagaaggggtgattcaggttcaaagcctgagaagcgggggcacgtgtagacgctgactgtggcttgacactgactgctgtcagcaacatgatttctgaggcatgtgctgtgacacggttgtgcatggccccgtctgctgggaagacttctggtggccctcgagctgtgaccaccacccaagactgggcccctgttgtcactgttcctgtcccccagtctccaccccctccccaccgcacgcacctcttctggggcagcagtgttctctcgctggacaccatggctcatgtattcattcattcaacaggcgtttatcaagtgcctgctcttaggcagggtcctgagctgggtgggcctgaggctctgaagggatccaggcagggcagccatgttctgttctccatgagcccctctaggaagggaggatggttagattcatcattatgggagtgtcttggacagaaggcttcaacttagaaaagatctcctggaggaaatgacagcgtgagaggtgagtggagtttgctgggcaggagggggaaggcagaaggctcacagggcaggagggcagagggcggagcagggctggagtggggctgggggagacagagtgactgaagtgacaggactggagggcctgcaggggcagtgaggagctctccagactgaggagggagagtgagcgtctctgtggccgaggtggacagtggggaggcaagcagggacaggaaggccaacgctgccttccaggaaggagacccagtggggaagcctggcctgtagtgagggctgggggcctgcagagaagggcagtgcctgggggcatatcaggtggagaaccagtgccaaactcacacccctggggacggttgcctctgaacccgctgcccacctcacccccgactttcagatccttctgcacacacttcctctgccagggacaggacaggagcgcaggcagctgcataaaaaggaggccctgcagaccacgccatgtgcttattctgtgcaaaccccaccgtcccaccttccccacagctgactcccatgagcgtgagcacacggaagctctgtattggcaaaaaacactcagctgagcaatgagacagggtgatttatttacaagcatttgagtatttcagttccccccatcaccactcagaaacaaaagtgaaaattgaggccaattgcatgggaaggagcacagcatgcctgagagggccgggtcagagctgtcccatggggactgcaggggccgcctctctgagccccatcagtctgtgtggagagggacccctcaatgaggagatgagtggactcaagagcagacaatggactgggactaagttcctatgggccctgggggaggtagtgacaagttatgggaaggtgaggggtggaagtgcactgtgaacaaaggttgtctaattatgcagattaagtctctcaggtaacagccctttagttgaaagaataggtgaagtctgtcctgggcatggagactttgagttttctctcctatgttaagagttaattttctgtgattaatataaatcctagggaggggagtctaagacaaatgcattccttccagaggaacttccctaggtcagatgagggaccttcagagagagcccacccccatgcttcagaagggaaagagggcaaggaagcaagttggagagaggccttggttctgagcttatttctgaggcctttcaatctccattgttcaaagcagtcagcatgccagagcaccatatcttggggtgttgttttctgagcccatgttttcaggacaggttttatccctggtctcaaacccatctctccacagagagaatatattgagccccagtccttttggctcagcatctagccagacctgccacaacacggctctgtagttactgagtttctcactgtgttcttgggctctcagctttaactggtgtgctgagaactgagttctcttccttgaagctcccatctccaagtctagtcctcgatctttgctgtggaaacctttgtgaaacacttgtgctgcccctgcctggacagacccctggacccgggggtcatgtcaggcatcacgcagcagtgtggctgcctgtctgctgtgctaagaaccctgagccttcagccagcatggtgggtgggagccctggggttggtcacatctatcctgagtggggctgaggcatgtgggtgctgtgcctctcttccaggcttctggcccctagtcggcaagctaagatgtgtttgccgaatgcttaccaaacgccagatactgtgcgtgttgtatcatttaatcttccccatctctgtgagggtagacgttatctccactttgcagatcagaaaagtgggactcagagaaatgagaccctttcccaagcagctcagacaggaaggtgttgtgggcaggtcttcccaggtcttacccagcagtactcactagcgctccgtctgttctgagcccctccttcctggtcctatgaaggtctctctcctctcagtagcaggccccacattcagctcacttgctctgtctcctgccatctgcttcacagctcaagacccctgggccccctgcttagcttaaccctggtctgtccctttctgacttggcccgtgagatgtctatgttctctttccctccatccagggaaggagcaaaagccccttgccatccctgtgtgacagcaatgaggtgaacccaggggccgaagcccacccagggagttgatggtaagactcaccttcgttttccttcccctcctcagaagtgtggctccttcctctgcattcactgggtgatgctggggtctgtaggctgagaggagcaggagatccagtggcaaggaagacgaaaacacagagcaggccaggcacgtatttttggattagttttagagaacaagttctaagctgtgctttttatgttgcctttagaaaatgttaaaatactttctaggctgggtgcagtggcttgcgcctgaggcagacgggtcacttaagcccaggagtttgagaccatcctgagtaacatatggggagaccctgtctctacaaaaagtaaaaaaataaaaaaattagctgggttcggtggtgtgccagctactccgagctacttgggaggctgaagtgggagcctctgttgctggagcatcgaggctgcagtgaggtcatggctgcagtgagccatgatcacaccactgcactccagcctgggtgacagtgaaaccctgtctcaaaaaacaagaccaacgaatcactttctgtctcactatctgtattcttacagaaattttcttctgtaggaattaaaaagatctgactccccctgcccccacctggagagacaggcactaatgcacatatctgacccagtgccagtatcttccttgatttttcaaatgggtgtcagtaaatgtgaatcgatttggatatttgggggtagatttaaatatccctggtggttatactagcttgcttaagcccacccttggatgcagtcatattattagatgtatttaacatggtagacgatcactctaaaacattagaatataatttgtatttctgcagctcttctgagacttgtagacaggcacgtcacccagtggatgagctctatcacgacaccgtctccctatttggagaaatattctgcagcgtatttactgaccaatatttgctgaatacctgttgtttactaggacttcgctaagtattgggcatccagggatgtgagtggagagtgtcggagctcctgccttccctcggtggacctgagctcctcgtggggaggacctgctttgtgggcctgtgctttgctctccaggtgtctggctggcacagtgctggcataactattactgcttggagctgccccttttccactgaccccacaaagcctctggtaggagtgtagttggtggtagaaacacggagttgggagccaggaaggcctgagtgaggggctcggcctcagccaccaggctgggaaacttggccacgtgccctcgtggctcctgggcctccgcctgcttcctgttgggcatgatgaccctgtctgctctccatgtctgcaggccagggacatgtatagggcatcagttccatggtacggcatgacagtagtgaccatcctcatgctgcttgtggctgctgcccctgctgctctgaacccacttgtagaacagagatgtgccctgctgggcccggggcgtggcctgggatcacctgcccacttgctgtgttctctctgctgggtgcttcagttttagtaacttaataattatccctatatgtcacatagtgccatctgtgtgatagaatttatgtatcaagaacccaggcctaggagcggtggctcacgcctggaatcccagcgacttcagaggctgaggcaagaggatcgcttgagcccaggagtttgaagcttcagtgagccatgatcacgccaccacactccagcctgggcgacagagcaagaccttgtccctaagaaagatgccaggataaataagtattatcactacaaaaaataggaataggaagcatcagctgtggttaaaaatgcaaaagggtaaagctttattcattaactgctttaaagcgggacttttcccttctcttctggtttagctttattcagaagctgcctctgctgaagtagctctgggttactgataattgctcatggttgtggggtgcatccaccatctggaaatatcaagaactgaggattctagaaactggattttaaccccgttctctgctcttcaaacattaatcatgttgggctgcggaacccacataatgaggacgttactgcagacgtagttccctgggatatgtcacattggaggtgattttcttgtgtcaagattattttactacatatttatttttggtttgtgactttcccccttactgaagtaaaacagtttcctttctccaaagagttgggaatgtagcagcttggctaagcatacaaacaaatagcaagttacaatttaaagccatctggaaaggttaccaatgagttttgtcacatgtatagatagtgcataaatcatcatcagaagggaatctggtgatatgtagcagaagccaccagggcctgctccaccagggagaacgcggagcagcagagtcagcggaaggagtgccagtgcgtacacctcctctctgtttacaaagcaaagctgctcgtaagaagtgcgcttgaggaaagagtgcattttacatttcatcacttcatcactctgtttattaaaatctttgttgacttgatatatacattcagaaaagtgcatgtatcaaaagctcactgatttttttatacactggaaacacttgtgtgaaataccactgaaggattcactttaaaatggttgtgtattaatgcaaatttcacctcaacaaacaaaaaaagccccagaactcaagcagccccgcagagcctccttgagctgcattttgttggaagtgtcggggtggaatcaccagggtcaacggtttcccatttccactcccgctggcacgtccgcagacccctgccggtcccacacgcaccccaacacttgctgtcttctcatttctgctgggtgggtggtagtatgatattgtggctttactttgcatttccttgatgtttaatgaacctgagcaccttttcatatgcttctcaggcatttgaagttttataatagttttaaataggggtcttttttccttacatgaaactttgatgagagtgatcatttcttttttattccccaaccatgatccagttcagaaaacatcaaggaccttgctgcctctccaggaagtgtagcaaaaggcacctgcctgctgtgctggggaagagcagtgggccaggttagccccctgtccctggtgtgctacacttacaggtgggcattgggctgaaggactctctggcccttgctgttgggtcggggatgcagtcagaaaggagcatgaagggcatctgtcccggcagggccatgtggccagaccaggaagggctgctcaaagaagaacaaaggcttctctgccctgatggagatgctgacaccttcagaaagacgtgtttgtggcatcagcgtcatttctttctgtggctaccaaggccgagaacttctctgtgctccatctcatggccagggttcttacagccgcaggccttctgtgtgcattagctagctaacttgtttcttctttcattcatccaataagtatgactaaactcctgcagtatcttcagcatcggcaattccacactaaataagtaaaacccttgccttcacagagatcgaaaacaaacaggaaaactgtaatgtcatgttgggtgtctggagctgtggagagaaatgaagggggccctggagagccatggctgtgccaaggccagggtggcgtcctggagaacctgccttggagtggagtgctggatctggggaggggggagtgctgctggacatttcatggacacataggcaggaggtgggcaggagcactgagagcaagggggagatgggagagggcaggggcctggtcagggtctcagggccctgggcgaggaatttgaattgcagtccaggtgagagggatgggaaggacaaggctttcagtgagctgcctgggctcttagagagtgaccctggctccctcatggaaaagcagccatctggcccttgagttcagcacctctccaagctccttcctgtccctagactggcagggacttccagggacagccttggccccctttccgctctgccttgccatctcccattgcttgtcatcgcttctgtgttgggtttgccctctggtcctgttccctagagccatgctctggtcatgagtgttacagggccagggcagggcctgtcaggggaacagagtgcagaccccctctgtgggcccctctgggccctcgcatcccactgccttggagaggagagagcaagatagaaacaggtcctgagatgaggtggcggcatacaagctatctcacacttctgcacccttccaggtgcgtttctgaaatgcatcaatgctgtgagatctacactgacttcagggatgtggcaaaccccctatttcttgtaaccagccagcgacagtcattgtggagccctgcctgtgccccaggcagccctgtgcactaagaaagccaggcctgggagacactgacttgtcgtttgcctccaggcgtttttagttgtaacagactagttcttgtttcccatcacctagaatctgttgatctgtctggatcttagttcctgagtctcctgctctgcaagacgcaccctgcacatgcacgctcacgtggggcacacacacccaggtgcccatcatgccagcaggtgcacagttggagaaatcgactccccagaccagactccccagagcgcggggagcggccaagtgtcctcgcacaaactggggtggaattgatacaggggccagggaggtccctaaacactagtgggaccctgaccctagccagcatccaggctcttgacactgttgtgagaaggatttcaaggatgagtcagaaaacagtgaaagtacaaagatttattgcagagtgaagagtacactcttgcaaaaagaaagtgtgggggcagactcaagagagccacagaatggggtttggggctgctatctttatgggtttctttaaccgaggggtggaatattcatgaaaattcctggaaaaaggtggagatttattggaattgtggtgctacccattctttctttcttttttttttttttgagttggagtttcactcttgttgcccaggctggagtgcaatggttcgatcttggctcaccacaaactctgcctcccaggttcaagcaattctcctgcctcagcctcccaagtagctgggattataggcacacaccaccacacctggctgattttgtattttagtagagacagtgtttctccatgttggtcaggctggtctcgaactcctgacctcaggtgatcctcccaccttggcctcccaaagtgctgggataacaggcatgagccaccgtgcctggcccagtgtcacccattcttacaccaaataagggtgtcctggaactgtcatggtgttggtggtgtgtgattgagtgcgtcagtgagcagataatgaggtccgaggtgagacctagctcaaatccagctctgcactgggtccggtcagtcttagccagcttggtccacaccctgtttttcagggtcagggcctagtcaccctatagcctccagttatatgaaactgttgcctggaatgtgtattcttctgtgaccacctgtattattcctgtcacagaatcgtgacacagcagcagccctttcccagtgtgtggggcacagttacattcctaggtgtggaaggaagacctttgctgcattaaattatccccagcatctgtttgctgcttttaacacgagtgacttaaagggacatgggttagaagaaggagggaggagatttgtgccagggatgaaagaaaatggctaaaagatgaatgaaagttgcatatatctctttttcttctgtaaataactcatgataaaagggaataaaatttaggttttccccacttggaagagacatggccaaacggagtgtgtgcttttcctaaaccaccgtgaaggtagcatgaaaaccaggcttgctcttcagagactaggaggctcctgttttgggcactccatctgccctgctgccgtgaaagctctcggacccaaatggcttcctgtgatccactgtggtctgcttattatattcccttcagctatgtttataactctgtcaacagccacagcgtgagtaccccaatcggataacaataacctaaaattttaaatgctcaaaagtcagaaacattttaagtgacaatatgatgctcaaaggaaatgtccattggagcattttagattcagatttttggattaggaaggtggatgtataatagaataactggtaagtataatgcaagttttcaagatccaaaaaagttcaaaattcgaaacacttctgactccaggcattttggataagggatacccaacctatattatgaagtggtagcaagaaaattacattgaaatggaacattttttcagtttatgtatccttttgcgaggtttttatttcaaaatatcacagtccaagccaaaaaatatacgtgggtgtttcagtttatgaaaactgtaagttatgtttacttttctatatgtatatatttttttacctcaataaaatgatagccccaaactctcttcaaccttacctcatctgtggtttatagacgtttccaggggaagttttttaaaatgatgtgttccagaaaggagtaaatggaatattaaaagcatgcagcatggcccattctggaggagggccaggcttgtcagggagatggcaggatgtgcatttttgcacatccttggctcattggcatggcagggagagtccagctaaagcttctgcaccccctgtcccctttagatctgggcctctctctctggacgatattctgtatctccagcctgaacctctcagatgttggaaattaacctcagagtgaatcactgggctgccatagggatttagttggacacagtgggtggccaagtcgtctctgctcctcttcatggtagtgggggctgctctctaccatctagacccaccctcatgggaaaggccgcagacccttactcagcctgtgggacaccaggcagagtcccttgcagctgatggtgagctgaggtgcactgtatttctgccacagggatttgttaatgatttactttaaatgtccacctgcagggtagctgggacgatgaaagcatcccaagacctcccttttccatctgtggctgatcacctctggaacccacagctagccggctgctcctccactatcagatggcggctgtcagtcatgggcttgtcaccgagtgcatccgtcatgctcgggccatgggccggcacctgtgtgtgtgtgtccagcttaacgacagagatttttggaaagacgccctaagatagacatacttgaaactgagtgagaataagtttgacttatttctttttgagatactttatatgtttgaaataattaatagctggcgccagtgaatctagtttctgtctgtttcctttaaagattatatgtagtgttggtgattgggatttagtaagctatattgaagatgctaacgtttgattttatagcaaaaaaagaagcatttgtgtggagcaaggacgtttgtatatgagcagtcataaagttaatgtcaagtggcccggcagggacttttacacccattttacaaagaacaagacccagaactagaggccaggaaaacagatcttctgtttctcaccctggtacttttcccatcaggtgacagtgtttgggtctgcaccacgtcaggccaaagctttgcacgttggtgctgtctgataatgaaatttgcagaacaccaccgggaggcttgcatgaattggtgcgaggaaaagtagaggcgcttccatcattcaattgatggatgactatgaggctgactttattgttcctagcactgaaatcctgtttttcttgggtataatgaatacagtagcatggtttatgctaccttcatagagtttttgccccccactgaaaatgcaacttgtcattctctaagatccatgccaccaagacccaagacaccaagacaagaccgattcgggcaagtctagctagaaacaggccacgctcttgtccccagaatggccaggacaccatcaggcctgaggggcacagaggaaggatgcgagtggcctgccacaggactcatccaccccagtgcacggaaaggtgaatcctggatttctcccctattcccgggctgttgatgggatctcatctttgtaaagtttcttctggttccgagttgcctctgccggaagggacgtcctttcacagcccagcattgctgtaatccggtggagtggctgcagtattaacagatggagttggtcctcccttcccccccgggtctgaatctgcctgctcctgtgcgttcactcttcctgcagtccagctggggagtagcagctccttggcaaacaccttcttctccagccccgtagaacgcctggcctcatcaaaaaggccacaggatggccaatgggcattgtcagaccctactcaggagtgggatctccactgactggggcggccctccagcaggtgtcccagggccttagatccctccagagaaatggtagctgctcagaagatggagctctcctggaaactcctgagtcacctgggcagtggggtgccctgggagcaccaggtcatgccataccccccttcctcattttctccatccccacagctccactcttcctgcctttcccttgaaaatgagtgtggcaaatagaggagaacgggctgggtgcagtggctcacacctgtaatcctagcactttgggaggctgaggtgggaggatcgctgtgctaccagcctgggcagcatagcaagaccctgtcttcacaaaaataaaaataacagtagctgggcatggttgtgtgtgcctgtaatcccagcagtttgggaggctgaggcaggaggatcacttgaaaccaggagattgaggctgcagcgagctgtgattgcaccactgtactgcagcttgggtgagagaaagatcttgtcttaaaaaaaaaggagaggatcaaaacacaatcctttatcttctaaacaccttgacatattgcctacagccaagaagttacattgttttcaagcatttaaatgccatttccacaagtctgctcatactgggaaagtgtatgtcctcaccccaaggccaggctgacaccctggttctcctttttagtcgagtgagtctgtctttctttttctatttttttgcatgacagttctatgtaaaacatggtcatgaagggacttgttaaatcatggagtcagcttttagggctagaaaaattgagagaaaatttaccttcaaaaaagtaggttgtggaagcaatgatcactagaaatattttatggaaaaacaaatcatgtttcctcttttgcactgtgcacccctgaggcttccggctttggtgttgctaaggttctgagaagaatgctgttcttagctggtcatcgctttatatgctttggaaatattttccaatatttgaatggcatcgtttcattaaggcataggacaccgtgcctgactggtcacataagagcttttcttctttaagcaaggaaccgagaggggtggagatgaaatgatttttttcctcccatctggggctcagagttggacatggcctctttacttcatccgtggctgggaagaggggcacagaacagcagagggaggcggtcaaagcccagccgtgccgtccctgcctccagccccgtggtccttgtccaggacctcactcagcccgtgggccctctgcttcctcccatctgtgtgcggggccacccagggggtccccgcttctgagaatccctggcagggcccagcatggaggcgtgtggtccaggcatggtgacgcggtgccgcaatcctgccttatggtgtggaggccgccttcctggccatcccacagtgcctcctccttcctgggctcggagcacagctgacagccaacatgacctcgacatgagtttggggagaaggagcagggcggtggtgatggctctgctgagaggaggcatcatggttgacaggtggaaaaggaaggtgcaattaaatattgacattcactgtatcccaacctgctgtctagcttgtctgacacaaaagcatatattcaccgagagaggaaataaaatcttcattcaacttctgcttcaagggacatcagttaagcaaaaaataaaacagcttcaggaaacatattcatttccagcagtctcaggtggagaactgaggaactggagtctagaggctttttcctgatgagttcacactgcaatgtgccaccgaaactctaaagcccttgtctcaagcctacctctgagtttcataaaacaagtcagatatatctgccctcataagacatcttcgcatttgcctgttttatagaaaatatacattgaggctgggcatggtggtgcacacctgtaattgctgcagtttggaaagctgaggtgggaggatcccttgagccccaggagactaaggctgcagtgagaaatgattgcaccactgcactccagcctggagacagagtgagactccatctccactaaaatatatatatatataaaatattatatttatatattatatatataatatatatataatattatattatatatataatatatatataatattatatatatataaaattatatttatatattatatatataatatattattaaaaatatgtatattcagtgtatatatacacatacacattgaataaatgacacagtgggaattaaggaagtttgggtgcccctagcgcctcccaggatgaaggctttatcaatgaattactaaatgattgttcacgaagtcttcaacaatggtcatttgtaattcaccctctcttcctatatgtgtggtccttcaaggccgctttttcctgttgttacactagtgagagggaaccgaacgggctcatattcagcttaaggcacaagcgaaccccgtttgccttcaaccctgagacccgcctcccagcttggcagttagggtggcccttaaggtctcatttggcatcaaggagagatttccagtctgccaagttttcacagtgagtgaatcattgtctgagaaaatgacctctgaatatacatatatgggactattcagaagggctatgcagcaggattcagaggaaagactattaaaattccagtgtacaccagtaaatctacagtttcatcataaattacaatcaggaatcattttgtctcatggcctcgctccctgcgtggggaggtggtttcagttccagggccagcgaggcgaatacggtgcggggagggctctgagaaaggaacagaacccaaatcactttccttctttagttgacgaatctcagggcttaaaatgctacaaacaattgagattgtaaatgtatctcgtctgtttctctgagcctgccttcagtcaacaaatgttttctattcaccagcctaagaagcagctttggtgctgtcccttgcgggatcccacttagttatcttttagaggaaataccaaggcatatttcccccattcctgaagtataagatggtgtcactaatactgtggcttagtaaaatgggaagaaatacactgaggattctgaaatcttccctcagctgccttgaagaattgggtcaataacctttagagtggtgaagatggctcaggaatagattaatagactcacaaattctagaacaagagaagacttcaaaggtcgtagggcccagccctgtcttttggaagtcgagttactaattttgtactgagatggcgactgaaactcggaggattgtttctctgcctggatcatacggcaacgtcaccagcactgccactgcgcagtgttcagagagcgcgaagacctccatcaccttctagctcagtcgggtcgcctcggcctccagctgccgggcccttgtggagtttcttcccacggatttttcatcctccccagctccccaggccccttctaaaccctgtaatacactgcaggttcttctggcgctcccaccacccgcctggcctcccttctctgcctcgaggagatttggctgcgtatagaggaacagggaaggtgagtatgcaggggacaggtaccagctgtttgccatgggtaccagtgagggcacaggaggaagtgagtgctgtggtggctttggagattaggttaatcataaggaaataaatcctgagtcgtggagactgtcaggaaatcgtgtgcgttgttcaggaagatggtggagtctgttcctctggaaacacaaaacatccaccttaaaaatgtggcggccttacttgcccagaacaattttagtggggtctggcctgaagtcagggggtggattagatgaccccagtctcttcttgattctattaaaagattttcaggggatgaggtttctacaggcaatagcacagtctaatgcttaacaaatcttttgttgaagatttttaataccatcttttcatctgacctaaatctttcgtgtggaagttgagccatgtcccctgtggagaggaagaacggaggagatcgaaattcagcctttaaagtacccagttaaatttagtgtttcgaattagggagactcaagcatcagcaccgaactgggtcacgtcatttgatgttttccgagaggaggacaccacagaaatctgactcttggttctggtatcagagtcaaagtcccccatactcgaggttaataaagggattgggacgtgggagggaaagggtgtgatttcaaggtttgtggcagttaccacaaaaccactgcattaatgcaaaccagaattaaaaccacatagtataaaatgtcatgcccacacgtctatttgtccagcaaatctcaaggcagccagcccgaacctgggcaccccagtggacttgaagacaggtgaagccaagcaacctcagaatgagaacttccccattaataacctttaaacatgacctttcattagcttaacaaaacctaagaaatgcgcatgtattcaagaaaagcagtaagtaagatgaattactgtgttttaagccataatgttcaattaattagtaatttccatccagcctgctgcctgactcataatgagcattctctagtctaaataaagtggagactgcttagttacagagcattttatttagcttccttttatttcaacttaaagaagggttctttttattttttagagatggggtctcactctctcacccaggctggagtgcagtgatcacagctccctgcagtcttgacttcctgggctcaagcaatcctcctgcctcagcctccggaatagctgggactaccgggacatgccaccatgcctagctaatttgtttgtttttttttgtagagacaaggtctcactatgttgcccaggctggtcatgaactcctggcctcaagtgatcctcctgcctcggcctcccaaagtgctgggattataggcctgagccactgggcctggcaaaagggtggctcttgtagtgttttttttttttccttcttttttcacatgcctgctgtgtcagtcttgtaatgtttttaaaaggctgactactgtgtatttttaaccctttttaattattaccatttttcagaagtagttcactaagactttgtaagaaggtgcaagtggctttcatgccataataccaggtcaaaacacatatgggggagccttaattttcttttatgtgaggaaagccctccctttggggaggaaagaaggctgacttctgaaagccaaagctacaatgggaagaaacactttgttagctgggagtgaggagccagcgaaaacgacaccagagaatccttcttcccacacacgtcccgccgtggacactggagaatccctcttgccacacgtgtcccactgtggacactggagaatccttctgcccacacacgtcccgccatggacactggagaatccttctcgccatacacgtcctgctgtggacactggagaatccttctgcccacacaagtcctgccgtggacactggagaatccttctccacacacgtcccgccatggacactggagaatccttctcgccatacacgtcctgctgtggacactggagaatccttctgcccacacaagtcctgccgtggacactggagaatccttctcgccacacacgtccctctgtggacactggagaatccttctccacacacacgtcctgccgtggacactggagaatccttctccacacacacgtcctgccgtggacactggagaatccttttccacacacacgtcccactgtggacactggagaatccttctgcccacacacatgtcctgccgtggacactggagaatccttctccccacacacatcccgccgtggacactggagaatcctccccacatacgtccccagccatagacactggagaatccttctcgccacacacatcccgccgtggacactggagaatccttttccacacacacgtcccgccgtggacactggagaatccttcttgacacacgtgtcccactgtggacactggagaatccttctcgccacacacgtcccactgtggacactggagaatccttctccccacacacgtcctgctgtggacactggagaatccttcttgccacacgtgtcccactgtggacactggagaatccttttccccacacacgtcctgctgtggacactggagaatccttcttgccacacgtgtcccactgtggacactggagaatccttctgcccacacacatcccgccgtggacactggagaatccttctccccacacacgtcccgccgtggacactggagaatcctccccacacatgtccccagccgtagacactggagaatccttctcgccacacacgtcccgccgtggacactggagaatccttctcgccacacacgtcccaccgtggacaccggagaatccttctcgccatacatgtcctgctgtggacactggagaatccatctccacacacgtcccgccgtggacactggagaatccttcttgccacacacgtcctgccgtggacaccggagaatccttctcgccatacacatcccgccgtggacactggagaatccttctcaccacacacgtcccgccgtggactctggagaatccttctactcacacacacgtcgcgccgtggacactggagaatccttctactcacacacatcccgctgtggatactggagaatccttctcgccacacacttcccaccgtggacactggagaatccttctcgccacacatgtcctttcgtggacactggagaatccttctactcacacacgtcccgccgtggatactggagaatccttgccacacacgtcctgccgtggacactggagaatccttctcgccacacacttcccaccatggacactggagaatccttctcgccacacacgtcctgccgtggacactggagaatccttctactcacacacgtcccgccgtggatactggagaatccttcttgccacacacgtcccgccgtggacactggagaatccttctcgccacacacttcccaccgtggacactggagaatccttctcgccacacacatcctgccgtggacactggagaatccttctactcacacacgtcctgctgtggatactggagaatccttctcgccgcacacgtcctgccatggacaccggagaatccatctccacacatgtcccgccgtggacactggagaatcctttttgccacacacgtccagccgtggacactggagaatccatctccacacacgtatcctgctgtggacactggagaatccttctgcccacacacgtcctgctgtgaaaacctccacgctccctttccgtttttgctctcagctgtccttccagtatgctgcttgggtcaagcagccgcatctccactgtcctaatgacaaaagacaccagcactgtctcacttcctttcctcctcctctccagagtgttaccttcctgattgacagggactttcggttttctatttagaagcacatgtttggtgcagacatgttgtccaagacttgacattgggaaatgttgggaataatctgaaactccttacaatgtgatgttttggtgattaaaaaaaaatgtttaggaaaggttgctaggctttaaaaatatatatattttgctaacctcatggagtcactgtgcagaccctctcagcagctagccaggctggcctggccctgacggcccgggaatagcagctgtcttgtgacttcccacagcaggcacattgcgtcgtctctcaaagtccctcctctggagcgcctcctctgcccgtggggctgtgcgggacagtggccgcgtctctgtctcattgcaggacagcactgggtcttaggtgctttttcatgttgtccacacctaacgctgctgctccccggggcccagttttgaaactgccctttggcatcatgctttcccgcccctcctgggagcagcgcctgtgggagggcagcgttattcccagctcctcagagaggagaccacatccatggcagtgtgtgactgtccctttcggcggtcctttgtgaagcccgcgggaagttctgcattcagttcctgactcccagaaaaacgtcctgtcttttgaactgaaaggaggctgatgtcagagcctcgttgagtaacaatggagaaaatctacatcagaggaaagaagccctgagctgctttaaatgcttctgtaagatgatatgccacaacacgaatgtggattgttgacagtaaccacagagacgagatcatcgagggaaccagctgggagtttgtgaggccataaaacacatcatcaaaaatatggtgaagcaaattcagaattggtttttagaaaggagaaggaaccattggcaatctgacccataaattattctacattttcaaatattataactaggaaggtcgcttcaaggagccttcaagcccctcatgcccacccgccccaaacccattgtcactgctaggtcccagatttacagccacctggagaggaagttgcagggggtctctgtgcagctgaggatgatggaagggattgcagaaggctggtgctgtaactgttgttagcgggagattgaggccggggggtggagtaggggctactttcttccccctgcacctgctatcatgatttcagcaaaaccttgcctttctcctcttcaatcttaaataggtacagtggctgagtattaatattaatgagcataataacaataataaaactggcagtagcatcaaatgaatgtggtctcctgcagtagaaatatttacccgatgtgtcctgccagtgagagagattttggcattaaacctagacattacctcatcctcctgggcagacagccgattgccatgctaagcaagtctgcgccgagaagagctgagtacctgccgacggctgcatggcccagaccccagggaacacagtttccttgagcctgtctgtctgtctgtctgtctgggtctcacccttaattcctttctttctctttccctcctccggaggttggcattgtgtattttcaaattgtgttgcttttttttttgcagaatcttgtagggtgtgttgtgaaaagtctgccagccaggtgggtgggtattattaataatccatagaaacccgaggggtccggagtgagaggagaaacatgacgtgcctgtgtgtgcacaggacgcctgacactcgctcacacacgcatgtccctctctctgagagccagggaatggggtgggggttggtttggtttaatgcatgataaaaacaggggcattctgtaataacagagctttcatttcaagattcttaacaactaaaataatattttgaaacatttggaattgtactagaaatgtgtgtttgatatgttcaacctaagaaaacatcacacttaaaatgcttttactccactggcttcagacctctttgaaattggtgcctacacagctgagaagtccgggtaggtgccgtaggcaaattgaggggagaaagtgacatcttgtgtaacgctgcaaattcgcggaaggctttgaaccgtcaccagagtagcaaatactcattgtgaaagtttttgcaatgaggtacggaaaaccatttcagctgctctgattgtcagctctcctgtgttttctttagctcctgacttaaagttacgtgtcctgtcagttttgatactcttactacttagtgctttaggttttatcagctggtgccacatcttttaaaattctgtcccactagcctctgtgctggtcctgaccgattcaccagctcttgggactgtgtccagatgccttttgtgatgcctcttttctaaaatgcttttatttgggtttaagatgtactaattctttcacacacccatagctgaataccaaatattggtatgcatactaccaaacttttgtgtatgaagttcgtacaaggcactaagtcatttaaaacattttaattgtgtgctgagctcgtaagtgtacaatatgactgtctagtaaattcttaattatttgtcgactctttatcgaagaaaaaagtaagtaggggaaaagataaaggagcatccagccggtggcaaaggaacaagccgtgtagctctgcttctcacccactctcagctagcttgggccacggctgcctgaagtgacaccaaacaggaaccccactgggaggactgtacgggccacacccatggacgtgatctgtctatgaaacaggtcttctcagtgcttcggggtgaattttgacttctcctgagccatcctcagagcacagctggtggggaacttcacccgtctggtcactcctgaagcagtctggctggcagccacaggctgggatcccagttgttggaggtcagtgcacacagcggctatctgctgtagcagaaagaatttaggggaggaaaggcttgagaaggaagggcaagagagagcagactttgtggcatcagtcaggtatatgtgcttgtattaacatgaacctgagaggctgatggtattacatggaattccaagtttcgactgcatgaattctgtctcttgtggtttatctatggccaccatcaaccgatgttgtgtgataaaacgtttaaagtatgtacaactgaaagtggagatggatactaggggcatttaacgttttaagctttcctccagggttttttcctcagttacatggaggatggccctaggtactaactgttggaaatggcagcattgaaaagtgcagcactttctgcttcagcagcatctcaattctgcgcagcctttgaaaatccttttctacagatagcaggcaacctgccattgttcccagccggcagcgtggtccctgccaccaggtgcttgaacaaacggccatgtgtatgagggtcccttctcctaagtaaaattaccctaaagactctaaacgagaatggagactttgaaaaaatcttctgtatttttctattttaattatcaagtaggggaaacagatctgaaggggaaagaggagagaggaccagaagggggcttccttgctgtgcaggagacctgtggatccagtggaaagcagccccatgtgagatgaaattatcacaggggcgggatgtgccagaggggaagcaggcagcccaggcatgtgtgcgtggatgtggagcccctttctgaagtgagtttggttttattttgggcaggcctcataggctgtacatctggcaggagatgagaaaggaaagactggctcttgttttaaaaaaaaaaaaactaagtaaaaaataattatttaaaaatgactcaaaagaaataattatgagactagttatgatagagtaaaatgatttgttcattttccagattttatgtaacatggatatactatatttaaagatttatttttttaataacattactaatgataggcaaggctcatatagtacataatacatgccaggcgctttgtagaaatgaactcatgtagtcctcctcacagctctataaagttagcataattactgtctccaccctagaggtgagggagagaggctcacgcaagtcacatatctcgccttgaatcacccaagtggtaagcagtggagccaagaactgagctgggcaatctggccccagagtctgttcgctgacccccatgctacaccccctctcaaaaacagagacttggacaccagatccaaattcaaacaagacagttccctgcttttatcaacctaaagcattactaatgggttgctccggttcacaggtgtggcattcacagtggcattctccagatgaagaccatggcttttaagacaagtgtccacggtctgtagatgaacagttgcaaactcagagagaactaagccatctagaatattgcattcattctatatttttatttttattttattttgtgtttttgagacagagtctcactctgtcacccaggctggagtgcagtggcacgatctcagctcactgcaacctctgcgtcgggggttcaagcgattctcctgcctcagcctccggagtagctgggattacaggcatgcgctatcacgcctggctaatttttgtacttttagtagagatggggtttcactatgttggccaggctggacccaaactcctcacctcaggtgatctgcctgcttcggcttcccaaagtgctgggattacaggcatgaaagaaccaccccactcggccattctgtatttttagaatacacactttctcttccgagagaggcatgggtgtggcttatactgccagctgttggttgataaccctgtgccgccattcccacagacataccccactattgtccttgctgtttgtgatggattctgatttgggaatatccacccttagtaagaagcttcaccttcccactagaggacacatgcaccgaccaggggtggatggagagggtggcttgagtctggagacctggaatccagcactgccatgaggatggggacggggatggggatctcaggggttgccatccattgtccccacaccagacgatgtgccagcattgtccctggcatgctgtgggggctctaagagatggtgattccttctgaataaggaaatataaaaatgtctcttaattcccctaggcagtaggagctggttacccacaagcgaagcctcagttagattctcccagcagagaaaaggagatcttcaggctagtcccaataggaaccgaactaagcagaagaactttgtacttggatgctggagatgatactgcgtatctaatgctcacgactctcactttgcacagtaatgtgggaccataaaaatggccctgtgaattgaaaccatgcaaagtgatgttaatagcaggaaaaattataattgctgccctgacctttaagcatatttttggtcacagcattaaaaacttttctaccatcaattgtaaatgcatagggaaatggcaagtgatagtagaactggtatttacttagcatactaataatttaaaacactagtgaccttgccaggcacggtggctcacgcctgtaatcccagcactttgggaggccgaggcgggcggatcacaaggtcaggagattgagaccatcctggctagcacggtgaaactcatctctactaaaaatacaaaatattacccgggcgtggtggcagctacctgtagtcccagctactcgggaggctgagggaggagaatggcgtgaacctgggaggcggagcttgcagtgagccgagatcgcaccactgcattccagtctgggcgacagagcaagactctgtctcaaaaaaacaaaaacaaaaacaaaaacaaaacactagcaaccttgagaatggaagcatgctgtttcttggtgagactgatccctagtggtctgagcggtgccacctcctctcatcctgtcacctgcagtgtggggtgagcagagcagccttcctgcactgcacgagctgtcacactccctcctcagtgtggatccatttcccacttgttctcctgtgtgctctcagcgttataaagtatctccaagagtttctttaatgtgaacttgtttcctggcattgcttcctccaggccgtctttgtcccgttccttatagccactttcctcctaagctcaccttcccctgggcgtgacaggagtctcactgcagcctggccaccaacctgcgggcagctgtttcctcttttattttttttattattatactttaagttctagggtacatgtgcataacatgcaggtttgttacatatgtgtacatgtgccatgttggtgtgccgcacccattaactcgtcatttacattaggtatatctcctaatgccatccctccccctccccccaccccagctgtttcttctataactccgtttacggtaggcttgaatttcacttccagcaggactttttatttctttgctgcacttttatctttgttggtggttttcctcttttgatgacctgtttttataaacatcacatacatttacccctgggtgacagggaccaacacagctacatactttgcattctgtacatgaaaaacagcaggttatccagaagctctagctaagatcactgatgaaggtggctgcactaaacaacagattttcactgtagatggaatagccctctattggaagaagatgccatgtaggattttcatagctggagaggtcaatgcctggcctcacagcttcaaaggacaggctaaatttctcattaggggctaatgcagctggtgactttaaattggcatggtaaccagttgccaacagactttgagagaagtgacctgcttggtcactgaccatggcactcatctgtcatttgcatggtgatctgcatggcagaagtgctagctgtgaagtctgcagtttcggcgctgacagtgactctatacaggagtacctcgctttactgtgcttcacagataccatgttttttacaagttgaaagtgtatggcaacctcacatggagcaagtctctcagtgccatcttctcagtagcatgggtgcatttcatgtatctgtgccacattttggcaattcttgtgatattttcaacttcttattatatgttatggtgatctgtgacagtgatcttttttaaaattctttttaattttaatttttaaaatgtttatttcaataggttttttggggaacaggtggttttggttacatggataagttctttagtggtgatttctgaaatttgggtgcacccatcacccgagcagtgtatgctgtacccgatatttagtcttttatctcttaccctcctcccaacttccccgcgaagtccccatagtccattatatcattcttatgcctttgcatcttcatagcttagctcccacttataagtgagaacatatgatacttagtttttcattcctgagatactccacttggaacaatagcctccatccaagttgctgcaaaagacattatttcattcctttgtatgattgagtagtattccatggtgtgtatatctaccacattttctttatcccctcattggtcagtgagcacttaggttggctccatatctttgcaattgtgaattgtgctgctataaacatgcatgcatatgtgatacagtgatctttgatgttactattgtagttgttttggggcaccacaaaccatacccatataagacagtgaacttagtgttgtgtgtgttctgactgctccactagctgttccgtcacttctcttcctttccttgggcccctctaattctccaagacacaagaatattgaaattaggacaaataataaccctaccgtggcctctatgtgttcaagtggaaggaagagttgcacatctctcactttaagtcaaaagttcaagatgattaaacttagtgaggaaggcaggttgaaagcctggtagtctgaaagctaggcctctcatgccaaacagttagccaagttatgaatgcaaaggaaaagttcttgaaggaaattaaaagtgctactccagtgaacacacaaatgataagaaagcaaaacagcctcattgttgacatgaagaaagtttaagtggtctggatagaaggtcaaaccagccacaacattcccttaagacaaagcctaatccagagcaagatcctaactcacttcaattctatgaaggctgagagaggtgaggaagctgcaggagaaaagttggaagctagcagaggtaggttcatgaggttcaatgaaagaaaacatctacataccatcaaagtgcagggtaaagcagcaagtgctggggtagaagctgcagcaggttatccagaagctctagctaagatcactgatgaaggtggctgcactaaataacagattttcagtgtaggtggaataaccctctattggaaggagatgccatgtagggttttcatagctggagaggtcaatgcctggcctcaaagcttcaaaggacaggctaaatttctcactaggggctaatgcagctggagactttaaattgcagccaatgctcatttcccattccaaaaatcctagggtcctaaagaatcatgctaaatctatgctgcctgtgctctagaaatagaacaacaaaactggatgacagcagatctaaaatagatccatagatgtatttttagcccactgttgagacctactgctcaggaaaaaaaaagattcctttcaaagtattactgctcattaataatgcacctggtcaccaagagctctgatagagacctacagagaggttaatgttattttcatgcctgctaacacaacatccactctgtagcccatggattgaggagcaatttttacttttaagtcttattctttaagaaataaatttcctaagggtatagctgctataaatagtgatccttctgatggatctgggcaaagtaaattgaaaaccttctgaaaaggattcctcattctagatgccattaagaacattcatgactcatgagaaaaggtcaaaatatcagcatcggccaggcacagtggctcatgcctgtaattccagcactttaggaagctgaggctggaggatcacctgagcccaggagttcaagactagcctttggcaacacagggagacatcatctgtacacaaaatttaaaacaaaaacaaaaacagccaggcatcatggtgtgcacctatggtgccagctgctcaggaggctgaagtgggaagatcaattatgcctaggaggtcgagactggagtcagccatgatcatgccactgcactccagccttgacaacaaagcaaaaccctgtctcaaagacagcaacaaaaacacaacaggtatttggaagaattgggttccacccctcctggatgactctgagggatttaagacttcagtgaggaactaactgcaaataaggtagaaatagcaagagaactaaaattagaagtggagcctgaagatgtgactgaattgctgcaacctcatgatcaaacttgagtggataaggagttgcttcttatggataagcaaagtaagtggtttcctgagataaaatctactcctggtgaaaatgctgtgaatattgttgaaatgacaacaaaggattagaatatttcataaacttagttgttaaagcattggtagagcttgagaggattgacttcaattttgaaagaagttctgctgtggatcaaatgctatcaaatagcattgcatgtacagagaaatcttttgtcaaaggaagagtcaatcagtgaggcactcttcattgttttcttattttaagaaattgccacagctaccccagccttcagcaaccaccactgtgatcattcagcagccgtcaacattgaggcaagaccctccaccagcaaaaagattacaacacaatgaaggctcaggtgatcattagcactttttagcaatgaagtgtctttgatttaaggtatgtaccttttttagacgtaatgctgtcacacgctagagagactacagtatggtggaaacctaacttttatatgcactgggaagccgaaatatctgtgtgactcactttgttgcaatattcactttattttggcggcctggaactgaatctgcagcatctccgagtatgtctgtgttgtagtaactgaaatgtgaaccgtattgttcagaggcaggtgttatttaactaaatcatgggaactgagatgtttttgtatctgaactgcgtaaagtggggatagcctctccgtggttagatctagaatggaagaggtaatatgtttttgtgggaatggggacctatgattttagctaaatcccaggagtcagcttggagactttctgcatgtcatgcagcctcctggggcctcagtttctcttctgtacaaggctgaataaccttcacaaagtctcttctagctctaaaactatttggttctatgatgcaggagtcctttagagagagttccaaagagaggcataaataattattagaaatcatctttgatataatggactttggagagttggggggaatgttgggagggggcgaggggtaaaagactacatattgggtacagtgtacactgcttgtgtgatgggtgcactaaaatccagaattcatgactatagaacccacccaagtgattaaaaccacttataccccaaaagtattgaaataaaaaaatcatctttaaaaatatgaggaaaggcaaagtcagttgggttggcctttctggtgcagaatgacagtgtcaacacctgttaagtttcccagccagggctggtgatggactgtctgtctccacggcagagtatggaagcagagaggcactacctggggcagagggagatacggctgaaagcatggagaggattaatgtggctggggtgaggagtgagagggaaacttcaacacaaaacaaaacaggaagatagtggagatggtgctccagtgatctttttatctgcttggaaaaaaatggaattaaattcagatcttccaaagaaaagctaatacatgtaagttaggaaaacggcagtgatttctgggagcaacattcttcaagcctggattagttcacccatagaagtcatggaactcatgtcctcacacacaggatctgtgaggagcggcccaagtgcagcctgcagaaggaagaggagaaaactggacctgctcagaaggcctctgtccactgagctttagatcctgtttctgaaaagggaaggcaaaatgtgctcaaaaagaaatcacacagggccgggcacagtggctcactcctgtaatcccagcactttgggaggctgaggcgggcggatcatgaggtcaggcgttcaagaccagccatctctactaaaaatacaaaaattagccgggcatggtctcgcacacctgtaatcccagctactgaggaggctgaggcaggagaattgctcaaagccgggaggaggaggttgtagtgagccgagatcgtgccactgcactccagcctgggtgacagagtgagactccgtctcaaaataaataaatagtcacacaggttatcagtgtactattaatagaaaatgggcatattctttgaaaattatgggtaaagaaaggaaatatatgacatgaattctgtaatcgttttctgataggtagaaatttccctcaaggactgacttgaatggacggggatgagaaagacagtgattgtttctggcccctcagtaggaaaggcgagggcatgggtacaggtgccggaacagccccagcattggttctccctcgggcgtgctgggccaagaaacgttggctctcaggaataaaaatccccagacctcaaacaaagagaagaccttggccgcctctctgtttgctcagcttaatgcccccaaatcagactgtatgaggaaacacacaagaaatgtatttttagcgtcactggcatggggcatgttctggggaccagaaagatgtacaacatctgggatgtatgtaccatgacagctgatgtatgtagtcgacatttctttgtgcatagaaattaagtttctaacaaggagcgcttgcgttgctccgtttatctaaatcaggttggaaggcaaaatatcgtgttttgtttttaaatgtaatttccttcctgttccttttcatggttgtgtctcatgctgggcctacagggtagatataggctgagtaagaaaatgtggccatattttagctatgccattattttaacccctcagccacacatctgctgtggcatgaagtacctgactgaaataaatctccaccagagtcatgatacaggaatgatcttcctaaaaccctacataactatagtcactcagtcatctgtggcctcctttcctttggggacaactttgtaagaaaataatctcaaaacaggaacatcccttgtggttttgtgaggtgctcgccatgagcttctggagtggaaaaggttgtgtgcttacaatgtgggtgttgagttcttttcaaaccttaatgcttttggacatatattatgttcctaatagttttgctgctcttgatgttcacattctggattcttacttccttagattcattgagtaattttatgtagttcacagttcctaggttaaatggacttgatcaattcttccttgagctttagagaactaatgactactgcatttaatttgagaaaattagagattgatttttccaggtattctgcctccttcctcctctaactctaactgcatttatgtttaactttaaaatttacacccatatttttgggataactaggttccgatactgtcctgggtattactggtcaaattccagttggctgtaatatgttgggatttcacattttgcttgaaaataaatatggcagtggagattacttgcactgaaaagtaaatttttttggcttattttatacgttaccctatcctgtcttctctcattgccttttggacttcagagattgtctctgaattatcaaatgatagtgcagtggatgaagtttggccacagatgctagttgctcagcagcagttcctttaaacgaataagggtctaaactgcccagagggccagcaccagaacagggtcttgcacattacataagctccataagtgtgcacagtctgatgatcatgtcatccagcctgccctacattgcagtttgctttgttctgggtggcacttgccccggggtcacagagctgccctgacaggtgacagagcctggccagccctcactgtaatacactctgcacccttcctgcctccaggcttacagacagcctagtaacggtttctgtaatctgagctgtctgctgcttcagaacacatttagagatcagtaagcaagtcacattttccgtgttaaccactgtgggctaaacacaagatgtttttgtgggtgggcaactttgtgtctccatggacattttttggccatacttatatagttaagaagttattaaattacatgtgtttttcccttcttttgttagggaaaatgcaaacttcaggagcttcagatcttcttcttggggatcccgtggggagctggatcctcagatatttaggagcggacaggtcctcacaggcttccaccttcatcgtcttcatcagtctccgtttattgtgagctttcagagcttatgctgaattttcttgctatgttcaaatcaccagggccccaagccttggacctatgttgggctttgatttcatgagagcgtgttagaggttactcatggaacacctgtcaggccaaggtaaaagtgtataaggtgggtcctaccctggcacacttagcctgtctttttaagcttgaaacatttaaaagtatttagagatcttgttgatgaagactctgattcaaagtcagaacttggagaaattcagatagacatcctgagaattttcagcagaaagtaatataggctttttcagctagaagggccatagctcaccattgtggatcaattcagggaactggggtgctggagaaagcatgatccatacagtcccaccagacttttgcctcttgccaggaagttggagagattggagattattgttgttgtatttcatgtgtactttgtcgtatatgttaactcttgtactaacttctagtaaactgtatataggtctcattccataataggggcccacccattttcaaagaatccataataactcgtggagggctgaagtcctgggttgtatcctgactctctctgtgaactgtgaccttggaagagtaaaccgtttctttaaacctcagtttcctcctctctacaatgagataataaaccaatttcacataattactgtgggaattagatgaatacaaataaatcacctagcacagtgtctagcatataataaatatacaacagatatcgattccatttataaagcttccttcctccatttataaagctaagagttaaataacccattctcgtataattgaccatggatatccgagtcaggtgggcctcgctgacaggtgagccaggattctagggccaaatagagacagacgaggtaatgggaaaggctgacatcataggccgtggtagccctctctggggactacttgttaacactgtcttaagactatttaaattccatatttgtgtctatgtgtatatttatttaaagaagccgtgggttcgcttggtcttgtaacttccaccttggacagctgtgtctctgagctaatcccaggatcacaggcttaatgcaatgcagcttgatgagctaagctcatgcagaagccctggtgaaacccaggctggtgttgctgcccagcctctgcaaacatcctggtgcacaggtgagagttgtaggttcaacgtctctgctcaaacccaccttacactatttgtaggtgagcaagccattgacagaggctctttcaagccctgggctgtaacatctctccatgctttcactgaaaggcatgtttgcccacccccaccccctcgtctattaccactgtgggcaaagcatggaaggtatttaggtgggtgggcaactttttttctttgtggacattttgctatatttaaatggttgtgaagtaactgaattacataactgttaaagggtcagcctttagagaagacaaatgtaagcggtggagcatatggtctcgataggcttgggttctgttcgtctcccgaataggccttccttgtgcacaacactggcgtgcattctttcttctgcctgcctctgttattacattggttttaaagaaaccaaaatccttggtgagctgcctgtaggcatgagggaaggaaggatgagtatttctgactttgctttttgaaaagcttccaaatgtggagcaaagaacaggagacaaacaaggagtggtggtggttcttgcatgtcactttgaatgtaactttgaagccaggttgtcctagatggcttatggttataggacagttgtcttaaaaaacaaaaactaaaactacagcacatagacaccaacacagatgagcaaatgctaaattgtcatgtaatgcaagtgactgatcagatgtatagcactggtgaaaggttcctgctgttttgccagcctcttgaaggaatctcagtagacttacaaattcacgtttatgtttcatcatttaacaatggttctttattttacctttttaaggacctaataaataagtcagacaatgacacaagatttggagagctgaaacatttctaaattatattacgatcactactgcttgaggtatttatttgcattttatggggaatttcttaagcaacctgaaattttttgttttgtttcgtttcattttgttttgagtcagtgtctttctttgtcgcccaggctggagtgcaacctggagtgccacaattatagctgactgcagctttgaattcctgggctcaagggatcctcccacctcagcttcccaagtagctgcgactacaggcacatgccaccatgcttggctaattaaaaatttttttttgtagagacgggaccttaccatgttgctcagactggtcttgaactcctggcctcaagtgatccacccaccttggcctcccaaagcactgggattacaggcctgagccattgcactcggcctaagctgaaatgttttggttcctaaaagtgtccatgtgtaagaaaaaagaactgtaggtctttggaccatatcaaggttttatttacatatccccctcttccctacacccaaaattgaatgtagaaaaagtgagggtgttgcaaatacaagtgacagtaacaaacttcgaatgaggttgaacctttacagcagcagtgaagccatgaacgatctcttccgggtgtcctagaggagccctcgtgccttacaggaagttctagccctgtgcagccaacacacacctgtatttgttcagatgtcaccttggtggcacagtgcagatccaggggacacctgtgcctctgaggccgtcggggagggtgtgctgtggagagacctgaggactctggtagcgccctccttcacaaatgtgtgtacatcgtgtggctctttattgctagggtggcatttgaaatttcgtttatttctaaaaaccaacagagcggcacttcaagtggacactatttttgattcagggatcagtgtctgagagcatcagtgtatttcaatcctaaaaagttttataaattctgtataaggtcatataaaggtgtttaggtttgttaccctggataatggcgattcatttggagaagaagcctttcacgatgcttcctgacggcaccttctttgaaggagagtggccttatatcagcctgtgttccttaggcagctggcatcccttcatttcattttgttcctttatttattttgagacagggtcttgctctgttccccaggctggagtgcagtggcacaatcctagatcactgcagcctcgaactcctaacctcaagtgatctttccgcctcagcttctcgaatatctgggactacaggcacatgctgccacacccggctaattgtttgatttttctgcagagacagagtctggctgtgttgcctaggttggccttgaactcctggactcaagcgatcctcccgccttggcctcccaaagtgccaggattacagatgtgagccactgcacctggcctggcatctcttttaaaaatggcttattaaatattgagttgatataagcaaatatgtataacctatgtgtgaggtattaagaatcatcaattccagtggatgcttatgtccccactacccagttccagcagaagaatgttcctgtcatcttccacttcccttacacagacacatcttctttctctaactggatgactccccatgtgggacaactgcctgcacgatacacatgagtaatgatgtggttttccctccacaaggtcccgaggaaccagaggtagctccgttttggaaagagcttcctggttgcccatgggttatgaagtctgctggtgaggcttccttagatgtctgaatgtctctggtggccatctgtaagatgcagtcagtcactgtgttcagggagggcggcccgtggatgcctggcttccacacaagcagtgtggtcctggaggcacacgtggggttcctggaaggagtgcagtttgcagttgttgaagccccacaggtgggagaatatttcgctctagctacctctaggtctttatatgacatactgttcttataatatgtctggacatgactttctttttttttgtttgtttttgagatggagtctcgctctgtcgcccaggctggagtgcagtggtgcgatctcagctcactgcaagctctgcctcccgggctcatgccattctcctgcctcagcctccctagtagctgggactacaggcgcccgccaccacgcctggctaattttttatatttttggtagagatggggtttcgctgtgttaggatggtctcgatctcctgaccttgtgatctgcccgcctcggcctcccaaagtgctgggattataggcgtgagccaccgcgcccggccatgactttcttttcttttctttttgtcctgtttgttattttgtgagattcctagtctgtggattggtgtctttcagcagttctggaaaactcgcagattttcaagatctcctcaaacattgcctccgtcttggtctcattatcctcctcttgtgatgagttgtgggttagaccttcccactctgtcctctgcagtccttctctctcttctgtatttcccatctttctgcttttacatcctgggtaacttcctacagtcattagttcactcctcagctgtgtctcgtgttactagacccatccagtaggtttgtgtttcttgtattatattcttcattccagaagctgtatctgttcttttcaaatgggattgtcattttaaaaagtcgtctttctccttatacaaagttcccaatgtcttcttttctttttaagctattaaacatacttaattttacccactctatctggtatttcccacatctgaagtctttgcaagtctcattaaacttcccgtgtttatgctggatctcactcatggtgctttgtttcttgtttgttttgtgattttcgttttttaaaagtgagcttataattcttagaagtacatctatggaaactcttggcctaggttgaaggtgggtttctccagggggtccatgaatttatacccaccagatgtcttggaaacatccccagctttgactattttctattactggcttcggtgtttttgactcacccagagagtatgattttagtttataaacctccttatgggcagacttatggttacacattctcatgggtggagatagttgttcccatcctttcaagactagtcattttccttgcaggccgctagggtaggaagggtctcggggatgaatttattcctagttcaccattctacggaggatataattttgtgaagactcagctttcttcagcagcagtgttcgttgtgggagccccgcagtggaaatgccctaggctttgtctcccgtctgctagctgcaagagtgcattaaaatggaagctcaaattcattgctttggcaaatactttcgaagtggaaaccttgagtgctgaatgaactctctaagttcctgctttccttagctcatgggctccaagtattgcttactttttcttactgtcattttaaagattactttatccagcactttagttgtttccagcagacggttcctctggggatctcactcactgttgccagacatgaaactcactcaccatccttctagttccagaaacatgtggcatcaacctacgtggctctccctggtgttccggagggagccggggagctggggtcagctctttccctgtctgccttgggtttcccttctttcattgatttcctcaaggggatgcttaccttttctaaaaagacttgacaacttccaaaggttagcagaaatgggccaggcgcagtgactcatgcctgtaatcctagcattttggaaggccgaggcgggcagattgcctaagctcaggagttcgagaccagcctgggcaacatggtgaaaccccggccctattaaaaaaatgcaaaaaaattatcagggtgtggtggcatgcacctgtagtctcagctactcgggaggccaaggcaggagaattgcttaaacccaggaggtggaggttgcagtgagccgaagtcacaccactgcacttccagcctgggtgacagaaggagactgtgtctctaaaaaacaaaaaagtggaaatgaaattttccaccatacctcatgttatctcaggtaaatacccaaaaagtgctggtttaccagctcatattgatttttcattttcatgagcttcaaattttctgaggatattttataactaagtcctgttgcctcaagtctatgctgttaagtacaaaagcttaaagtttaaaacatacttggaatttgctacgtaaaatatgcactagctacaggtgcatttaggtaatgaatacacatgaaaaagagggtagacctgtgtgtgcccttgagaacaaggaattttctcaaccataagaatcctctatagaccctataatttgccagttcttttttatcacacacttgttaggggattgggcaatgaaatgttgctggtaattcttcagaagaattcatggggatgagtcgaattttcaccgtttagttggaggcagcttcccaagtctgctaaagcctgtcttcagcttcccctgaaagttggccctgttggcatcctctgatcgagaggagggagaaccttgaatagtagcagtggggtatagaataaccatcaccctagactctagggtgattcttcctaaattgtactttacatatctttagtgctctgtttgctgagatattaatagatgtctcttgacaaaggaagtgacatattcagacagagcgggaggacatcgtgtacacggcccagctgcctggaatgtccacataggaagtgctcggggcagctgttctttaggatgggagactcagagggaacaacttaaaaatacccgcaggctgggaacagtgtctcacacctatcattccagcactttgggaggccaagatgggagggtctcttgagcccaggagttcaagacaagcctgggcaacatagggagacctcgtctctactaaaaattaaaaaattagctgggcatggtggcaggtgtctgtggtcctacctactcaggaggctgaggcaggaggatcacctgagcctgagagttaggggctgcagtgagccctgattgtgccactgcacttcagcctgggcatcagagcgagactgtctgaaaaaaaaaagccctcacattcacttgagattaagaagacaggacaggaaagtctttgtcagagaatgcaagggatgttgctgttggagaatacatccccaccctcggcacctcttggacaggccactggaattcgtcttcctgaagactcgccattggaggtagcctagtgaatgccttgcagagtcagaaagcccgttagactttgcttaatgagtcagtctccctactgttgtagccttggagtcctttttgtttttagaaaaagacccattagcagcttgcagaacacatatgtcccatgaagggcagtttgggagaggctgacccaaccgactcttgatcgctggcactcgtgcagcctggctttgcaagctatgaggacctgaacacttgggaattgttctgtgtcttaaccatgaatatttgtttgcaaaatttggttgagaagattaattaccttcttgttaagcatatttacatgattagactattttgtgatttgctacaggtgtaaaaatcagcctgttgtggaagatctggagtcattaggagcttttgcacttgctctcattagagatgggatagagcaaaacaaaccaggagagttgaaagtatgacagattgccttattaatgtcctctctgagtacctgtgctggatggattgccagtggaataacttgggaggtggtacaaacccacaagatgacagtcatcctctgtcattgctctcttttgtgatatgagtggcgtgaggaggaagaagggagcagttgctgcatttgatttggaaactgaagttgtcacggggtctgttccatgagcacgtgacgaggagtcatctgagctttctctcagccatgttggtgacctgctctgttttggcatacaaaaattatcttaaatatgggcactcttgtaagatgagaatgagatatatggaaaaataaggaaattatacaaagagtaatagacattactggcactgtaatttgaaatctagtagccgtctctgttttctctaaggctggtgagtaatcagctccaagacttggttttgtctccatggcaagtggctgaacatgcagtgccctggtctcctgtctgcaggtgggctaaggacactagtgcttactttgcagggttatggtgaagtaattcacgtgaagctcttagttaacaaatgctacttgttgaacatgtttgtttttatcatttttttcccctaaagcagtattttgaaaactggaaaatatttcccatctgtttcttttgtttaaggtgataaatgctgtggcattccattgccttgctttttagcagtggctggccaggctgacttcttgctctctggacaagctgcataattctctattagcctgtagccttgctgttttctagaaccaaaggacctctcctcctgctatccaggcagacccttgaaagtggaacattatacatgattctagaaaatctcctacaacagacctttttttgttttttgtttttttaacatttgtgtagcattgcactgtaccctcatcgtataatgttgcttaagagcatgccttttacatatctttcccctgcaggtccttggaagggctagtctgcatatctcgtatctgcactgagtggtcctaaggggttgtttgtttgtttaaactgcaaatgtgatctgttttcagagatgtgactgacttgctgggcttcatgtcctggaacatggcacctgcttgaaatcctcaacagtctttgtcctgtgtcatccaggtagaagcttacatgctacaaaaaaaggactagaatgatatggcatcagacacaaaagccatatctggaatgtttagctctgtcttttttatctaagccgaatgtgttttctactcttttaaatgaacctaacacttaaaaacccagcagtaaatcctagggtgttttggggcttggggggggattttagtcagaaattcattgtcagctttttgcaaatatttgatagtgttatcttaaatgtatgtacgaagtttgtaaaggtgcgtttgatgcatttacgaggtgctgagagtggatgctcccacctgtcattccagcctcacatccccaccttcccggctctgtcctttagcccagatccagctgcccaggagcaggaacgctgtgcccccggcaacattctagatagcctgtgcccgtggaggtcccagtgtccacagcagtctcctcttggtgcccccactgtgtgcgaggcagactctgagaccatccccaagacccccaccccaagatgtgcacaccctgggtggtctcctttcctgggtggggtcagatgggtatcctcacattagggcaaattcagtgacctaggtgaagggatttggtagatgtaattgacatccccgatcaattcatgagaatggagattgtcctgggtgggcctggtctaatcaggtgagtctttaggggggacatgcagcagtctcagacaccctcctgctggccatgaagaaatgagccacactgttgggaggggagtgggccacatggcaaggaaacagtgaccccagccctgcaatagcaagggactgaattctgctgacggtacaggcaaatgctgaagaggaccccgggcctgggatgagagtgcagcccgccttgatcccagcctcaggagggcctgacccgggctgacggctcagtattgttctgagcttctggattgttgaagtctgctgggctgtggtggaacgtagtctcctgggctcttcagagccactggccagagcgtctccccatttccttgctgtgtaccatgcagttgcctccctggccactccccctggtatctggatgatgtctgccacagaccttttctatggggacccctttgcctttccaggtgggccatttgggaaggatttggaccgaccccagtgggctctccctggtgacacgaaccttttgctgtggctgactctaaggttaaggtggtcccagccccaccctttgcagcaggagacagcccatctctctgggtctctagcattcctgggtgaggatcaggccacagtccatgagcctccctgccttgttaggagcttcttggctggtgaacctctctctgccttggcctggacacaggagggggaccattcactctgtccctggagaggggtcctagcgtgatcctcggcacagatgcctcagaagagcttctcttcacaaaggcatctttagctgtcagcacctcggtcttccaggtcgggacccccgacttcccttgtaactgagaggagcctcagagcaccagggaagccccttctgaatcaggaccgggccctgctgcatgatagagaagaaccaaagggtcttgggttggtttttattttacactttactttgaaaaaacacacgtgatcagcaccctcactttgatgtgttatattgactgtatcttgatgcttcctttgaaacttaaaattacacattctgttacacctgtttaattttttctaaagaaaaatgcaggttttttatgcttaataaaatgaagttagttgagtagatcaaatatcttcacctggggctttgaaaaaaaatttaagcagagtggttagtctgttatctgggaacagagtttgaaggaaggccctaagttacctggtcaccttattactaagaaggaaagttactgtctgtatcaggtagtgcctcagtaacgccgtgtaacaaaccacttccaagctcagtggcttcaaacaataaccatttattatgaatagctcactaaacatcactttcacctatctttgctccaaaacctgctcattccagcaaaagccgagacaaccagatcatatggaatgaactgtgcgtatttcagctccctgcaaaggagatgtggcttcatgcagggtccccagaatggaagccttgcgtttttctccacatcagaactaagcctacgattttatcctgagcttctgaagctttaagagtgacttgatcttcttgatcttaaaaagaattaaaatgccaactaagttggcgtgtgtcactctccatctcgccccagttctaaattaaggctgccctagttaaagctgcttatatcttcactgtgcctgagtgttagaagagcttaattacaatccctgcaattggtttgggagtgtgcgtgcgcctttgcatggatgtgtgcgtgcttgcgggcaggcacagacacacgtgtactcaggtctaggtgcaaggactaaattcatctggatacggtgctttgtgatgaagtgggagtggcgtgggagctggcagacctgtgtgttgagccctgactgtcccacatctgattattttgaccttcagcaaatgacttaatgtccaagagcttgggtgtccctatttgtaaaatagagacactgaccttaagctctctgtttttctgggagaacgaagagcatagaccagcacctggcacacagtgagcatcatccccacgccctgagtccattctgcaaatctcacatttaaacacgctaaagtcaacctctgcctttcagaccacagagctgcttccagatcctggccatcctggacacctggagaactaccagtcgggatctgcaggaaaacgtgggcattcccataaacgtcattcgttttgcagaaatctgaccaatgtcactggaagttgatgggcgtgcttcagggggctgaaatcctgtttcaaatctgtgttgtgtctgggaaggtcttggcatctgccggggtgacccacaaaaggcccagcctcactgggcttgaggaggccctggaagcagaacatgagcaggagagcagagctgggtgggaaccagaactcccgcttgcctgcgcctgggtcccagggagagtggcacctgtaagtggaaaactaaagcccttacttagcagactatgagacgtgctgtgcccactctagggggcggaatgaccaggaggaacggttcttctcccacctgtactctgggccatgtaccccagcggggcctcaccaccccctttatcactcttctccaaaggatatcttgcgccctcctgtgtgtctatgtgaggtttctctctgcatgcagatttagagcagctttttctatttcagaatactttttaggtattaatcatgcttgaaatctcatggactcagtcgcgatttgggaattttattatattttattttggggggaagggagctaatttcctgtgggaattttatggcactgttataagcaaacactcccataggatggatatgggatatatcctctgtgcgttttcatttcccatcgcaagttaggtggacagcatctcccaagccttcaggatttccgcaggagcctactaggccctcctcttgtcaatgagcctggagtgactccttgcactgcatgtggtgggaaaaatatccccggataagctggggcatgtcataaagtgtgtggaagggatttttataatattggaaaacatataatgcactctgaacagctttaaatgtgtgagaagagaaaaagagatgtgtctgtaagaggggaaatgaagttagctccaaaaacaaagccagaagtataaaaaagcaattaaaaagtctctcacatttttgcattttctgtatcatgagatcacttgtgattgagccatactttttaaataatgggcaacattttctccattgtcttgcttgagcattaactaccatttctgtgttactcttgtgaggttatttttggtgtgatttgatcctagtcagagcaaaaataaaatgtcagttctacaatgatgtactctataatgtagaaagcacttgccatgtgtcatcgtttcatctttatcgcatcctcgaaggtgtttttccatttatatgtgggtgagctgggcctcaaagaggacaggagatttgcttagggatgtaaggctgagaaacagcagacacggtgtgaactaaggcttctgagtgctggtccaaagtcctcccctcctctcctcctctcttccccttctcttcctcccttcctccttccctcacttccttccctgagtggtgtcctggccccttttctggttactgtctgtctcatgaatatagatgatctggatgggtgtatagaatgcatgggactgttatgtttgtgctgcaggatgaaaagcacccctgtcatttgcagctgcccttggcagagaacgttgggcagtgatgctgactgggctggaacctcatgtcctggtgcaggttccctgtaagacaccattaagtttcgtgcttttactcagctcattggagaaggctgtgaggcagagaagccaaataagtgaatttaatggtgctcagaaaataccagttctacagacacttcatgacaaccgtcacagatcagccttagagagtcgtgcatgggaagatgtcttaatattgctgacagggttgtcgcttggcatatgcccttgtccttgaatgaggcatgaactgtgccttgtataggaggcgggcctccaggctgacacttgggtttgctggccttctggagaccgggcccttatggtgctggcctgggccgagggagcctgttgcacacacagcttttccagaagaccttgttcttcccacctcttctcaatcctcgccaaagacctagctccaggctgacccaatgtgagcctctccccagcctgcagtccctcacccgcgggctttctggcttctcaccttgttctgctcaccggcccctctaggaaatttgttaggactcggccacatgcatggctacttggaagaggcagaagagagagctccgctggagggagaaacgaggcagagtgtgagagcaaaggaggggaagtagaatggcccaagcagtcctacatggtctaaattggtgggtgaaaggaatgagaaggacctggggacctgcctgagtcccaggaggccaccatggccttcacagaggcagcccatcaggtctggggctggagaccccgggctgccactcctgcagcaccccctgcttccctcgccatggacacccattctcaaagcttgcctcctgctttagcctggcttgacgtcctgggccagctgcctccatttctctgtcggctcctgccctccatgtaggaggctgggacactccctcctggcttcctagtgactgtcgtctgcctttctacccaaagttgtggcttctgcacctggcctcacacttcactgcctgatatgctgccctggacaacctacctgggctttcctacagcagcctggtagcagatccctgagagtgggggctcttccccacctgagtctaaaagtatatgggggaaaacacagtgactcctagcccacatctgccagtagtcttcctctgccagcactgagctggagacgccttacctgcgttaccctgttagtcctcacagcagaattgagcaccattattactattattattttgagatggagtcttgctctgtcgcccaggctgtagtgcagtggtgccatcttggctcactgcaacctccgcttcacaggttcaagcaattcttctgcctcagcctcctgagtagctgggattacagatgtgcaccaccacgcctggctaattttcgtatctgtaatagagatggggttttgccatgttagccgggctggtctcaaactcctgacctcgggtgatccacccaccttcaccttccaaagtgctgagattacaggcatgagccaccacgcccagcccagagttgagcgctgttattaccatctgttttcaacctctcaacaaggttagtataatttacgtaaggttgcaaatttatgccactttcaaaaagaatagtttgctcttctacaactagcttgttgcagagttagattctgcagtaacacccgtggttcccattgcacaccccactggctcctgcatagcagcgttcccccaactgtaggatacatgactcccagggggttccaggaagatgcagattctgattctgatgttgggagtgaggcctgggcatctgcctctctcacaagctcccagtgatgcccctgctgttggtctgtggcccacgctttgggtagcgagagcttagatcctcggccgtggttctagcttcccaatgctttggatcacaggaggccagagacactggcccaactgatgtcagaatgatgggaagtcgaaatagcagcatctacttgaaacccttgcttagaaagtacagagattaaagatgtgtagggagaacctggttaaggagctcactgtctgattctggctctgagcaaaccagagcttgcccccagccaccccctcatttggcagtcctgggcccccagttgcccggcactggccaaaggcccatgtaccatagtggtgacctttcagaactagctacttgggagattcaggttctctctttgatgtattcctcccacattccaaagggaaaggtattctccgaagatggcctttgatgatacaaatggtggtgatgactgtaagctacctggaacactgatgcctgttaaaaggaggtcatccacaagtagaaaatgaaaaaatgcatatggagaccttggcaacctcaaaggcaggctgtcgcggtgcaagacttttagaaagccctgtaggaagctggaatgccacagagctcacagaactagacccaagtaaataatacatgcctttaggatgggatctatcaagtgactttgtgaagtgtggttttcatagtcatgtggacatggcaagaaacaaaggttgagctgctaacccctccagtgtgaaaaacactgaaaagaaaatataacttttggatcaatagcgatcctatcctttctctgaatgttggcaggacatttaaataatgtgtgcacagaagacagcgttctgatgtgcttaaacttgtgtttcatccacataggctgtccacagagtgtgtcctcttgttacgctgttactgctttagagacttccatggcaccatcccaccgaggtggaagaggttccgttttgaagcactgtcatcctcagataatgtttgctttcatgaaaaatgatgtgtttatctctgtagtcggaagctttctcttttgaaatatctcagataatttgaggtgactaggtggtatttcagggtgagtttcatcctcaaatatgtgtccttagaggccaagttaaaggaaaaaaaacactgcccgatcataaaattcacatttgagtcaaaagaattaaatttgccccctacctgtgcttccagccatgtgtctccagactccttgatggatgatttgtggagtcaccgacctgctgctgtaaaaaccataaacctcaataaagtgatgtggaaatgtagtgtacagctgcagacttttaaaagtaagaagaggaaggaacacatgttcgtcttcctcccccagaagaaaaacaacattggattctaaaagatggcctcctcctttttgctcccactgaatgccacagctgttaatggacagtcttagaggagatgatggggtcatcagtctgtttctggagcattccgaggctttagatagggagcagcatgattctagcagtgctgcgtgttcttgggcagcgtgtccttctagtaggagtccaaaaacatcctggccaaaatgaaatgatttccagcaatatctgcagtgaaagcaaattgacccaaggataatctgtctcccagcagagagaggcggcagggtggggtccgctggctcagcgaggcaccctggactctctgcccactgagtgagtgctctcgtgccctggcacgataaaacatgggttctttgttacagcttggtgacgtgtgtgacatgcagggaccctgccagggcccagggtggacccccagagtgagagctgtggctcctgctgcctggaagcctgccctcgagccaggaggaaggggatgggggcatgagaaccatagcatttggtgagcagcccccgcagatgtcccagggtcatggtggtgtgggctgggggtggggtggggggtggtcctgggcagcgaaacttcatttggaaggactatattctaaacacttccaaaccaaaagtctggatttagagtaaagttaagctgcctcttaacacagtggttctccttcgtttcatctgctgaccacactgtgccacctgcaggctggtccgcttgctggctgttcctgcactctacaaaactagaagttgctattccttaaccctggggcctgccttgggctcaggaccagcccagtcctggaggcagccaagggtccacaaaggtcacatgggcactgggtggcaccagttccaactcaagattaagtcacatgcttgatgttcctttaatacaaagtctgttaagtacggagacagatgtgtgactgtcctacttgtggaatcagtcttacggcttaataatcacactttggccgtgcgcactgtgtgattatagaatcacatctataatctcagcactttgggaggcaaatgcaggaggactgcttgaccccaggagtttgagaccagcctgggcaacatagtgagaccccatatctaaaaaaaaaaaaaaaataggtagcctcccagctactcaggaggccaaggcaagaggatcactttaggccaggagttcaaggctccagtgagatatgaccgcaccactgcacgctagcttaggtgacagagcaagactccatctttttttttttttttttttttaaagaaatcacactttgtgataacaatgtcatggggagaggttgtctggctctggtctgaggtaggaggaaggcacaattcctggtgctcagagatctgctctttgggctggaaccctgatgggcctcctttagtaggaaatggagatggagagaaagcgctgcatctttctccttagagaactctggggttgtgctggcctcagagacagtggagggggtgagggtcctctgagggcgggagcggccatatgcaggaggctgcgctgaggatgcagggtggctggtggccctgctggggggcggcctggccctctggagacagagcttcccatgccagtggctgtttgtgctgtgtggagtgtgattttcacactgaccccccaccacccccaatgtaggcagagtgtggtcccctgcctggtggtcatgttactttggaggataaagagtaggaaccctggtccatgcagggtgatgggcagtgagagatgggagcagggctggggacagccgatgcagcctcagagctgcagaggcagctgccgggctgttaaagtcacccggagggatgcaccccgccgtgcatgcggtggacggctcctgcaattgccttcagagggtaagagcgattgggaggggcagcgaagcagccgacttctggagtatgtattattcctccctctgagaaatacgtgactatacattcaagattgcggctgaaacttcggtggtagtattcggcctggatgacctgtggcattaaactgatgcttataaagtagatgtgctagttactaggatttggtgatctgagtttatttccaaacaggtcaggcccagatacaagcgaccgcgtagttgggagaagagcaatgctggaacagtgggtccctgtcttccacatttcctaaagtgggagggaggcggaggagtgggatagcttttgattgagggcattgacatttgtctaaggaattaaacaactgggcagctagatgacctcagtaaccagtctcgtctcagccccagccttttgatgctcatcatcttgtctggttttataaacagggagatgaatccaccttcatcggacttggcaggacagaggcatgttcatctgtgtaatcaggtttaatagcagtggcgcttgtgaaatagtttgcagtcctggtgcccagggtggaagccttctttgctcctttgtgttcctggggtgtgatggcatgcctggccctgcgccttccgtcctccaggctcccaagctgagggtcaggggccctgtcctgggcaggggccgtggaaggagcccttggtcaggagcttggagtagcaatgtcgggttttctgaatgagaagcaaaacaacactcgggaaatgagcctcgtttggctggaaatagtgtgccagtgttttcttgcttcgggttagataccagttaatttacccattgtttttcattaactaatacatcaaatttctgagcacctactgtgtgtcagggctaagggataagccagcgaccaatagacaaggtccctgcccctcacagcaaccatctagtgatgggctcaagtcacagggcttctgtctgaataaacttgtgtatctccacaaagagatgtttttgttgctgcaatggatttttcatcttgaaaccccagtcactttgatgtatttctggtccccaactactgtcaaacatttactttttaactcctcatgaccactttgaagaaccagaaagggaagataaagaaaataacattgcaatgagcagatctttggactagagcattttaaggagaaagggcttaattttgaagaaagtcaaaatagaattaagcatttacacttagcttatgatcccaatttttttcatattctttgcattgaccgtaacatttttcagtgtgcctggcaagaatttggtttaaatatgtggatttgatttaaatataaattgtacttacaaacggtactccagttgcccattaccatggatattttggaagtgattatgtactgaatcttaccatgaagcagtagtccatgtatctgaattacatttaggccttttaaaacatatcacattatgtatatagttagaaggagggatgagatgggtatttttgaattgagtttaatggcttacttcaataggtgaataaggttctgctctgggaattaaagggacttttaagtttctctcttgactctgatgtgcctttcactgaacagtaaaggaccggggagacttgcccagctctcctacttgacaaaaggtgaaatagaatgatgccatgaaatgcatcaatgtaaaatgcagttttaagattgcattttaacttgagagggtcgtgaagctcttgccttcccattaagcccccaggaataatctccaggtgtgtcttctggcactccacgctgcctgccttctgatgcttcctatgaattgttggaaccagccatatccttctcacttctgccacaaaaactcctggtggttttgtactttgccaccttgtttaggtttcataggcgattggttcaaggcagtgcctatctgcacttccctgtaactctcactttttttctttaatgtggcctgcatatgaatatatcaacactttttaaattaaaggctaatgagctcactgcacagcctgagtacgtttggtatttggccttcttggagatgctctgcatgtgtcaaatgttattttcagaaaactggctaaacttttaatgggacctgttgttaaatcaccctgtgtttcccccataaacacgaatgttaatttacatttttaacctaactgaatgagttgtttttcttaaattcctttgcagtttgaaggaacataccttgcaacaggaaagctttaagaaagaggacgaaaaggctttataatctttcttgaagagaccctgttgctaaaaagaaaaaaaaaaagaaagtcaaaataaacacatagaagagagagaggctgcatttgtctggtgtgccctgtactttcttatactcatgtttgatatttgctatctattgtgggacatctttttgtatgctttgctgaggtagaattcacatactgtgaaagttactcacttttggtgaagagttcgatgaattttggtaacgacatacagttgcataatctacaccacagtcacagaacagtcttatctccctgaaaagttggctcatgttccttgatacccagtccccagtcccgaccccaggctccaggccacctcggacctgctgtcactctacttttttctcttctggaatatagtacagtagaaacatgcattatgtcatccttgcagttttgcttctttcatttagggttatgtttttgagactcatccatataatggtgtgtttccatggttcattctgttgtactgctgagtagtgttctatggtgtggatgtaccctactctgttcatccactcatccattgacggaactgttcattgtttccagtttggggctattagaaataatatttctgtgaatattcacatagaagtctttgtgtgggcatatattttcatttttctttgttaaatacctgagagttgactggccgtgttatatgtgtttaatttaatgggtaacgctatactggttttcaaagtggctttaacattttgtattccagccagcaatgaatgggggttctgattgagccacattctcatcaacacttgatattatcagtccttttacctttagtcattctggtggttgtgtagtgcatcttactgttgtttgaatatgcatttccctcatgactagtgatgttgagcatctctttatgtccctcttgcttatctgtgtctttacttttgtgatatgttgttttaaatcttttgcacattttttattgggttgtctattgatttgtaagaaaactatatatgttttgaatacaaactttttgttagatatatattttccgcaaatattttctcctagtctgtggtttgttttttgtttttcttagctgttttcaaagatgaagagctttttatttgtatgaggtccatttcataatttttcttatataaattgtggatttcatgtcctgtttaagaaatctttgcccaacctaatgtcacaaagattttctcccatgttttcttctataagtttaacagtttcagcttttatgtttagttctatgatcctatcaagttaatttgtggatatggtatgagttaagagtcaagttcactttttgaaataaagatacaattgtttcagctccatttggtgaaaaggccatcttttcccccattgaattaccctagtaccttcattaaacaataaaggaccgtataacattgagtgtctttttggagtctctattctgttccattgatctgtaggtctatctgtataccaatatcattgtctcttgattactgtagattaataggaactcttgaatcaggttaagttctccaaccttatcccttttcaagactattttggctttaggtcttttcctttacatagaaattttcaatttagtttgtcacctattcgaagaagtatgctaggattttaattgcagctgcactgaattgaaagattaatttaggaagaatttccatcttaataatagtgaatctcgcaattcattaacatggtatatctctccatacactaaggtctttgattttccttttataattttcagtgtacaggccatacacacctttcattaaatttattcctaagaattgtttatgctcttgtaaatgaaagtattttaaaattttcattttaagtcactgctggtttaaagaaatacagttgatttgtgtacataaaccctgtattctgtgactttgctaaactcctttatttgttctagtagctcgtttgtgtattctctagacttttcttggcataaagtcatatcttttgaacagagacgctgttttacatctttttttcccagcctgtatgcctttaatgtctttttttttttactttactgcactgttcagaaccttcagtacaaacttgaataaaagcatttaaaaaaataggacatgcttactctgttcctcatgtaagataaaaagcaagagctttttatgactgagtagtaatatgagctgtatgttttttgtaggtacttttaatcagattgaggaagtctccttctgttcctactttgctggtagtttttacaataagtaaatgttgaaatttgtcaaatactttttctgcatctattgaaatgattatatgtttttttcaaatattctgtaattataataaattgtattgattaagttttcagatattaaaccaaccttacatgtttgggataaatcccatttggccatgatgtattattccttttatatattgttagattctgtttgctaaaattttgctaaggacttttgcatctggcttcattagagatattggtctgttgtcttctctttcttatgatatgtttatctggtttggtatcagagtagtattggttcataaaatgaatagagaaattgtcctgtttcctctattttctgaaataatttgcataaggtggtattatttcctttttaaatacagtcatgcattgcttacagaagggggtaggtgtacttacataaacctagatggtatagctgactgcacacctagggtatatggcagcagtccccaacctttttgacaccagggaccggtttcatggaagacaagtttttccatggactgagggtgtgcaggaggatagtttcaggatgaaactgttctacctcagataatcgtcatcaggcattagttagattctcataaggagcatgcaacctagatccctcacctgcacagttcataatggggctcacacacctgtgagaatctaatgctgctgctgatctgacaggaggcagagctcaggagataatgctccctcacccaccgctcacctcctgctgtgcggcccagttcctaacagtccatgaaccggtactcgtctgcagcccagaggttggggacccctgccgtacagtatagcctgctgctccaaccaccattataaatgtggtccatcattgaccaatacattgttatgaggcacataactgtatttaataggattcatcagagaaaccacctgggcctggaatttgtgtgtgtgtgtatgtgtgtgtgtgagaaagaaagagaaaaagggagatatttaattattatttagattatttaactgatacggggctcttcagtttttctgttctttcttatattcattatcataatttatatctttcaagaaatttgtccattttcatctaacttgttaaatctattggcacaaaattatttataatattgtttattagccttttaatatttgtaggatctgtagtggtatttcctcttttgttcttgatcttggtaatttatgtcttccctgttttcttcttgccagtctagctagagaacttatcagatttgttgatcttgtcaaatacccagcttttctcttcattcatttttctctattacttttctactttttattgaattgtgttcttatctttattatctctttccatttacttactttggagtttgtttttctttttctgatttcttaaggtgagaatttagagaattgattttatgtcttcttttataacacaagcacttgaagctgtagacattcctgtaagcaccaatttagctgtatctcacaaatttttaattgttttatttttactgtgattcaattcaaaatattttccaggttaccccatatttttttcacccattttaaagaatgggatagtagagtataaatgagagaaaaaaatgcagctttccattcacatatttcttggatgtgaagagtctcatttaaaattttgatgtctatgtttttttttttttttgagacaaggtctcagtcttgcccaggctggagtgcagtggcacaatctcagctcactgcaacttccgcctcctgggttcaagcgattctcccacctcagcctccccattagctgggactacaggtgtatgccagtattccaagataatttttgtattctggagtacagacagggtttcaccacgttgactgagttggtctcgaactcctgacctcaagtgatctgcccaccttggcctcccaaagtgctcggatgacaggcatgagccactgtgcctggccttatgactcttactgggaataagccttcctcagggaagtcaggctctggttagggcttatggctctagagtttatctgcttaatgatgtctttgaagaaatgatgagtaatctttctcttatttgtccctaggagggaaattagggttagtgtttttgtacctccttggctcttaatgagaaattcagtttcctttggtgtaacttttgattttggctttaattcccctcccctcgttacaaagaaaaaacagagaagtagtttctgccaagtactctttttctcagagtagagtgattgcttttataggcttgtttgagtgataaaagcttgttaggaaatcatctttatgccttccctgcaatgctttatttcgagacctctggggagacatggggtccaggaaatgggtggggagcatgtgactgtgtgagcgcaaggacccacgtcagggagcaactgtgtgcttgtttgaacaccagctagctgaaggaagaggttattcaggtaattgctcagtccctaaacgtagctcaatttccttttgttatatttgcatagaaaaagagctgttcaagggaggaaccagagcacgaaaaagctagtatttctcttttgccaataggaaaaacagatgcaagctcttcttgacttagtatccttcactacagaaagcccttttatgtttttgtggataaacatagattattttccaccccctttcctcctctttcaaggtggctatctgactccatgcacctatttagtatttatcactgttgtgatatttgtgctttctcatttgcccaaatgggagaagcaaatgaagtaggtatcatgatcactgtgtcttggtgggaggaaagacgtgacatctgaaattaatgggactaatgtaaggattgatattttcatatttgctcaattgcatcctgggttaagcacattcaacaggtaaagaattcactgtctaattataattcttctttcaaaaaagaaacccatagtgcataaaaaagaagtgtaaccaatgtcaacactggaagggagaaacaggtgctggcagacaaatgtcctgacatggggccacattgctatgccttgggctggctatggccacctgggtccttgaagaccactgtcagcccacaggcaaagtcctgtaggccctgacacccccagggttggggccgatggagccagggtcacccgcatgccaaagctccttctggcccaagaacagggaaatgaggaaagtccacagtcagaagttacgcagccagatgccagggaggttgagtaaaacagaatattttgtttggtttgttttcatgccaaatcttcccaatttatctgtgtttgtcttttttaaaaaatacaagtttttaaaaaactagcaaaagatatgggccaagaaattgagatccccgtaattctttgtttagtctgtaaggcagagtacatttgcatctgaaattaaatggccattgaataaacacagggactcaatatttgtaagggcactaatgtttgcagatgtctgcagttgttaagggcaagccaaggaaacaggaaatgctgggactcatattttttttctggaagaaatgggcattccaaatgcatcctatataaccttttcttcttcttcttcttcaggtacatccataatagtttctgaaaggtattcaatcctggtggagagctggagatgtgtttatgctgggggttgttaaatatatttacagccttttcagagagttccgtgggggttcgtcagtggttatttattagtctgcttcaacatctgctggctggaaaataatctgtccaaggcaattcacaggaacattataaattgcttccgattataatgagcagtaggaaaggtaatttgagggaaattccacgcatgttagttacagcgtgtcagaagcaagatctggtgtgaaatgcccagagaatcagtgtctgctgataacagttataagatggaaggttctgggtgtctcgaccgtgtttttcttcctgtctcacttctgggcttgctgggcaacttgcctgcttgctggggttctttggagcctgtgggcaccttcatgtgggcactgagcagagccagccctgccccttcctgcaggcactgccagcggtccctgagtggaggtggaggtggaaaccttgagtgttgaggcccctgggggctgctgcattctagtttccaagacagagtctgcagagctgtggcaaccctcagaggcccacacacacctccaaagccagcccgaccccgcaaggcactctcaccggggtataaattggtgctgccattttggaagacattggaggaaaacgcaacaaaatgtaaaatgtgcagaccaatctcctcagcagtttagaccaatgacaacaataactattcaaggacactcattgcagcagtgaaatgcgtggtccactttaagttgcttattataatactgaaaacttggactgacattaaccagtgccaacaatagggacttggttaaagaaattacagaaggaaattcactctatactgttcagtggaaaacaatcagtgagaagcatttgctcatatatgcaaaagggtgtgcacacttgggtgtgtgtaccgagattactggaagaacagtgtgaagagtggtctcctcaggtggtgggagtcccagcttcctttgtgagacatgagcatgtggagactagaactggtctttctcatagaaagactgttggttctggtgttctgcactctgcacatttctactaataattaaaatacttactgcctctgagatgcctccggacacccttctgaatcacagtgttcagaaatgctctctaaatcaggaaggtgtggatgacctttggaccttccctggtgtgaggagtttagcacactgagagtaatatatgaaaaagaccgccaggcgtggtggctcacacttgtgatcccagcactttgggagaccaagccaggaggatagcttaaagccaggaggatagcttaaggccagaagttcgagaccagcctggacaacatagtgagatgttgtctctacaaatatagcccaaaaaaattagtggggtgtggtggtacatgtctatggtcccagctactggggaggctggggtgggaggatcccttgagcccaggagttgaaggttgcagtgagctgtgatcatgccaccgcactccagccctggcaacagagtaagaccctgattctaaaaaaggaaaaaggtcactctctactcaagttctacttatataacagcaatgcagctctcttcataaagctggctgttgtgtagtttatgttggggaatcagttcatggtttaaaaagttctgtcaatgcagagaacaagccggtgtgttttatggagaggctgtttaatctccactgtgagacagtaaatatttggctgttgcatcatcgtgaagcttatgatcacagtctggcgccatctccctccttgcctggagtctgatctgtcccggcccagtgtcctccaggaccctggcccctcatgcctccgtgcttgcgcgtgtgccatttcctctctccagaggacctttcctgcctaggactcatgattgtcccctccctggtaagccatccccgaccttccaggcagaacctgctggcttctcctcagcactttgcatggatttctgtcacagtcctgggtgcactgtgtcgccctctctatgtgtcagcctcccgtcccctaccgtgggctcctccagggaggtgtggacattcatcctcttccaggcagccctcaggaatccagggagaagataaggaggcggggcgggcggaggtgggtgctccacacactcagaacactttcctctgcacttacttcattctggtttttcttttgggtccttggtgtttttaaataaaccctttcctgtagtttgctccccttccatggagggctgtttcgagcacagatctgctgggtgtctgtatttacaaagagaaggggccactcgtgtgtgagcagcaccgagggacagaggtaccttgcctgcttgtgtcccctccaagtccttctgatattttcctttccagctgttgcctagtttcctggtattaaggagaatcaactctctggataaacgtggtaaatatggcccatagtcccatctttttacaggcattttttacacctggagcagccagaggacgcatgcatggctcttcggaaggtaatttagggatcacccatgtaagtttcctaaggatttctttaacatggttcttctgattcagtccggccaattaaatctaaatccacccctgaaagccatctggtgtggataacaagcccacaaatgagcagtcagctttttgtgccctttagggcctgggacaaccacgggatctaaaaggggctggaactagaggtcttgagctcctgttcctaaaatcatcttcatcctatatctgcagccttctcctgccacggcatgcacccacacatgcgagcctcccgggtactgtcatcctgaattctgagaccatccagcacttcctttagttttgccctggtgctgttgacttttgtttactgaagagtgtgctggaggcaggacaagggacatggaaggctgcaatttaagagtctaaaaggttttagaatcctgaaggaggtttaacaagctgaattgaagaataatacctttctcaactggagagaatttacatgattgcattattgttaaaattaacatctcatctattaaaagcatttgtagattatctttgtaccttcactttctttgtctgccttacattaggtctcagaggtagattggtggagtcacctggagtttgttggtgacttggggtttggctggcctgcggagtcagccagactctagctctgatccagattctgccctttatctcctctgtgcccttgggaaagtcagtgaaactttctgagccacagtttctccaataaggaaaaacgaccgccaacggggctacctgttgagccctacctccaacagggctgctgggaggattagccaaagagatgtctgtgagggaaaccagcacagactctggcatggagtatgtacccggggataccaggacgaggcctgccccgaacgtgcaggcccacatacgtgcatacgtgtggacgtgcacatgcatgcacacagtgtgcacacagggtgaggcaccgtgaagctgaggccgcacttctgggctttcagccttggcattgtggtttccatcgctgggcctgctatgaagccacgctgcttttcagaaataccttcagaaatgagattgggaaactttagtgaaaaacgtgttgattgcctgaggcactgctctgcctccgggctgttttcctggagtgtgatttccccgtcagagtgctgcagtgggccagggacttgtctagggtgccatggaggcacaactgttgattatgttaataggataaacaaaccttctttgacaccataaatagcagacgctgtgctttcctccccacctcctgggcagggaaaatatttgaagctggaaggaattgagccctgagcttaatacagttacagacccagaaagaaaacaaagatgggtacaaagatgtgttttcaggagacagaaaattgtgaaatcaacccatcagtcggcccaggactggctcaccttgagtggctcctggtacagtgactgctgtggatggcagcctgcatggtggatgggaaagcggagttcgtgtgggagacagagctctcgcgaagctgtgctgttttctcttaagtaggctagaatggaggacaacttacaggtagacctaactgcaacctgttgacagtgaagctaaagtccgaacacacccgtcacctttcagaggacagacagaagccatctttataatagtgattttgcacagaccaaggagaggctaggtccaaccgtttcagctgccgccaggaaaaagggtccaactccctggagcacatcagaaggttagacgtcatggcaggtgatggtttgtctttttttttttttttttttttaatgtgctccttttattttccaaattttctaaaatgaacaagtattacttttataattgaaagtattattagagaaaacatacattaaactttcttagaatgtaaacatccactgtgtgaagtcagtcccaaagttttaacggccacgcaatctagccttatccagtggtgctccccagaaggtcctcagctgagagagtggggtggtgttagtggcctcctcttgatggcccagctgattgcaggggatctctgggatgctgctgatggagtacctgggaagatggctccaggactctgaagggctgcgtgtttttgatcttgctccccgagccccagcctctttgaccacatcattgagctgcgcacgttcagggcagacgcctggaactggagaactctagggaagcaaaggggactcctcggggactctgatctttatgtccaagttatatatcaacgaatccttttggcaacaccaaaatgtatggtgagcccttagttaaagtgtgggaaaacatgaaaatgatcaaatatgaagtttgcagattaagaccaattcaatggccctccattgaccagcgagagaatcatcctgtgtcatcttgtcttgtcctgctgggatccactaatggctttctcctttatggagtcctgtgctgaggccagcagtagctctggttactcttccacacacacaccttcttctagcagccggccatgagcagtgcggtttcttagctgcaaacaagctgcgggaactgaggagggtgggaaactggcggggcaggaaagagacaggagatgttatggagccaagcaagctaatttatgacaccaagcatactcagtgcctgctgtgcacaggtcacagtggggtggagccttccaggggtggaacatgtaaccacagctcaaaagtcagggaaagccaatggggcaggatggaggctgggaaggacccaacaggtgagagtcagtgggcttcatttgggaagtcatagtcacagagctgtcctcaatcctaagccaagagggagtttcttagcagcagcagtgaaggatagggtcgggatgcagtgttcataactgtgggatcacaggcccattaccttccccctctggacctaagttccctacctgtgaagtgagagcctgaggctgttcgggattagggcagatggtttagcccctgcttggtggggagtgggtggtaaaagtcaacaacagttgaggcaggggactgggtttatgttcacagatggagagatgggtgcattcagcctggacccaatggctgtcactcatcaagtggaaggtcaaggggtaagggaggggagttcagtgaagcagctctgccggggaaccagcaggccaactccaccactaactgctgctcgggagtaatttgtctaactgaagtggctcaacaataaaagattgaagatggcctcccctcccccctcccctcttgcttgcctgacagagtcttgccctgttgcccaggctggagtgcagtggtgcaatcatagctcatagcagcctcaaattcccaggctcaagcgattctcctgcctcagcctcctgagtacctgggactacaggtgtgcaccaccatgcctggctaatttttgcattttttgtagagacagggtcttgctatgttacccagcctgggtggttttttttttaaataccacacactactgccatgtgatgtcactgaataacactggtggaattactcagtaccctggcacaaaagtagtccgtgtgtgcagggaacttcatgcaagctcattaggcctgatgctgtcgggcacgtggttcccccatccgccatccccactttctcagcttagagaaagcggtgatctctgaggattctgtcgctgacatcagtgaggggcttgccagatgatgaagcggcacagaaaggcagtgtctctgttaggttatgaaatagccacacagaaagccagttggcttggagagggggtttcactgatctcccttgacagaggagtcccattctttttcatttacaacacttgagatgagaacatttgacattttggctggtgaggtgacactgcgcagctgttgtaatttttgccatcttgaaatttattgatgctagataagattgcagtgggccccgatgttgacaagtagagctcttgtgccagtgagaattgtgcatctgtcttcctttgttaacctgctttccgttactgactttatttccattaagtcatcctttgaggtaggaaggaagaaaatgtaccacttcgtcatttactcgagtagcatccattagggtccagtgattttaaagttacagtcacagattctgggcttctttgaaagctaaaactatttgaaaaattaactttctgcacaagctacttgagagtaaaaacaatgtcttaaacttgttagatgatccaccagtgtctaactttgtgcgtctgctgtatcagtgtcacaggatccttagggtgttgcttcacccgctggaaaccttgtagccggtggcacctttgactgagttttgctcaggcccactgggctcgttctgcccactcgacctggcaggctgcacttggctttcagtcctggcccagatcccacacctgtcaagggtgagccaggtgcagagtggcgaggggtgcatgagtgagtgagcgtggagtgtggccactgtacatggccaggcatgctgtctgcaatggggtgggcagctccttgctgtggctggaccaggcataccacaagcggcttccactgtggacaccggggaagatggtggtgcccagaagtttggaaatgctaggaagtgcagagccccaaagagggtgtcacagccctggctcagggagctcctcctatgtctgggctccccaaagggctgcagcttttctctcattctctcttctctccttcttgtcacccacaacatggcaagcaggagggtgtgtttcaggcctgtttgtgttacagctctttcagtcccaccattcagtaggtcctgagttcttgtcctgcatccagaagaacgaggtacccagacaactggagggtgagcaagtcaaagaggtgctttattgagtgacagtatagttctcatgagtcccgaggtgggtagctcctatccacaggcaggtcattctgacaaatgcagctctcagcagagaggagacccagagtgggtggctcctctctgcaggcaggtcatcttgtcatctgcctgagtctggctgagtctggggggttttatgggcttcagaagggaggaagtagatgctgattggtccataggcagccattggcaggcctggaaaaagcaccgtaagttctcactctggccagaaggtggggttagtcaccagggacctgcccctttccacccaggagcctgtctgcctcctgctgctgttcatggcattcatggcgcccaggctgttggtgccaaggggtgcctgcaagcccaggctgagccactttcagcacccccttggcctccttcccctgcttgttggcacccaaagtccagaaggggccaagggcaaggggctgggatgtcagtgccactccaagtatgtgcacacctggtcaggtcgtaatagtgcctgggctcatccacaagtttgcttcaaaattggagtgggtgctgggagtggggagaggccaggcagtgggagcaggcacttccaagcctgctggggcacggggtggtttctgggcctccaagagtccaggggtgcagggatgcccatgtccacagctgtggctggggggctgcagctatgcctgggagagtggggctcctgccccaccaacttggaaagggttagggctcccacctgttcctggctcctgcctgctccagggagcacacggccccacccatgcctcccctgctgcagccagcatcatggcagcggccattctagacaggccattgctgccatcatttgtacctaataaatatgagatgggataatgcaaggaatacttttttcattttaccatctcaagatggggaatctattaattatttcatgagtcctaaagcaacttcttgaatattcagctccccaaaagcaaacagctacttagcctagctgattctacagggagttgcatttcgcttttgtcacaaatggatgctggtgtgtgcctcacaaagtcatagttgcatgtggtgtgggggtgggctggttgagatggcattatgatgtttcagaaaagctgtgtaaagatgagaaatatttgcatccagacacagagggaggcaccatgccagcatgtaatttgccaagctccctgctggcagtttaaatgccctgttgattttattaaacattcttaataagaagttggagttttgtttaggctaaaaccataatgaaaacagctgtcttcatttctcagaaacagtgagattgtgcaaggatgaggaatcacgctggatagtggagctgccatggtccccagctggggtgctgcccatggaaggtactggggatgtccatcaggtgcttctgggaaagggcccaggaagaccagacggttctgttcagtttattttattcacggaggcattttaatgggagaacagatctataattgtgttttaacattgtctgaaaaagggaactgaatctgagtgtctgagctgtgagcgtgaaacatagaaaggccgtggctaccaagagcagaggacagtgggttctgctggaagagggaggaaacttagagaacagacaaagagttaaaattagccccggctggaccatgtgtgccgtagaccagcagcaccctatgcagctggggcagccttattttagtctgtccaattttaaagcttctggcatttggttgtcttgcttccttgttttttctggggaagccagcagcagacaggtcaagaaggcaattttgccatcaaacagaactaggttcaaattcaggcaccaccactttagaagccagggaaacttgggcaagagtcttcatttctctgagctgcatttcttctgtataatggagatgataattctgcctcgtggattcttctgaactgctgccatcatccgactagcatattttaatccagcaacgtttttctttcttggagcattggccacgtgcccacacaggaagaaagcagacacagttgctgtctacaagggggcaatgggcttactatctacttaacataagacttgaaaacagattaccacaacatgacaatgtaagttctatcatggaaaagggttccaccaaaatgttatagtggtcttggagggagaataaggggcagcttcatgaggaatataaaaacacagagccctgagctgacagacacacacttcacatgtaataggcaaatggtttcattcacagaattgtttcatttctgtggagggaaagctagcataggaaaaaaaccttcaactggttggtgttacgcaaattatgatggatgaaaacaaaattcttgaacctgtcatgggtctgtggagagacgtaatactgggagctgcagagggctcggaataagtcaaagctcgaggggctagagggtgtctggacggcttacatcataaacacatgctgtgagaatgagaaggcgtccctgaggacggccaggaggaaggctcaaggcatgagtgctggcgatgttgatgccatcaagacgatgagtcccgccgagcagccttccacagtgggtttaggaaatggcagccttgggagctggcccctgccaaaacgtaagccgaggaagatgagaggggcctggctgacagccctccggccatccagatctaggggcggtggagagagcctgggaagagcgagactccaagtccgagtcccgctgtgagtggtgtccagtaacctggctccaagtcccttcctctgcgagcaggcagggccgacttctgtttgggatgtcccattctttgcctcccttgggccccctcctatgagtacagatgctgtcaccgtgggcagagatggctggccacaccaccctccagtcatgccccctctgtgctcattctcatcacccagcccaggggcttgacctctgcctctgggggatagcagagcactgggcccttcttatcttccgtgtgcctccccagcaattttctatgcatctctaaattacacccctacggccagtgccacttcctaactcgcctcaggacccactgtttgacttcacctccaacggccacgagcaaaatagtgtcatcgggtgccaacagcaaccctctttcttcccaccctcagcaatgtgggggcctttccgacagagcagcagcgagggtcccccacaaccctgggacagctgtgctgaccttcctatcagggccaccttgtagagacatcttgattaagtgctcctgttgtgtgtcctaccgaggatctgttttgtttttagtctgtgcacaggctcatttggcccatgcttgtgggccagaactgcttgttgacacagagcaaagagtgaatcctgccaggctgccgaggcctcggctgtcccagggcacgtgtgataaagctgagagcaaggaggtactctgagagctctggtttgcagaaagagagaaaagacaggatagatgaagagtagccaaaactccgtagaactggggggagttactgagcagacaggatggcatcacagagtgtgccatggtggggtaggagggcggccaacagggacagaggagggtcctctgccagggagagaaacagagggaatttgggggaaaccagttgcagacatgggctgagaagaccctgacctgccatgaatatgggcctatcaagtgagcaggtgttcgttctttttgcactgctacaaaggaatacctgaggttgggtaatttataaagaaaagaggtttattgggctcatggttctgcaggctgtacaagaagtatggtgccagcatctgtttctggggaggcctcaggaagcttccactcatggcataaggcaaaggggagccagtgtgtcacatggcaggatggggagcaagagggtgacagggaggttccagtagctttaataaccagatatcctgtgagctcattactgcagggagggcaccaagccacgagggacccactgcatgacccagacaccccccactaggccccacttccaacacagaggatctcatttcacatgagatttggaggagacagacatccagaccatatcagtagtgtgaacaatgtgaggcacagtggggtgcagtgaccacctaggcctgcagctcccagcggccagccaggttgagcatctgcatcctttaaactgtccaccagccctttccacgacaccgtgcttcctacttgctggggcagtgcagacagattgctactgatgtcatcgaatcccagggctgctggaaggcatgcctgcatgtcacttctttcaaggcacttacgttttatgcctcccgatctcctctgccttagctggacctggaaggacagtgcactatctctagacctgggcttatgcatctttgaaaatgcctttaaggttcccttagctcctgagggttcagcttctgcccagccagtcacgatccttccccctggcctcctctctggttgctggtgcagtttgattgtgcctttgatagatggccagggctcaccctcctccctccacttcctaacgacggggagaggctgacggctgaggtagttcctagaggactgtgactcttcactctttcttccgtgttgtatcccgactttagatgatgctgttctagacagtacagggaaagtgatagaacctagaatctgtccgtctccctcttcatgggccacctgagtaagtgggtgtgcacggttctttaccgagcttcagtttgggattgcctagggatctcctttgcctggctttatttctctcttgttaagaaaaagtcagagtttgctgcccaaaaaagttcctagagttattattggttaggttgaaattaaccaataatcattgtatctggttcatttacttcctttatgatgttgctcatttaagactttactcatcctctgcgtatttttaaggaaggatctgaaaaatgataagaggttagtattttgttattttatatttttagtaaatgtgacattctagttgagactaaatatgtacagacatggaacagagttaaaagtgtttatgagtgggaaatagatggaaataaataataaagacttatagcttgtgatttgttcagtatcacttagcaacatcaatatttttgtctacaaataaaggtctcctgtttggtacatgttgaaaatatttgtatgcttgcgtgtttgtgaccttgtgtacacatcatctccagcagaaggatcattttggttgtggctgggtttacagtacttaatttgggtgtctagacactggttatagtgacagaaaaacgtctgaagatgtgagacgagattttgaagaatggtgttcttaaaatatgtctgtaaaccgcctcttaacacagaaataaattaaattacagagttagaaaaatcctaaattaaaaggatgtgtttcttctaagataattatttgcgtgatttgaaatcactttttccttatcagaaggtgaaacatgatgttccctgagctgtgccgagaacagggagtgattcccattaatagctgtggaacttaattaatctttagttttctgacacctttattttctagttctttcctgatgcgggcttcctggctaacctccatttctactgctgataaccgcgtctgtccttcgcatggaaacattcgccttgccctggcaccctatgttgtgctgtgtgttttctacatgttcccccctttactgttcatacatgaagcaatctggattggccttgcgagcgtgtctatgacctaggagagtaatgtcaaccaactgccccttttgtcaggtggaaccgatttccctgaaattctcatctgtgcagttaattagtgagtgacctccccatccaaggctctctgagtgtctctgtgtagcccatttttaactctcagtatgttttatttcttctaattattctagtcacatagcatttaatcacatgatcccacttttgtctgctttgtgtttgaatagataatggaatgatcgtactttctctgcttccctggttcctgatacacagtaggcactctgcaaatagttattgagccaacagatcaaggaatacttcataagaagtacaagcattaaaaatgtttttatattcaccttgtttgctaaagttcagttgtttcaactaaaaatataattttcaatataaaaatattttaagttatggccaaagtccaaagttagcccatagcaatgtatgaaactcagaaggtaactgactagttgtttttacgtgtttttctaggtgtcaagggagtcaaatgaaacaaactagttgtatattttggtagtgctattttaagcatttaccttaaaatgtagctttaaatggagccttttctgttaatattttttttcacctttatgtagtcaggtctcatgtgtaagggttgtgtgttgcatgtgtagacggcatcagcatctacccctggctctccgtatgaatacctacacacctaagactcggggtccaaagacattctcaaacagatcttcacaattttttgctacaataacctattgccctttaataatattttatttagggaatactaatattcaggaacattatagcagaaattattttaatacctttgaccattaaaaataagattttagtgatatttccactctcacgttttcaaatggtaatctgtaatttatgtagacactctgccctcaaagagggagcctaaccctggctcctgacatgcggactgtgcattgtgatgcccttccacatgtacagcatgaaaggaggaaagagcagctgtatggtagagaaacctgacaaacactccaggtgatcacgccaacactgacgttggcgttacagtgctataatgtgccggaagtgacactctaccctgtggccctcctctcccaaacccttaaagttagtctaatcatgagcgaaaacagcagacaaatcccagtcaaggagaattctgcaaaatacctgattgttattcctcaaacttgtcaagatcatcaaaaacagagtcaaagacactgtcacagccaagaggagcctaaggagacacagtgactaaaggtgatgagacatcctgggtgggatcctgggacggaaaagggacattaggtgaaaacgcagaaaatagaaataaactatagactttagttaactttttaaaaagataatcagcaagaggaaagaatgtcattcagtggaaccatttaacctcagcactatctttctgcagtagttggggatacattttaagtctgattgcaaataacacagaagtaaaatgagtcacagcctaccttctccctccttcccctcatctcttactcttctttttctctttgtagaaatgattcagctggtttacttttgattaaagagcttatgttctcttacctatggaattcaatattagataaattgttgattttcagatcactgttttcattgtaaaatgggctagaaaatgcaaactataagtgtctattatttgttatttagccctataaggcatatagcagttgctaccctagggtgcaaagcaatgtgatcagttggtttttgagttgaaaaattacatggtctatctcattaagtaaagccaggtgtgtctcagagaaactcactgtaattagtcaaagacacagaactgcagatggaaagaagtttataaagtatataataattaaggtatagatgaggaataattgggacttcttggattattacttagagcttgtttgggagttgtattattttctaagaaggcgggaaagcagtttttgtgtgtgaattattcttaccttatttttaatagcttcattggtgtcttccttgcagcttattatagagagaatgtgaatctgtggtaagcattagatttattctccatctagcatgacccagatggtagttttggaatgcattcctgcccaaactactcggagtcactgagatttatgatttgtgaactcataaattggataaataaaactcatcttctacagcttcagtgtatgttattttctagagttcatcgtgtctggaaacttgatttcagttaagctatgtattaagtacttggaatttctgagtctattgcattgttgtttctaggagagtggggaactttttttggtgaacagagcttaccttcttgtgactggtcattgtcatttctacatgttatcaggaggccctagggccttgctggaacaagtacttctgagttgacagaaattggattgctataaactctgctttcaagagccttaccatccagtgaagacacatgattacctgcagtatatctaagtctctttaattgtgtgaaattcatgggtgaggtttaaggtgggtgcacagggagagtgaggcttggtgcttggctatgcccgaatccagagaggcttttataaagaaaaatcatgagcccagatcaaataaccacatagaccaaggagagagaaataacttctgccttagagaacaaggaaagcttcacagaacagggagtacttaagcctggtcttttgaggatgatgtatttgagggaaagggagtgtccatgggtaaacaaagacttgctaatgggatacacgggaatatgtttggaaaaggccatgatggggagtggttgtcactggttgtccttgtccttgtgcatcatatcaagggtatgtagtttcaacgtgatttataactgctgatggtgaccttgatcacctgactgaggtgtattaggtttcctcactgtcaagttgctcttttcccccgtctaaagagaaccaccctttaaagggtgattaatgctttataaagggtgattaatagatattagcaatgcatggtgatgaaaaccaagcttggacgttacagcactttcatctggcttaaggagataataagcacggccaggctcagtggcacacacctgtaatcccaacactttgggatgccaaggcaggaggatcacttgagcccaggagtttgagaccagcctagccaacaccgcaaaccctatctttacaaaattaaaaaaaaaaaattagtcaggcatcatggcacatgcccatagtcctagctgcccaggaggctgagccaggaggatcacttgagcccaggagttcaagcttacagtgagctatgatcacaacactgtgctccagcctgggtgacagagtgagatcctgtctcaaaagaaaataataagcaaaaaactagactttgtcttcactttgaacatgatcctaacctaaacttgaccttctcaaacactagtgcctaaggatggtttctttagacaaagccttttttttttgagattgagtctcgctctttcgcccaagctggggcgcagtgatgcggtcttggctcactgcaagctccgcctcccaggttcacgccattctcctgcctcagcctcccaagtagctgggactacaggcatgcgctaccacacccggctaattttttatatttttagtagagatggggtttcaccgtgttagccagaatggtctcgatctcctgacctcatgatctgcctaccttggcctcccaaagtactgtgattacaggcgtgagccaccacagccggcctagacaaagctttttatagggagacgagaaattgttaagaagtgagctaagaattgtaaaacacttagtatgtggcattgtaatatatgtgttattgtctgttgttaccatcatgatcatcaccatcatcacgtgcattgagtagctgaagaacctcgataccagacaccagtatgtccaaattcttgatgcccaatctcattattttcactttgaatttgaattagaagtaagttgttaaacaggaacaaaatctaatcattttttcaaggtacaaaaaaattccacatattgaaatataatgaatggttttgcaaactttgattggcactttaaaaggtgttggagtagggcgctctgggaaactgcctattgattgcactgttgtcagtttctaagcaaccattgccaaatttatcttcatgtcacacaacttgtgtgtttatccaagctggttgaaattcttacccttgtgcaaaaatagaccagggtgaatattgagtgggactgtatcggaggagtgggctgcattcctccatagttcccagtaggtgtcactctggcagaagaaaacaagacatgatgggttctgaagacacatccctggggatccgcccaggccacaggggcatgcagaagcaccacttgcctacctcagttcccctattcgtacccgacttctctggccagcaggggcaggttgcccaggccacgtggtgaagagcattcctggaaaacattgttctagacccacctggctacagacatcccagcttactcataaagcattaaagcagtaatagaggaagagctatatctatgtagctgtaacccgaagaattggcagcacttgctgggatatgggtagcaaatttttattcctagtaggatcggcacatgtatggctcagtcgtaaatgtttatcagctagctgaacgagtcccacgaggacttcatgtgtttctgggtaatcttccataggagttactgtttactcagaaatgcaaaataattttgctattagccagtgtaactaagaaaaattttaaaaagtatgaaaaatataaaacagtaagaaaaatataaaatatgaacacccaaagagaacctctgccaccattgctttctgttaataggtgatcaacagtaagcattacataaccttgaattctcccacccagccctccccctgcccctctacaagagcaagtcatcagggggccaccctgtgcactagggcaatcacagaagtgggaagcacaccagctccccagctaatgcgactcgcaggcactgaagtactgttactgtcactagacgtgccaccggcagcaccccagaatgtagtaccccactggctgcaagaccagcattagataaaagtaagcagggagtctcgatggatcaccactgatctttggtatctgtaaaggtgtcactgtctctttaaggaaagagggagtccctactttcatttttcctcaataaataatttttgactgattagtgacaaagggacactttagtgggtgatcagcacagcatctgcatggctgcttccttgtggggtttctgaagctgcttctgtgactcagcccctcaccaacaaacaaacaaatgagataaatcccagagacctggaagagggaaactgccttgaaatggcattcatggaaaaggtctggacacttcagccaagttatttgtataatttgttagttacatataaggcccaatatgctaaaaaatgcaacaggattattagtctctatttgtctagaattgaaatttctaagtaggtgtgtgaatttatatgggtatgtatcatatatatgtgtatgtatgtacatatacacatgtacacatatatatgacaaatagcttacatgtatatatacatatagaaatgcaagtatatctgtgtacatatgtatgtatgtacattttatatatgtatatatatacatgtaagctatttgttatttcttctgtctagagaccaacatcacactccctgagagtcagaaaactgggttcagacagcagctctgcaaatgacttttccaggacattcgctaaatcactgcccctctcctggactcagttgcccatggaggagttggcgggagatctctgatgcctcttccagttcaaagacagcacagctggtacagcctctgcttgtatccagacagcactttgctgccccgaccaagaggtgcctatcttcaaaccaatatgttggtctgccgttgcataatcaacagggttgggcgttactacctagcaacaaggagtccctaatccagggcctttgctctgatagcttttgagtattatatgggtactttttagcttttggattaattggtagcagaaaaagtggaactctagttcctgtcatgcttttatttttttctttttttgatttacattgttcagagcaaatatagaaaccatggaattattttcagggaattgaagccctagagggtgtccccctgcttttgggtctgttggcctgagccaaccccatcctcaaaacaccccaggtgagactgctgaaggacgaatgtgcacagcccatgtcacaaggagtctgtccggctgctcaccttttctctgacttctgagcaggtgtttggaagctgtaggtaatggcccaatctcagagcccaaggggattcgggtctttcccctgcagactgtgctgctgtccttggttggtccttgaagggacctgcatcgtacctgaggctctgtgccagtggggatgacgggggctgatgtctcttcccatgggctcctatggatttgcccttcagatgacctggtagggctctgagtgactgacttaaagaccttcgtaacgccaaagtggcaagattttggagacagatttgtgtctcctcatccatgatttttgactttaatcttttctgagaagaccagaaatcagagagtttgtcttctcagcctctctgtgcaaggatctgctgagctcaagcttcccttttcagcgtcagctttttaagttgagaataataattaaagaaaactccaatctcaattccaacatcaagtgtccatgaagctgtagttgttgctgtggctgagaagaaagtagagaacagagtgccgacctgcggttgaaatgactcttggaagggcttgcaggtgacctgggagctagcaggtgcctaacactgtggctctcttggcacaaaacaacttcaagcctgtgtgaaataaaggaaaaccaggagcctcgttctgatttttatggagacacatctgtgtgaccttaggaaggtctcccaagagctctgggtttgtttcttcccctgtgaattggcttatgattgtgtcacttggccttacaggtatgtaaagctccccagttaccagatcttactgtctcagggaacatcctgcagatattcagggccccacactggagctattcttcaggttccacgtttgaaaggttgaaaggcgttaagagcgtgacatgaaatgagtgggtgaatttatttttaggaaacaatatataggtaattagttttggaaatgggcttccgttaacttatcaccccttactcttttctggggcatcatccagttatttttcctcagtcatagaatttggggcttttgaaaatgtctctatgagaaatagacacacaccttgcaactccttaagatcttgcccttgtaattaaatttttgagcaccatttttatataggagtaaatgagataattaagagatatttcaagaaagagaagtatatgagaaaataaatggtttctgctgcgtgattaaacactgcagctgagaccttgatgagcagtcatttgttggaagtgtacttcatcatcgggagtggtgtcctgattatcgttcaagaaacatgttgggagaaggcaaagacggacgtgatgacacctgtgcaaagacggacgtgatgacatgtatgccgaagcgtgtcttgactcagtgtaggattgataccaacatctcttggatgttgtgggatatggagcattaaaatatacaataatttatgctagtggtgcagtgtaatgaggacttgctgtgaatctcaaatcgatttcggagaagctgaacctaatgttttcctgattgtcaaaccctccagtaatgattataaataaccactgttttctttatattagagaaaacctaaaagaaaaaccaaacatgttcaacaatgagcaacagtacaaaagaaaaagtacaaagtctagcatatccaataacaattattagctaattaattttactcgaccacctggtgttggaggcatccctctcctctctggcatggtagagtgagaacttcctggtcctatagatccaggcccaaatcgtggtcctgactcagtgtttttaagataatgtgtccttggacaagttgcttgatgtttctgagtttccatttcctcatctgtgaaaggtgatcatcacacctgcttttataggtagatgtggcttgctgtgagggtaaatgacagtgcagctgtgtttggtagagggactgtcatggaatcaccatccttgatcccggtgacccagactggccaccttgaggctttgaaactctcagccagctctgccaacctacatcagtgagacctcagcctgcctcgtttctccactcccttaactaggtccattactttgaaatttgttatcaatgaatttgtttacattttttaaattttaatatatttaattgacaaagattgtctctatcctgtgtatacaatgtgattatttgatacatgtatatacattgtggactgatgatgacagtcaggctcacatgttcaccacccacgcggtccgtcagagcctcagaacttgttcatcttataactgaaagttcgtaccctttgactaacatctccccatcgtccctaatggcccagcccctggaaacccccattctaccctctgcttccgtgagttccacttttttagatgcaacatgtgagatttaaaaaaatatccagtgaaggctgtcgatgggacattgatgaacctgggggctatgtgagctctgggctggcgcctacccctcccacccaaggaatctctgcttcccgggctgtgccctcctgtgtgatctgaagtagggaagtggtatactaacttttggaaacattcagctgccaagtttcctctgctgcaggctttaaatagatccaactgagaaaggaaggtagagcttgaaccaactgccaccctctatatagagacggttgtcgcctggtctagtgtaacaaatagagttctttgttagaagaggaaagaaacttaacccctcatttcccatttctgatgatttagggacagacctgatggtctaccaaagatacacctgaagctttactatttcttgtcactctatattttttagtaaaacttatttttatctttggagatgacaggcatctttgttttagggataactaatgatgcctgtagagaacatgagcatgttcacaacccccaattaatctttaacccagaatccatagagcgttttttaggctgacagttagacccagtttaattgtggatggatggtaggattccagacacttcagatgaaaatccatccagccatgcctgtggatgccccttggaaggaggttggagcttgggccactgagaaggtggatattgcatgtcctgactccccagatctgtttacacaacagcgattttccggatagagtagcacaaggaaggaagtgaaagggggatagtcttcatttgcggagggtgagtctagggagcagaatggacatgttctgcagctttgccatgtgactcctttcagcacaacagaaaacatacagggcacagagcttccttactgaatgcctcaatggtcacgacattagtgcgtcagcaggactggaggatggcagctaggagtgctgataaacgggaggctccgtccttctcatacatcaataaacacttaagtgcctggcaaatgcctggccccacgggagatgtagaagccacaagaccgacccctgttctcaaggatctttaaacagatggcctctaaaggcccctcagtgattcttgagctatggtttaaacccccacagctaggttagagctgggccattttctttttaaaaaattatttttattttgctattatttacattttttaagagagtctctctctctctctcacctaaactggagtgtgatggtgtaattatagctcactgcagcctcaacctcctgagctcaagtggtcctcccaacccagcctcccaaagagctgggaccacaggtatgcaccaccacacctggataattgtggtttttttgtaaagatgggggtctcactttgttgcccaggctagtcttgaactcctggcctcccaaattgttggtattataggcgtgagttgacaggctccggcataggccattttcaaactcccagattctctcccttttgatgctttttgctgataattatagaaattttactttcctttttccctcctaaatggagcagtattctggtttggaggatggctgctattcaagtagtccttgtcagaagcaagcctatgttgttgtatctaaaggtaaattgcacatctctggcaattttccttgccaacgcgtatactgaagccatcccccagcgctcgcctttgccaggtggccaggcctcagggtggggcttgcttgtctttcccctctgctaagacctgcatacttagtgctctgagaacctttcctcgcctcacctgctctccttggtttttctgtttttgagaatggaaaaagttcatttttgtgttcccattttctaaaaaaaaaaaaaaaaaaaaaaaaaactcacaaaaaagcccaagcctttgtggggtctgagtcgtggcgagtgcggcaggtgagggtgcgcagacccacgaccccgcctctgcgctgccgcccccccttcctcctggcggggccgtgagtctggaaaccatttcccttcattgccttggcagtgctccagccctcccgtgatgatttccctgtggctggtcgggggtcattcaagtccaggtgtgccttgctctttaggcatgatttagattggaatctcctgccttctctgaagaacaagtgctttctgtccatacctcctgcctccccaaagaaaagaaaaaaacagacattaaaagtgaggctcagccagcaggaatttatagtcagagttgccccatgcatgtcaattatgcttaccttacaattttagaacacggagtatgtatttcaccctgtatgcccttgtctggaaaataaaggtaattaaatctcatgccgtcatgatttgaacccaaagcagcaatgtaaaacaaagccatacaccaaacaactaggttttctaggattatatctccccataaaacatcaagtatcctcagaggggttttgtaaaatcataatacattggcttttaggtcgaccagttgtccacagtagagggttggccaggggtgtccaggagtgggatgaaggccacagctgaagagaccatcttccctgatcccagacagcccctgtgacgggcctttgtgctgtgagggcctgaaccacagaagcgaacagccgttgccagcgccaagctgggccagggcccggccgtgctggcctgcgagcagcccgggcagacctccaggcagcaggacaaaggggcgctgcggtcctcagccacacagccagggtggcggggataacagccccttgtcatcgcagggttgtgacattggcatgagccgccctcacagctggaccgtcctggcgcttgtcttgggctgtggaacgagccagcccagctgtactgaaatgcccattcttttctcctttctcgtgcccctgtcaacaagcagacagacaaaagggttctattgtggctcatgccgtgagcataacctttctctgccatgggaaggagatgggtgtgctcaatggtggcagagctctgtacctgcacctcactttgtgtgtggaggggaattgggatttgtgttttgtagcctctaggacagagctcctccatgcttgcggggtcgcacattttggacggggccttaaggagtttgtgttgatattcaaaggaagaattccatcagcgttgatcaaacgtggctctgaagactgtgacgatgatgtcccatgtggcattaaacacaagccgagctgctgctccaaggcacgccattcgtccattcgttcagtccaacaagcctgggccatgaattttctctgggacccgcatcatctcatagtggggacacagaaatgctccctcccagcccctgctcctggggctgtggtgtctggtagagagggcaggtgtctaacatggttacagttacatccgcttggtgggacttgatgacaagactaacgggcagccagtgagacccccgtcagtgctggggagatagtaggggaaagggcactgagccaggacagtaagctatcccttggctcctgttcctgtctctggaaggtcagtctgtcctggaggagaagccaacacccatctctgttcagcacaacgggcatgagttttcttatattttcaataaagagcatgccttagacttttttttttttttttgagacagagtctcgctctgttgccaggctggagtgcagtggcgcaatcttagctcattgcaacctccacctcctgggttcaagtgattctcctgcctcagcctctcgagtagctgggactacaggcgcctgccaccacgcccggctgatctttgtatttttagtagagacggggtttcaccatgttggccaagatggtctcgatctcttgacctcatgatccacccgccttggcctcccaaagcggtgggattacaggcacgagacgctgcgcccagccaagagtatgccttatattaaatgacagcaggtgtctcttggcccagtggaaataattgatgtggtgctatactatggctttatgtctttatccttgacacatgggttctccccacagtcccccaaaaagagaggatttaaatatgtataggtttacttacaaacatctgcccaaagggtattagagtagcatggaaagtggaaaatcatttagacttgttgaacttctgctttgtgctgaatactgtgctagaaattcaatggactcagtgtccctgtgaggagagggtcctgctgagctgatggggaagcgaagcccagcctggtgcagcctggcctggagtcacacagcgtgtgtgaaagagcctagaaccaagccgcgcctggcccaggggggaagcagccctgccagtgcacgcagacttgttcccgtgtcactgacctcatcctcatcgtgggttgctctggtttgccttggtcaatattaatcatttccccctgcctcccagcttcactagtttaactatgacgtgcatgtgcttttgtgggtaccctaagagtccaggggcgctgctaagaaagacaaatacacacacgtagggaagaaacacaagtaccttgcgtcttcctaatctaacagtgtctggattgcttcagattcctggagtagctggactgaaggcagagatgaggggcttgttgacctgggagctctttatagctaatgctgctcggcttcagttcctgaggcctgccgccgtagggcctgcctgcaaacgcactgtcaccaccccccgccgctgcagccccccaggagttacgcttttgcagaagacccagctgcctaagtaaaattaaacaccctcaagctgtttgaggctcttaaaaacattttctcagcactgaacttctctgaagatctgagactattagcacaaaaccaagagttctctctaaactgcttttctctttcccctgaatgcaaatgaacttcccctgctggtttccattcatctgacaggtcataattgtgacgttggtaaaatagagaaagttcccttttgaaaattgagctatgagaactttttttgttaaaaaaaaaaaaaaatagaatatttgcttattttaaaaatagagtgacacagtgataatggtgtcatcatttaaactctaccctataaactctagtttggacatgtcttggcttattggaaataatgaaagtattaacgctgtggattttttgttatagtgggtgtcactgttaggaattgtgagtcacagacatctggtcatcgtgccttcaacccacaagcagttattgcctcacattagaaacaagtttggccgggcactgtggctcacacctgtaatcccagcactttgggaggccgaggaggttgggggtggggggatcacctgaggtcaggagttcgagaccagcctagccaacatggcgaaacctgtctctactaaaaacacaaatattagacaggtgtggtgatgtgtgcctgcagtcccagctactcaggaggctgaggcaggagaatcacttgaacctgggaggtggaggttgcagtgagccaagatcatgccactgcactccagcctgggtgacagagtgagactccgtttacaaaaaaaaaaaaaagaaagaaacaagtttgcagaaggcagcatggggctggtataggggccccactaagtcctcgaggatccaggttatctctttcggccccactctcccagcacttagtgtccagctctgaggttgtttcatggtctagaatggctgctggaactccagccaggacactcacactgcagtctggaccatggaagaagaactgaagtccaaaatgatacatgcctccttcctttaaagacccttcccagaagtcccacacaccgcttctgccactgtctcctggccagaacctcaccgtaaggccacaccagctgcaggaggaactggacaaggttccagtcttgctaaggaagaaagggaaggcagaataaaaacgagtgcacttcacgccccacatcaggacctgtggccttcgttataatttagggtctctgtatcacagtagacagaccccgtggttagaggcctgctgagtgtaggtttcaggtcttcctgtctcttaccttatcaagttatttaaatttataacatagccaagcgtgcgtctatccaggaagtgtgttcacatctagtcagcatggtcatcttgaagggctcagggaaagaccctcataccccaccttcaccaatcccttggtcatgaaggatgttggctcctctcacctgcaccctctacccaatgtgatgtttgtaggcaccccatgaataaacattttatgaatgagttgatattagtggattacacgagcaactacatcatttgaaaaaaaaaatgattataagaagctaagagaagttgtgacactaatccaatactgagatgcttgttttagatgatgtcatactttcatagcagacactagagaagcgccctttgccctcctccccactcctggggccttccccatatgtggcctcagaaacttctttcccacgcttgggcctcccagggccgccccatcctgcaggctcaggggctcagactcagaactgaactattagctccatactagccctgcgctatctggggaataaaacactctctgtactcttgtctctatagaaaaactttttttcagttgcaggataagccaattagaaatgaattttgggcaccaaactgattcataagtcggatgttgcttatcttcactttactttaaaatgaattgcttttatgtgtctttcaaggaaaaaaatattctcaaaaaatctgtagcactaatgattagccttactttgggctaatttcccttttgatagaaacgaatgattgtaccaacaacttaaatttcccttggggctgggcacagtggctcaaacctgtaatcccagcactttgggaggccaagttgggcagatcacttgaggtcaggagttcgagaccagactgaccaacatggtgaaacccctgtctctactaaaaacacaaaatttagccaggcttggtggcaggtgccggtaatcccagctacttgggaggctgaggcaggagaatcgcttgaacccggaaggcagaggttgcagtgagccaatatcgtgccaccgcactgcagcctgggtgacaaagtgagactctgtctcaaaaaataaatacatgaaaaataaaaaataaattgcccttggaagaataagaagttatttatatttagttttttgttttaaaagtatgcatggggaagcaagacagctgatccccatcaaaattaagctgctgggcttagaaagtgttttgggggaaggggttgtattttattttgcaggtggtttttcttctttttgacaaaatcattaggcctttgaaggacatttttgatctaagcaaagcaaagataaaaggtagtgatagaaggtgacgttttcacttgctccctaacacttgtgagtcaggcaaggaagaaggacagacgtgactcgtctgggacggtctgcaccggagcatgtggggggcctggtctgtgcgcaggtcagcccttctgtgggtagtggttttctcaagatgccactacctggctcgggtctccgtgaccttgtcctgcagctcgttgcctagacaaccagcaggcgggagcccagacgccggtccacacaggcagttatcagggccagaggagtggcagagactccagcgagcactggggcatccatggcacccgaggcttccaggcgcctcctgcccattccacacaaagcagaaatctggcagctggaagcagcatggtctcagccggggacctccttaatgagatacctaatcaatggggagatgccgctgatagtcacggctcccgctgcatggaaagggcatgctcttgattttgtacctggagagggaaatgaggagtcccagttaattgggagatccagcaagagcctcactctggagcctcatagtctcctgtgccagggcgagctccaccttggtgacagaaggcgcagccctctggctgcccttttcatttcttttctctttttcgtctttttcttttccttccttccttccctttcatttatttcattttcttttctttttgtagagtcaaggtctcactctgtcacccagcctggagtgcagtggcatgatcacagatcactgcagcctcaaactcctaggctcaaataatcttcttgcctcagcttcttgagtagctgggactacaggcgcataccaccatacctggctaatttttaagtgtttttgtggagatggggtcttgctatgttgcccaggctggcctcaaactcctggcctcaagcgatcctcccgcctcagcctcctgaagtgctgggattacaggcatgagccaccacgcctggcatgccctttctaagtgtggagtttgtgaatgtgtccactttcctcacactcccatatgcctggccaggcagattctcatcaaaaattagaaaagcagatgtttccatttgcaaatgtgtaagtacgctgtctatgatcactgaagctctgactcagccactgtggtcagaagctgggagccactaagttcagcacagctgccaatcccctgtagcttccagtgcctccaagaaccttatataaagcatgtgaagttggtcacagcccgtcaccctgtttctgccatctccgtccacagcccctggatattactaagaagcaagcactcttccatgccacactactgcctctggtaaccccataagaggaagacctgggctcatccccagcagggtcagagaaaacatgttctttaagctcacgcatgatggcgttgggtagtttgcctgatacaatgcataggccagtgttgctttggattctgaaaaatgatatagagcaattattcataaactttttatttatttatttattttgagatggattctcgctctgttgcccaggctggagtgcagtggtatgatctcagctcactgcaagctccgcctcccgggttcacgtcattctcccgcctcagcctcccaagtagctgggactacaggcgcccgccactatgcctggctaattttttgtgtttttagtagagacgaggtttcaccgtgttaaccaggatggtctggatctcctgacctcgtgatccacccgcctcagcctcccaaagtgctgggattacaggcgtgagctaccgcaccgggcctataaactattattaattaatcattgttaacctaagtgaagagtgttcaggattcattctttggaccagccagcattttaactgtacagtaagtcccccccttaacattgtcaatatatgattagaaactgtaattttaaatgaaatgacatgtgacaaaatcaatcacaaaaacaaagttgaaggaaacagcgttacccgaggacttgctgtatgtcatttcgtttacagttgcagtttacatgaacctatcggcagccttaagtgagcatgtactacattgggcgtagtgaaatgggtttaagtttatagtgctttcgttgatggttttcaagtaacaaaagaaacaggcctgctgctgagccacccctggccccctttgcagccggctgtccttctgtgatcactgtgaatgtgaacgtcctcagcttccctgctccagggtcagtgatcggagtgcctgtgatgtgcttacagcctgggctgggagtggaaggaggctctggtttagcagataaagagaatcccttggcctttttactgatttttgtgtttgccttagaagatttagggatccttcagtccttgtcaagagggttcctgaatcttttatttggcttcaatgcacattgagtaagaaaccgcagaaggaaagcagggaagggaagagtcagcgggaggagaggagatttgcttctagttgtcttacaattcccatcatgcttctgagtaacattctcaattcccagagatcaccattttttagttaaattggggcttccgaattctagcaaccagcaggtgttttggaggtagcttgttgacccctctttcatccaaaagtgatcatttttacgggggttcctcacagagtaggaatttgttagcagtgcatacccgtggcaagagctgtggctaaagcacatgccctgtcccttcccgatagcagcagcgcagagggcacagagtggcgcaggcgagactgccacagacgccagtgaggccaggatgtgcttgatggctctgcatgcctgctctgtggggctggaggtgtgccctcctgtgctgtgtggatgttattagatgttggaaagctgcagtgttcatttgggaaggagttactgctctgaaaggtttgttctcctttattttattttatttttatttttattttattttatttttttgagacggagtctcgctctgttgcccaggctgaagtgcagtggcatgatcttggctcactgcagcctccgcctcccgggttgaagcgattcttttgcctcagcctcttaagtagctgggattacaggtacccaccaccacgccccactaatttttgtatttttagtagagatgaagttttgccttgtaggccagggtggtctcgaactcctggcctcaggtgttctgcccacctcggcctcccaaagtgctgggattacaggtacccatcaccacgccccactaatttttgtatttttagtagagatgaagttttgccttgtaggccaggctggtctcgaactcctggcctcaggtgatctgcccacctcggcctcccaaagtgctgggattacaggtgtgagccactggctgctctcctttaaagagaaggtttgttctccttgattctcctgtacagttttttcttaaaatttgtttagaaatctaggagcatgctgggctcacattataggtgacaggaataggctgacaaaacacacaccttgcataagccaacaagcattggactagaattcatttgctgtcagatttgggggcagtgacagtcttttggtagaattgtaatcaaaggaacaaactcagagaacaatctgggtaaagagactggtgtcaggttaagttcagatctgtagacccttctcaggtggtgaagccgagaccacagacacagatcctggagagggattagaagccagacattccgtgggtgacgcgctccttctcctgttcccatctccgcatttcctggtcaggaacctcatgaaagacagctgcattttttccaggctggtatctctcaccagagtgaggcttgtgggcttcatgcatagcgatggatacagaagccttggctgttggtgaagacactgaggtgtatggatatattgaccactgtggggaaggctctaactcttggtcgttccacttgctcactgctcttctttgatggttgagaaagtggtaggatgaccagatttgcaaaagcccatctcactattatcaaatttaatagtggatgttctgccgtctgctattattacccatggtttgcttttgtgtgtgggtattagaaagccttttagggaaaaagcagaatgtggctgggctacagctcctgaggaagccggccatggcagcactcttcccatgctgtccctgggcctaggagagcaaccgctctctgttcacagtgtgccgtccagacccctatttagatccctgtcatgtggtagttcatccacctggacatcttcctcaccatggcagcagctccttgggagcaggaactatgtcctgttcgtctttgtacccctagcacctgctatttaagaaggactccagaagcctcgatgtgcggcaggaccatggccgatgtgtctccctggcacctctgtctcagggttaactttcctcgctgcctgagagcccccggctttgacgctcatggagccctggcattgagtgtgagcacttcacactctacctctctcagttggccctccgaaatgcctcaatttaggagtggtgccccactgtggagggtattttcaggaccatcttacaaattattgtgaagtgttggaaacaaagagcttcctgcttcttttcaacctggttctaccatgttccaagctgtagccaaaaggaaaataaatcagagcttgaaactagcctttctgatgggaatatctatctgggacacccctccctttttgtctcttgcccccatacgtctcctccttacagcacaggctgtttgggaaggaggacaggatatgtcatctaactttttttccatccctagctgagtcactgattaaaaacaaatgaacaaacaaaaacctaaaaaaccttccagaaatacaaaggaaaagggtttgtttgttttttattttaatttttatttctgtaggtttttggggaacagatggtatttagttacatgagaaagttatttagtggtgatttgtgagattctggtgcacccatcacccgagcagccttcactgtacccaatatgtagtcttttatccctcacttacctcccaccctttcccctgagtccccaaagtccattgtgttattcttatgcctttgcatcctcatagcttagctcccacttgtgagtgagaacatatgatgtttggttttccattcctgagttacttcacttagaataatagtctccatccaggttgctgcaaatgccattaatttgttcttttttatggctgagtggtattccatggtgtatatataccacaatttctttatccactcattgattgatgggcatttgggctggttccatatctttgcagctgtgaattgtgctgctataaacatgcgtgtgcaagtatctttttcgtataatgacttattttcctctgggtagatacccagtagtgggattactggatcaaatggtagttctttctacttttagttctttaaagaatctccacattgttttccatagtggttgtactagtttacattcccaccagctgtgtaaacgtgttcctttttcaccgcatccacgccaacatctgttattttttgatttttggattaaggccattcttgcggagtaacgtggtattgcattgtagttttgatttgcatttcccagatcattagtgatgttgagcattttttcctatatttgttggccatttgtatatcttcttctgagaattgtctactcatgtcctcagcccagtttttgatgggattgtttgttattttttcttgctaatttgtttgagttccttgtagattatagatattagtcctttgtcagatgtatagattgtgaagattttctcccactctgtgggttgtctgtttactctgctgactgttccttttgctgtgcagaagtttttatgaagcaagtctttggggaggatattttgtctcataaaagttattacaaacatcaagaaagtggattccagccgggcgcagtggctcacgcctgtaatcccagcactttgggaggccaagacgggtggatcacgaggtcaggagatccagaccatcctgggtaacacggggaaacctgtctctactaaaaatacaaaaaattagctgggcatggtggcgggcgcctgtagtcccagctacttgggaggctgaggcaggagaatagcgtgaacctgggaggtggagcttgcagtgagccgagattgtgccactgcactccagcctgggggacagagcgagactctgtctcaaaaaaaaaaaaaaaaaaagaaagaaagaaagaaagaaagtggattcctcttccagtttcttgcctagcttaaagccatgtaattcttgccagctcacattgtgacttttctggctttcaacactttgattgggatttaccatttaattaaataagcttaggagctggagggtgggtgctgtccggggtcagttcagtcaacccctggttctctttgcacttcacagaatgtggattgtctctctgttcatgggctctgctgggctctctgagctcagaaccttcagatttgttgggtgggaccacagatagtcatggtaagtgcagtcatccttcccagctgtagcagggggatgtccggaggctgtggaaggtagagtgttaggatagagatggcgacagtgtggccatctcaggagggcctggggtgcccatgagctccgctcagagaaactgccagctgagcagacgggaggacctggctttgaaagaagttacaacattaagcaaaacaacatgtcgttgtctgtggaaaggaatccttagcataagtttttgaaaatatgatcaggtgtcttgacccaacacttaaaaagtgaagtccacagggtttaatttcctggtgatatttttgtttttatttgcggtttagcatttttttttttaagtatccgaatttgcatgaggctagttttgtatttctgcaagtttcagtccatgtgatttgaagcagatgtcatagtcacacaaacagagtccataatgggaaagtcaactcctgggcatgctgttccatgcctacatggactggaaagaaatttgattactttgggaaattaggctaatatttcaggggttgtgtaatggacaacaaaggacatgttcagcagcttttgagaactgagagaatggaggattgaggaccctgcagcggcagtcctgagtctccaagcgcggctgtgttgagatgggtttgctggctgctggggaacatgcctttgctcagccgaggacagctttttactgtggtgatgttagaaatgtgggcagagtgagttatgactcagtctattgtaattagaaaaaagagcaaccactgagaaaagtcctcagagaaaacttaagaaatggggatgttcttattctcagaaaactaaaacgggaagtcattcttggtgatagtgaggggaaacgcaaaagcgaagggagaggggagctctgtgtgcggcgtctctagcattgcacagtcctctttaatgaataaatggaaccttaataaggaaaagtaccggctacattatcggttgcaaattgatttgctgtaggcaaattctaatgtagtttggccatgtgaggcgtacctcttaagaaaacaaaatcaggttgcctgaaaatggactcttgctttccaggtgaaaaaggcactggaaacaccacacagctttgtcctgtaatgtttccttactctggaatcatgaatgggcttttctcgtgctatatctaaaactcagctctgattattatgtttaaaaagaggctgtgcttactttccacacccaaatgaggctgagagtggctgtgaggaagggaggtcagtgcctcctacttctttttggtggggcaagcaggggagggagaatccatctctaaaaaccagtggttcttaacctttgagaatctgaagcaggccaaagactttcatcccaaagcaatgcaaatataccaagtctcatgtgtagttacggggtttgcagacccctgaagctcatccgtgggtctcagctaaaagcacctgctacaaactcagtaagtgctttttccccattaaataattggtggcatcatctgtctgatgaattaccaccttactactttattttctaattttaactgttatttatattcccctggaacaccttgaaattttccctaaaactagattgactaatctgggtccctccttgtctcaggagatggggatggtctcccacttccacctgtgccctccctggccagcacatcatcattgtcatcggaaccaccttctttgtaactgtcctcctccaagcagtgtttgccaagcatggtgctaggtgccagagaataagctagaggacaggaaagaagaaacacatagaagtattaaccttcagcggaagaaggcgtgcccacctgggagaagtgacagtggcgatcttatagagcctgtggcatgccctgcagatcgtgcacacagctgaataagatgctggtgctggcttcttagcgaaccataatatatttagcttggagcaacttttgttttttgctaggatgaaaaacaacctgaaactcaggatacatacaagagatcaaaataaaaaccatgaaagtacagtgacccatttaaaagttgtccgggtcttttttttttttttttttttttttttttgtcagagatcatggtagaccacaaatcgctgagttaataatataatgctatttggccgggcgcagtggctcacgcctataatcccagcactttgagaggctgaggtgggcagatcacgaggtcaggagatcgagaccatcctgactaacacggtgaaaccccgtctctactaaaaatacaaaaaattagtcagacgtgatggcacgtgcctgtagtcccagctactctggaggctgaggcaggagaattgcttgaagctgggaggcggagcttgcagtgagccgagatcgcaccactgtactccagcctgggtggcagagcaagactccatctcaaaaaataaaaataaaaaaaatataatgctatttgtttaaaatgatagtgctgatttatgaatgtgggaaatatctaaaaatatctacaaaagaagtgattattgaattacagtcatttgtttatatgtagttattatcaaataatgatcaagttgtcagtctctgatttttatatgtagtcatctgtgacacatggaaaatgtgtaagtgggcctgtccctttttactaggaagtgacttcctcctaccttctgagccaaagctctccagtctccacttagccaggggatctctttcttcatggatgaccagtaaggggagagaattccttatccccatgtagtagctgaagggcattatcttggctggtgattggcatggatgggaaaggccaatgtagttaaagtcttcctgggatcatagtgaatttcaggtttcaactggtggagacatatcactggacttagcttcccaggcaaagtcaccaaagattctatgtaaatagcattgaaatgccacctttgcctatcacaagaatgtatgcattaaagagactgttgcaagttatcctggacaccaccctgccatttgcggtattctttttcctgtggaaaaactagtgcccagttctgagtagccgacttctatctgaacttttgaaacgcagtctgtcatgcgttgtctgggggccatagacttgcccctctacagtgtcccttctcagcagggctgctgtccgatgctgtgagagccagggcccctgagtctcccttctagggcccctagtcacactgccttccttccttcctctagttcactgcatgtcagccataaatgagtctgcattattaacgtgatgcttttctcatggtctgtgctcatcaatttctcatttccactgacacttctcctcaggatgactttcagggctccaggctgctcttcttgctcccacttcctgtgttttattctgtgcctcgtgcatactgtgcacactccctgctcaaagccttcagtggcttttccctgaacaggacaggatgaagcaccagctcctggccttccctgctgctctggagaggctgcctgggtctaggcacagctgtggtcaccccaccttggcttgtgaccccaccttggctttcttggcttgtgaccttttcgtcatctcaaatcctttggcttttctgaatcactccctgggctctctgtgcctgtcaggtggcagcactgtctctgcagccagaggatgggccccagagggccagggatgcatcaggctgcttggttctcctgatgcttgatgagtgtcggctgctgctgggaggatgttcttgggatcagtttgaatggcaatgagaacgtcccacctcagccatctgcaggactctgctggaatgtgcaggcgatggcacggtggccactgctgacagaggcacagggtggccatcctggtccccagacttctcgggggactggccagcagtcacttcctttcccaggtgacttggccgtgcccttgtccagaggcagggctccagacttcttaatagccacaggtctaggaatctgcattttcctggcttatgaaactgtcaagctgtctttgaactacggctccctttctaatcaagcctctggcaaagagaaaagcagcatcgcttaactattagaagcttgcccttttaaaaataacctcttcagcgtctggttttgcaattgaataattgccaggttgctggttggtggatacctggtttgtgttctgtatacaggttgagtgtcctgtatccaaaatgcttgggaccagaagtgttttggattttgcatcttttgcagattttggaatatttgcatatacagaatgagatatctcggggatggggcccaagcctgaacacaaaatttatttatgtttcatatatatgttatacacatggcctgaaggtaattttatgcagtgcgtaataattttgtgcatgaaacaaagcttgagctgcattttgatgtgactggctcaggaggtcagtggtggactattccacttgttgtgtcatgtcggctctcaaaaagttcgggactttagagcatctcagatgttagattttcagattaggtatgctcaacccctaatacatttctgctagttgtttttttcttatcctgcagtctatgtacaggcctgtctctcattttctgtctctactgaactgtctggagacagtctagcatattcaaacagccgagctgctgcattctgttttccctgggtagaatctcctaagttctttggagccttctttctgggaacatgaaaaagggactcatgcagttataaaaagaaactagagatcatccagctataaaattgcatcttagcattagcttctgttttgtctaccattcattttctattcatccttgtctaaagtttgtccagcaatttgaacctggtaattttagttctgtggtttctattggctcctagacccttaccagtggttaaaaatacaaattgcaagcctgtcttggtgggcatgtatacagacaaagctgaggactttctgcactgctggatctgagaatcctgagctgagcagccatgcttaccagcaccttgtgcgtatggatgcatgagcttgtgtgtgtgtgtgcactgtacactcatgtgcagagctatgcacacacgtatgtgtgtgcatgtatgttcatgtgtgcatgtgtgtggtaaggggtggcagggactggactgcagcatttgacggtccacccccgcccatccgttacaaacatgcatgtatctttctgtgatttattccacactgaggggctgtgaaaggagcatggccttgggggcattataaatccagattggagtcagcccctagctctcatgcatctgtaatcaagtgacattaccccacccagcatcaatattttctactaaaatgggcatagtgatttatgccaaaaatgagggaaaaaacaaaaaaacctaaagcagtcggcacagggcctgacacagaagcactcagcaatggccagttttctttgcctttgaatggcctaaaagggcaagaggtgactggggagtgaaggagaaagatgaatgtgtatatcagttctgtgtgcactgtgctggaccataagtgggcatcccaggccgcagcatggtagctgcgccatcaatcaaagaactgcatctaaaccgcctggagtgggatttggctttgagagcagcctgccttttccaggcagatgcagttccctcccaggcttgcccgctaaggcccccagccgagggcagtgtttgcagctcctctgctctgtccacttgggttcctttgagcgatgggaggaggcatttgacaacacatgggcatcaatacctgtccccactgggcccaggagagatgcagcatggcaggaggcccacaccctcctcagccttgccacgagctctgctcctgggtggctcgcctcccatgtggctccacttcatctctgcacttatttatttatttttaatttacttttctagagacgaggtctcactctgtcacccaggctagagtacagttgcacgagaatagctcactgcagcctcgacctcccaggcgcaagcaaacttcctgcctcagcctcccaagtagctaggactataggtgcatgccgctgtgctggctaatttttaaattttacattttgtagagatggggtcttgctatgttgcccaggcttgtctccaactctggcctcaagtgatcttcccacctcagcttcccagtgtgctgggattataggggtgagccaccgcgtcttgcttgtatactcatctgaatcaaaccttaataggtttccatgctgaagagctctttttggtctctgggtctttttgattatttcacccgcaccataagactgtgaattatagctcttattttaaaatttatttactagccacagtggactagatgctatccaaaaaattagaagcttttgtaatattagtacaaaattatatataaatacatgtaatttaatattttagtatttcttttatattctctcatttttttctaaaacactgtgaaattgttagggcaatatttgtagtctaaatctgcagatgacaaggtgaggtggagagaggatggctgacagactggggcggcctcctgatggccacgtgtgtggtgactgacttttgttaccgagacctaggggagggacgtggtggtcacggcaccaactttgagatgcctaagatctagttagtagtactagaatgcatgggattgggaactttaaatgagttgtaaaaaataagtgttattagagttccaaaaagaaagaaacgagtttggccgctgagatatttagaggaacataatatcaccacgttcaactgataaattaaattttaagaaagattgatatttgccaaaagatatgaagttagagtaaaagaggctcggtggcttgaccagggtgtggttttcactctttcattcactgacaagtagtgttggggggcccggccgcgccgaagcctgcttgagtcaccgagccagggcgctgcggctccccactgctggcggagtcttattgttgtgtctctcgctttgcctttcacagttctggcatggcagggcttaatgaatgtcaggctcagagggaagagaatggaacctgcgagcactttctgccactcacagagcggggtcacctcgccctgctcccccagctgcctacaggcctgccgtgcccttcccatctccgcagcctcagcctggcttcccttgaggaccaccaccgcccttagcccatctcccacacccatcttgctgagagtgcaggtgagcccggcccacccgaagccacgttgcctcccatcacccttcagtgctctggggccacaggggaaagcctgtgaccggcgtctgcctctgcctgccttggtctcttcatcgtcataatgccctggactccaattgcttagggttgtcccagacacactgtgctctgtcatctcttaacctctgcttcatgacagtctttccccctggaatcttgtcccctctttctgtcatctgactaattattacttatcccttaagactcagatgagtggccacctcctacaggaagccttcttccactctctcttcttcccactgcttggcgcttcctctcctctcctgagctgagctgtgatgattctgtgatagccctgcccagctggtttgtagctatctgctatctgtctcctcttccttcccagacacttccagcttgtctgagaacaggagctcatccgtgttgttcccctcggtgactagcactgcacctggcgcccaggaagacttagccaatggaggaatcataggatggctcggtggagggatggctacaaaacctgtcttttctcatactcatttcttgttaattgtgcacaaataattccatattaccacttcttattgtgcttaatcctagggtaaatttaagttaagagtgtgctgtggggaagaaaggcaagttgtctgaagattattctgcagtgagaactttggatctgtctcctgatacactgtagaaccaggataaaccataattgtccaaatccttcagggctttccttccaaatgaagtgattaacttctgcggtaaacttcctcttgtccaggctccaggcttcgtgctgggcctgacagcactcaagctttgctgcccacgtaggcaattagggtgtccttatccttcggttccactgcctggtgaaatattagataacgaggacagagcttatcttacacgtgtctgagctgacaaatatggcagcctttcagcaaaaggcaaatgcagacgaggccttttccctggctggaataagaatgagcctcatgcgtgtctggccccattgccgatggtcaaatgcactcgacatgatttccatagcacccagacagcctgagtagctcatatctacctgtctagtcaatacatcagctttgctggggagagagcaggagtttgtcactggggctcatttctaatgcatcaggaacaaatctgttactggctctctttattccggcatgaatactgtaagctgcatgaatttatcttcggtgataaataacagtgccttctgggttctgtttttttaaaggggtctttgctaagccattaatattgaggtgaagagagaggagaagaaatggattatgcctgaccgtggagattagcagcctgctcaggtgaagggtggccacacttattaatgcactaatgagcaagcagggtcattctgatgattagtaattttggcaacataacttctgccccagatttgattaagccttcatacagacttcctcttccaggagattatcttttcaaagcacatttggtttcccactccccctttcaagcccattaggaaaattaaagcatttaattttagtgatgaattttactgatacagacaactgcttttccagattttctccaaatgtaagcacaattgctacatcaaccaaaatacctcttactgaacacaaactggcgttgtgtggagattgctgattcctggtaatatattacagaataataagctctgtgttggaaagaatatatatatttcaatattgaaccaagccaggggagcaaattaaataggagaactgaaagttagctaatatctgcaaacttacttcctcttaaatgaacttgtccatcaaaccttcagatttcccctactttctcccttaaagaaacagatcaaaaatatttcgtgatgcacaagctagctaatgtcacacagctgaagcactggagtgaatgaaagttgaagatatggcagactccttgaggctaaaattactgcaacctagatgttgaaaaaatacctagtaaagaatagaaactgagggccgggcatggtggctcacacctgtaacccagcattttgggaggacaaggcaggcagctcacttgaggtcaggagttctagaccagcctggccaacatggcaaaaccccgtctctactaaaaatacaaaaattagccgggcgtggtggcaggcgtctgtaatcccagctactgggaggctgaggagagagaactgcttgaacccgggaggcggaggttgcagtgagttgaggtcgtgccactgcacttcagcctgggtgacagagcaagactctgtctcaaaaaaaaaaaaaaagaatagaaactgagaagggctctgagggctctgagtcacagctaccattttacctttcccctgccaaccaagtgaagtcagattatgacagtcgctgtgccattgtgagaagagcctaggagccctgaaacagacacacatccatatatacaaggatctctgactttaaggcaagtcaatctcaaaacaatctggataccttaaaaatcaggggggaatcgttgagaggccaaggtaggcagatcacttaaggtcagaagtttgagaccccagcctggccaacatggcaaaatcccgtctctacaaaaatacaaaaattagccaggcatggtggcgcacacctgtaatcccacatatcaggaggctgagttgggagaaacccttgaccctgggaggcagaggtcgcagccagcctgggtgacagagtgagactctgaatctaaaaaaaaaaaaaaaaggaaaaaaaaataggggggatcagtatgtgtatgcacccctgtaacatcacactgtatctacttgcaaagaaaaaaggggttgggagttccaagtcatgggagtcagagacccagagaaatcagattgcctaggaagctggcaatatgaaaatattatatgtttattcattttctttttggaggtttccactcttgaaacaccaccgcttccttgggtcagagggttctcaaactctaacatacatcagaatctcctagatggctctgtaaaacccagactgctggcctcatgcccagagctcccagtagatctgggtggacctgaaaatttgcatttctaacaggttcccaggtgatgctgatgctgctgttctagcaaccacactttgagaacccctgccctaggcattgcattccagaactctctccatgttagacagtctcactctcatttagtttgtaaatattgagcccttaccagatgccaggtactgtgctagaagcagggaatcccagaaacaccctgccttggtctttaccgagaacagtcgacctgtcagattccctcacagaaaggaccccagtcaccctcagcctgcatgcccgctgagtggaagacctgcttattccaacgtccacacttcgtttcatagggtggaatcttcaagacatacaggcttagacaatttcaattacttgcttttccttataaggcagacctctttcccacctccaatagacacatgatagtaggttttgcagactaacctctctcttggatggctgggccttgcatagacttatgggtcctctgatcccttctgggccactgtcccagtggggctatttttctccaatctttaggactgttgtttatgattgagcctttgctcattcataatcctgcttactggtatccaatcctttgtttatttccttagctttagaatgtctacaaaaaggggggaggtcactttcaatcttgaaaagttagtcctcaaataagtttatgtagtaatagccggtagctgatcttgaatctctttcatataaattggatggctgtttctctgcattgccaacaatttctttattttagacttctggaacaccctgcatctggaatccagaaagcctttttgtatgagtcgcaccattttcttggttcctgtagaggatgtggtgctgagattattcatatcgggaaaaaaaaaccattctcagaagaataatttctttgtcctcctgtcccattgagaagctttgtgaaaatactgtgaaaagacagaattattttggcttgaagctgaaagctggtgacatgtatgctctaagtggtctcactgtgcgtgggtaaggggcctgtggcttctctagcacctgcttgggaggggctttcttctccttctccttttcaataatttcatcttgaacctctctattctgaatggaccagtgggagtgatacttttttacacagagatttatacataacataacaaatttgaaggctgggaaatgaatctattgatttcttcattttctgaaaatgtttggaattttatcttttttcagtgaaatattacaaataaatttacagatggggcttcattaaggaatgtattttaaaatatgtgatcaaaacgattcattattttttaaatttcagtttcctcccttgcccttagcatgtttttttttttagggtctctggttgttacctcaccaagcgaagggacagcaagttccttttctccctctgctactcgccgggtgtttttgtacgcagcttccatttctgaaaacactttttggcctctgtgttcttaggattgaattgttcttgtgctgtcgacacaatccactcatgtcaccgctagtttcttgaaactatcttgaccttgtttcagagaaagtggcttccctaatcctacagtccagcaaaatttacatttcatgatgcacccgttcagctgtgtgctcactcagaaagctctgcggaatcatctagcactctgccatctttttccttttcttttttttttctttttttctttttttttttttgagacagagtctcgctctgtcgcccaggctggagtgcagtggcgctatcttggttcattgtaacctccgcctcccaggctcaaatgattctcctgcctcagcctcccgagtagctgggactgcagggttgcaccaccatgcccagctatttttatttgtttattttcagtagagatgaggttttgctgtgttggccaggctggtctcgaactcctggcctcaagtgatccacccatctcagcctcctgaagtgctggaattacagaaatgagccagcatgcccagcttgccatcttttttcttctgtggttggtttctgtccccaaactgtgatgggagaaggcaggtgaaatgatggttggatgccactgcaagctgccttttctgtgtgggctcttggtctgtgtacatggggccccatggcacactgagttttacctaggaaggcttcagctgttcattttcgtttgcaaatcctccgtggagacccagggagagactgcaggagttgcttcttatttcttgaccagggtttccgctcccatcaccgtggctttttggggagccttgctggtgtgttcctgggatggctgtggcctgccactgtgtcctcttacacaggagtcagccctggatgagacctgcagccctgtggccttggactcccacctttcccccaggctgggtccctcaggcatggccctttcccccagtgtccccttaggcatggcccagtttgcttggtagggcctgacactcttcagatggtgaagtcagaaagaaaggaaagtctaaaggagagaagcagctcagagaagggagaagagggtttgggaggaaagggaaagaggtgttgagaggttatgacgcccaggagaggtgaatgcagggagggaatggaggggcccaaggagtgacaggcagacggggtctctgatccgggggtgctgggcctgccctgcaatctgagtcacaaaagccagtggggaaagacaaggcaggcattgggtgtgcgagtgggtgtgcatgtgtgtggctgcgtgtgtgggggtgtgcacgtgtgtggctgtgcatgtgtatgggtgtgcatgtgtgtgagtgtgcatgtgtgtgactgcatgtgtgtgggtgtgcatgtgtgggtgtgagtgtgcatgtgtgtgactgcatgtgcgtgggtgtgcatgtgtgggtgtgcgtgggtgtgggtacgcatgtgcgtatatggagtacgggggaaggagatgtgggtaagggtttgtgtatgggagggtgtgtgggtataagtgtgtgcatgtgagggggataggtgtgtatatatgtgtgtgcatatggagtgtgggggagataggggtgtatgtgtgtgtgttggtatgtgtatgtggggggtaagtgtgtgtgtgtgcgtgtgcgtgtatgtgcacgtgttgtgtgtgtgcgcctgcacacggagagcccactcatacgtagcagaaaatcaaatggccccaaatcagaaacatggcgcatgtgagcatgccacttcttgtgtgcctgtgactgttcagaatgtacacggccctgcagctcccgaaggccagctctgctgcaacccctcctctgtccaacacagtcctcactggtgtcttttcctcttcaaatctacagcatttctgatctctgcaaacaatttaacccaaaaccaagttctggctgacaaggctacatcttgtttcttgtgcgtgattagcctcgagacccaaggagctccctgcccttgactgattcattctgtacctgctggacctggaaatgcattaaaagctcaggaaagcttactgatcaattgcactggagattgagtctggtttggggctttacatttgtaaagcatcttatgtgcaaaagtaatttgaaagaccaatttattatttctaattcagaggtctcattatcatcagatggaatggaggaagcagtggcatgagttggtgcccttgaggctggtgcttgtgttctccctggagttcctgctactctttgtcttcaggtttttcttgaagtatgaattaaaaggagcaggagatcttaacccagtatcatgtgtgggttttagtggcttttgatcagggagttttgaggctgttttattgtccttgaacaattacagtctctgaaagcagaaagacagagcccaaatcttgtgctcagtttgcttgctgtagaattctgtgtcttctctctcttaaaataaagccatataaataaaaactcttggggattccttaagaatgtcaaaagtaatgattggtctaaattgaagactgttattgtagaaactggtttgctttcaaagattttttgagtttcatatttaatatcaccaggtagttagaataggaatgaagagattaagtctacatttgatttttctttcttcctgaagtcagctgcaacatgaagggatgtattccaaagagatgtgtgtgtatgtgtgtgtgtgtgtctgtgtgtgtgtgtgtgtctctgtgtgtgtgtgtctgcctgtttattctcgagagaggaagacagcgacagaatgttaaaaataaagaaaacaatcagtagtaacccagtctaaaatagtgattcttaaccttgcctactaaaatcatctggggagttttaaagttaacagatactaggtctacctccttctgatttagttagcctgaaatgaaacctaggtattggtattggtaaaataaaataccgcagattggatgcaatctgcagccagttaagaatcactgctctgaacaatatatgcagtggaattccaggattgtgaggcatggagccagtgtagaactaagcggtcacttgtacgtgaggccaataaaaaataatgcacactttttaattgtatgccacatgcacatggattgtttgatttgattgttataacatcgttagggcatttgggggtaattataacattttatagatgaggaaactgaggctaaggaagattatgtgacattcagtcacgtaatttacagacagggtgtcgggttccagctcagctcattcaaccacaaggacatcaccctgggtcctcagacagagccaaaggtgcacatgtgtcaccttctgaattataaccttcgaccttgaaagatcttcactagtgtattgctggtttgttcccaatacagaattgagttttgtggaagaaggtggttttaccttgttgaataggaaggaatgatatatttgaatagctggttactttttcaaccagtggctttcaaactttttaaaccctgacccacagtgagaaatgcatcttgcatcataacccaatataaatacacacgtattgtaatgacaacaaaaatgtctcacaatacctatctttactgtactcactcagatatttcctattctgttctttcttttaaaactggttgcagtctgctaagtcgactgtcctaatagattgcaacccatgctttagaaaatactgtccaacttccttcctgtcttccctctgaaggccagaaaaaggaggtagcattacgattaggaaagtgaatgacttgtcttatgtagccacatgaaaagatctgtgtaggccaaagaatgattattattggtagagtgtataggaaatattattttaaatttgataagcctggttctatgtggtcaaccaggcttttaacccttttaaggacaaacctttcacaataaaagttgtaggtatgatttatccaaggagggataatcaatgttgtgctcccttaagtttttaatgtttcatttaactcttggaaacccaagataaaaaaatataatttgtagataacctagaaatattttagaaggaatttgtaattccttctataaattgtagttcccagttggaaagggagtggaaagagaccaaaactttgtggagcaattcagtttcaagcaattcttaagcatttagtatctgattctcacttttgaaacctgattgtgtcaaatgaggttctagaaagtgtattcttaaatttacaaagtactatttgcaaaataatattgttttatatttttaattgcttttttaaaaaatccagtcttggctgggcacagtggctcacgcctgtaagcactttgggaggccgaggcaggcagatcacttgaggtcatgcattcgagaccagcctggccaacatggtaaaaccctgactctactaaaagtacataaattagccggacatggtggtgtgtgcctgtaatcccagctaccgaggaggctgaggcagaagaattacttgaatccagaaggcagaggctgcagtgagccaagatcgtgccattacactctagcctcggcaacagagggagactgcgtcttaaaaaacaaaaaacaaaaaacaaaaacagtcttgtttctccagcaagattgttagctttttgcaagctgacctgggcatggatttgtcttcctgtcctttcctcgcgatgctttccacagtgttagttacagaggagactctgaagagaacttcagtctgaacctaggagtgtttgacctgtggcttatcaggatgtgaacattgggcagcctattttctattttgtttatttactttatctatctatctgtctgtccgtccgtccgtccgtccatccatccatccatccatcctatttatatatctgtctatctagctagctagctatgagataggggcttgctatatggcgcaggctggccttgaactcctgaacttacacaatcctgcctcagcctcctaagtagttgggactacatataagcgtcctttataacagctctccttcctaccctcctccctctttatttgtttgttgacttattttagagacagggtctgtctgtgttttccaggctggagtgaagtagctatgtacaagtgtgatcatagcacactacagccttgacctcctgggctcaagcaatcctcccacctcagactccagagtacctgggagtacaagtgcacatcaccacacccagctgagcagcatttttaaaattttcttttcctccaaagctttcttatatcctgattttccctcactatcctcatgtaatatttgcatatattcatacacacacacacacatgcaactgcattttatacacatgtgtcttggggtcctggagagctcagcgtgctggtggggttggtggggctggtgtctccagagtggtgatgtgaagagcagcacctcgcttagaggtagagcaggtgtgtgccatgagctcaggtgatggcagtggagcttacaggagatggcttgtggcttttccctccgttggtctgtcactctcagctgccactgtctgccactgtagggattccactgtgggttcaacttgttcttatgtcaggcaatgttgtttgtgtatactcataataagcactggttaaagagggaacattaatgctgaaatactagtgaggggtcgggtgtggtaacgcttgcctgaaatcccagcactttggaggccaaggcggacggatcacttaaggccagcatggtgaaagccatccctactaaaaatataaaaattagcagggcgtggaggtgcatgcctgtagtcccagttacttgggtggctgaggcacaagagtcgcttgaacccggaaggtggaggttgcagtgagctgagatcatgccactatgctccagcctgggtgacagagcaagattccatctcaaaaaaaaaaaaaaaaaaaaaaaaagaaacaggaagaaatactagtaagaagcatttgaaaatgataatcatagtcatactagaatgagtggggaagtgttctcttctccaaaaagaagttgtctggagggattggtggagaattagtattaactcttctttaaatatctggtaaaatttacctgtaaagccatcttggtctgggcttttatttcctgggaagttttaaagttactaattcaatctctttacttgttacaggtctattgagatttgttatttcttcttgatttagttttggtcatttgtgcctttctagaattttttttcatttcgtacaagttatctaatctgttggcatacagttgctcataatattacattatagtcatttttatcattgtaaggctgataataatgttgcccctttcattcctgattttagtagtcttttctttttttcctatgtcagtctactaaagatttcttaattttttctgtcttgttcaagaaccaaattatgttgattttctctatttttctattctctgttttgttactgtaatctttgttatttccttctttttttcttgattttgttttaatttattccttttggtccagtgtcttattatagaagattaggttattaatttgatatctttcttaatgtaggcttttacagctataaatttccttcagagtattcctgtagctgtatcccataagttttggtatgttttgcttttatttgccttcatctcagagtgttttttagatttccttttgggggagaaatttccttgttattccatctttgacccatgggttgttctttttttgtttgagggtgttttgttttgtttttgagatgaggtctcactatattgcccagactggtcttgaactcctaggcttaagccaacctcccaccttggccccctaaagtgctgagattacaggtgtcagccaccacacccagctgaatccatgttttttttaaatgtgtatgttgtttattgcttacatatttgtcaatttttgaattccccattttctttctgttatgatttctagtgttattgtattttaatcatagggtatatattgggtgatttcaattattttgtttcatggcctggcatatggtctatccttcagaatgccatgttctactgttgtagactagagtgttctatagaggtccatctgttaggtttatttggcttctactgtgtttaagtcttctatttccttgtcgatcctctgccttgttgttttatctattattgaatgtggagtattatggtatccagctattattcttaagttgtctgtttttcctttcaattctgtcagtttttgcttcatgtattttggaagtttattgttggatgtatatatgtgtgtaactgttcattctttctgatggaatgaactctttgtcattagtaaatgttttttattatcccttgtaacttttttttgttctgaagtctgttttgtctagtattagtatggtcgcaccagttttcttatgactgttgtttgtatatctttttccatgttttttactttcaacctattgctatctttgattctaaattattttctatacatagcatatagttaaatcttgttctctcatccattctgacagtctctgccttttgttcatttcactcttatgtaatcttattgatgtagtttgattggcatttaccaccttactttttgtttcctatatgtctcatctttttttcttcctctattcctcctatactgctttaagttattttcttaatggttgctctcaagcttaacacacataacttgtcagaatctacttaagatttccactaaattctagtgtgagatatatacataattttactccaatatagctgttttctctttttttatgctctccttgttatacacattagctctctatgttacaaacctaacaatacattgttataattgttactttgtgtcattttatgtcttttaaataatttgaaagaagagatgagaacaagcatctatttatagcatgtcttgtattagccttctaatttaccttttctagttctcttcatttgttcctgtggatttgagttaccatctggtaccattctctttgcctagtacagctttgctcccactcacctcctctgtgttgtcatcatgaaataaattacatttctacatgttattgggccagtggcacaattacttatgcatatatttgttttaaacaattgccttttaagttaattaagagaagaaggaagaagaaatgtacatttacactatcttttatcattatgcagttatctttcctggagctctttgttcatgcagattcaaattactgtctggggttacttgctttcaacctaaagaaattccttttgtatttcttaagtgagtctactagcaacagtctttcagtttttgtttacctaggaaggtctttatttagtcttaacttctgagagatagttttgctggatataaaattcttggttcacagtctttttaaataaatttcagcatatcaaatatgtcatcccattgtcttctggctttcattgtttctgatgagaagtcagttgttaatcttaatagggttatcttataaatgatgagtcatttgtctgttactattttccttggtttggctgtcagcatttttaccatgatgtgcctgttttttggtctctttgaatttatcctatttggagtttgttgtaattcctgagtgtatagattaactttttcaataactttagtacattttcagccattattctttggatttttgtttctgctcatttctctctctctctctctctctctctcctttcctgtggtactcctaatgtgtatgttggtgtgattaatgatgtcttgtgttttttatctaaggctctacttgtttctcttcaatcatttttctgttactcagagtgcacagtctttatcaatctataagtttgctaaatctctcttatgtcagtttagatctactgttaagctctagtgaattttttattttggttattgtattttcaacaccaggcattccatttggttttttcacagataattctatttctttattgatctactgttaagctctagtgaattttttattttggttattgtattttcaataccaggcattccatttggttttttcacagataattctatttctttattgatattctctgtttgatgcaacaatgccattttaccttgctttgcttctttaatcattgtttccttgatttctttgaacatacttgtaatggctattgtgaagtttttgttaagctggatatctgggccctcccacaggtagtttctattgcctgctttatttcctgtttatgtgtcacactttcctttgcttgtctcattttttgttactgaaaactggacattttgataatatattgtattgactcctctagagacggattttctcctcctccccagaacttcttgttgttttctcatttatttagtagcttcgttggactattttattaaagtctgttttccttgcaatgtgaagcctctgatgtcactcctcagagggcacagccttggatatggcacagtcaccctgggatggcagtgattttagcagagctctctttgtttctttgcttcatatttctgtcaagctgtctgccttagttggtatcacacccagctgttagtttccactaattgctggctaattgctttattgttttcctctatgcctggggcataaatcactacagagtctgatccaactaaattcaggcccctttgcaggggtcatttttgatctagcctttgaggtttgttctgaccccagaaaggttcttcttaactgtctctttctctgattctctgtaaaattgctgacctagagttaagcttgtcactctcaaagagctactagcctcctctcaatttcttactaccaaaatttctacagtttttgaaagcacccttacacttgagcttcctcacatactgttctaaataaagtaagttttcggtagcagagctttggaactctttgttcttatggcctgcctgtacactctgggcaaaatctctgagttgatgctccacagctggagtggggacattagctcacttctctgagtgagccctcctcaactttatgggcaggatgggcaggacactgggtagaggtagtagccgctggtctttttagcttgcctctccttacatggaatttccaccctgtgaatgaactgggctagaagcagttgggaccatgctatcattagcctgccattcctcggatagatcttctgccctaagagtgggggtgaggaaggggtagaacaaggaaggccaagtggtaataggaagcctatggcctcttgactgcattcacctgtaatttaacctctgcaacagggacgtgctgtgcttgcctttcactggagatgccataggctttgttgggaagtggggagagaggaaactcttgtttttttgccacacccactcagtgtagatcttccctgtgctgaactggggaagggagagggaaggagtgggttgtggctcaagtgccacagactgtcactgttcttacaatggaagtaagagattttaatagattttcttgaaacaagatatttattaatctgctgaaattcccttggacaattttcagagactcaaaatggttactcttttacataatttcagcaattatggttgttttcctggcaagtgagtctgtggaacttctcagctcactattctttgagtctccaatttttttttttttttttttttgagacagagtctcactcagtcacccaggatggagtgtagtggcgtgatctcggctcactgcaagctccacctcctgggttcacgccattttcctgcctcagcctcctgagtggctgggactacaggcgcccgccaccacacccggctaatttttttgtatttttagtagagatggggtttcaccctgttagccaggatggtctcgatctcctgacctcgtgatccgcctgtcttggcctcccatagtgctgggattacaggcatgagccaccgcacccggccgtgagtctcctatattatattttaactgtgttaaagtttcaaacacaatatatatgtggacaagtcatgtttttcttactaattgattgaaactaaattatacagcaaacctttcttttaaatgagcaaaagaaagaaaattatctttatattctataaataacattaaagattgttttggattttattatatatcttttaaaaatagagacagggtctcactatattgaccagtctggtctcaaactcctgagcaaatgaagcaatcctcttgccttagcctcccaggtagctgaaactataggcacataccactatacctgtaattttattatacaatttttaataatatgcttgcctcaaatgttttatttaaaatatctagcatatcaggcctgtgattttttggatattgttacttagaagttaaattttttaaaaaatgaattaattgaagtccagtttaaaatcaatattaaataaataatagaacatgtggagtgcaggtattttaagaatccttagggtgggacttgaaggacttggactgaagtgtgcaagacattgatttggtcctagcaatgaaatgagacatgtgaggactgcacagctgtgtgactcaagatgtcactttcagctagcaggacaggtggcactagaccctgggtctcctgaccagcatccaactgcatcaagagtcactaaagccaaaatgttccaggcataatgacagcagacagaatctgtagcctaagacttccagggcattcagctggagtctgatcaaggttcgccatttgctgttttgtctgtttgagctaaaaatcaccaagaagaccatgtgtgaccaaattgccaccctgcagccaacctttgccaggatttctgcctctcagaggatgaatggtgatagactggtttggaaaatttttctgtaaggtatattataggaaacaaaattgtaaaggtatttgcagtattaccatttctaagcttgtaaatttttttaaaattacttttatttgtataaccaaaattagatgggtttctgccagagtagcattccttctatgaggactctacatttttattattaacactctattttactgtatttgctttcctgctgtgggtatttactatgttgagaataacagacttaattaaggtcatttttaatcaaaacaagaccatgtttctccttatctgcataaaaggcactatcaggcctttagggaggatgggcacctgttctcctaaccctttggcttctgtccatttcatggtggcaaggtgtcatcataaagtccagtcgatccatctccattatctctggttaaccaggggcctcacattcacagctaagtttgtcatgtttccatttgtcagccctgtagaaatattttaaacgcagaaatctgatgttataatgcatttaacaatgatcatttatccaaaatctatgaggaatgtaaacaaatcaatgagaataaaacaaataaccccactaaaaactgggcaaaggacatgaacaaacacttctcaaaagaagacttacaagtgaccaacaaacataggaaaaaatgctcaacatcactaaccataagagaaatgcaaatcaaaaccacagtgaccacctcacagcagtcaaaacagctattattaaaaagacaaaaaataacagatattgacgaggctgcagagaaaagggaacacttccgggcatggtggcgggcgcctgtagtcccagctactcgggaggctgaggcaggagaatggcatgaacccgggaggcggagcttgcagtgagccaagattgcgccacggcactccagcctgggcgacagagtgagactctgtctgaaaaaaaaaaaaagaaaaaaaaaggaaaagaaaagggaacacttacacactcttggtggaaatgcaagttagttcagccactatagaatgcagtttggagatttctcaaagaactgaaaatagaactaccattccacccagcaatcccactactggatatatgcccaaaggaaaataaatcagtctaccaaaaagacacttgcacctgtatatttattgtagcacttgttcacaatagcaaagacatggaatcaacctagatgtccatccgtagtggatgaagaaaatgtggtacatatgcaccatgaagtactacacagctgtgaaaaagaatgaaatcatgtcttttgcagaaacatggatgcagccggaggccattattctaagtgaattaatgcagaaacagaaaaagtaaatataagtattttctcacttatacatggaagctaagcactggatactcatggacatagaaatgggaacaatagaaactggggactccaaaaggaaggaaggagagaggtgggaaagggctgaaaaacttcctatcgggtattatgctcactgtcttggagacaagatcaatagaagcacaagccccagcagcatgcagtataaccttgtatcaaacctgcacatgtacccccgaacctgatactaaaagtaaaaaagaacttgatcgtatcagacagtttagtaggggttagaatttcaacccaggatatctgactgcaaatccacatccttcccaaagcagtatattggttgctttgggaatcatcattggtggtgggatggggggaattttatcagacatcattcttaaaccatggcatttaattttttttttttttttttttttgagatggagtctcactctgtcacccaggctggagtggagtggcacaatctcagctcattgcaacctccgcctcccgggttcaaggaatttctaactaatttttgtatttttagtagagtctgggtttcaacatattggccaggctggtctcgaacttctgaccttaagtgatctgcccaccttggcctcccaaagtgttaagattacaggtgtgagccactgtgcccggcctaattttttatttaaaaaataaaaagaagaaaaactagaaattaaaaaacaaataaaaatttgtcatttcagtactttttcaagtcacaaataagtaaaatattgaactaagcaatccctccaggcacatcatggctttcagcattggaacaggttccaaggaatcctattggagaggacatttaatgggaggacatcgctatatgttttcagtcagaaagaaaagaaaggctatggacataacaaatttaaaacagtgaaaaagaaaagtgttgagggagcttttattctagaaaactctgatttttataaatatttaagtttttaataaagtacctttttatactctattacagaagcagaaacttcgtctttttagggcccaagataaggaaaaggataaaagacaataaccttaaatttccagaacacaggtttactttaacataaaggaaaattgcctggtggtacagtttgtttctaggaccatcttccctgaggagtgaagaagttctttcctgatggtccacttaaatggtctctatgcacttccagagcttcctagcttccctggtctcagagaagtaaaattcattcctcgagccttttaaatgggacttgttgatcaggagccttctgaagggtggtcctcggatcggccacatttagagttggactgatgcagtggtgaggaacaggctctggagtcagtcttcctagttcaggtcctggcattgccagttactgctgtgtgactttgggcaaattacttaacctttctgtgcctctattctctcacctgtgagattgggataataactagaattcatctcatgatagttgtaattattaaatggcctacttgaatgagttagagtgccctggagcactgcctggcccacaggaagcgccatctcagtgttagttgttgtcagtatttaggttaggcacccctcctgtgtgctcctgcagcacatccgtcactggtgccttcacccactccacgctgagcacgctgctgggtgccacgccaagtttcacaggcctcacgaccccgctagctcttgctagagatgtgaagtagggacagcagggacaagggcggttcctggctctctttgtctcctgcagtgcatcgtggtggccggcacatagtaagtgcttagcatttgctgcctgcagccctggagctgacatcaaagagactcaacctcaggctggaattttctaaaacactcgagcactggagagccatgaattcttgtcttcacagcatctgtgtgtcaggctagtcttaaatgctgaagatgaaaacggagtatagttatataggtctgatgtcaaggttgactttggactagcttggatttttgggccatactttctctgatatatggcttagtatatgctccagtataaaactaaaaccctggaatgtgccttgactttatcacaacttttgaagaaatgaatgatttggccaagctaaaggtcttggagccacctggacacatcctgcagtttataagcaagacagagaggagctacagagatgacagtatgtgccgcttaggacgggtgcaggcctgctgccctaacagctatgggaataacggccccaggggtgcggtcacttggcaacaacctggaccatcatgagcaccacctatgtgtgccatatactgcgtgtgtgcaagaatgcgtgacatttgcctggattaaggagctaatgaaactggggtttcagtctctcaaggggcagttacaatttttatggggttaaaaactgagaactagaatagcagtatctaactcctgagttaataaacatctcgagcctcattttctgtggtgtacccagaaataagatgaattacgaaagttattcagccttccattttggggatgaaagtgaaaattgtgatatatttaaaaagcaaaataaaatattttcctgagtaactacatcaagcattttaaacagtaaaatatccagtgtgtttttctataggaaaaacatgtttcacctgataatatgcagatttctatcccccttcaacaccctcccacccagaagatgtactggcagttttctgaaggcactctcagtatgccttgttgataaagaaacatttgggggcgtgccagcagccaccaggcaggcaggacacatgtggcaggagtaggtgctgcttccagaatgctcaagggccaggacccttcctggcatctggctctctcaaggaacaggaaggccgaggcggggacagagagaaagcggggccaggctcatagggacggaggcttggcgtcttcatcattctgtctttacaagaagtctgctcctggcacttgagtttgtccagagcgcagaattagagtgttctcttaacatatggtgtccagaaatcctgaaagacttcttgagtttttaagaaggatgccaaatattctagaaatagtgtctcaacactagagcctctgttttaatgagacagggtctcattctgttgtgcaagctggggtgcattggcacaatcacagctcactgcactctcgacctcctgggctcaagtgatcctcctgcttcagcctccggagtaactgggatgacaggcctatgccaccacacctggctaatttttaaattttttttgaagatgtggtctcactgtgttgcccaggcttgtctcaaactcctggcctcaagcagtcctcctatcttggcctcccaaagtgttggggttacaggtgtgagccactgtgtccagcccagggtctctgttaacataagccagctagctttgccattcttggggaccttaacgacactgttaacccctgctggttctcctgaaaggtgcaggtagatcaatcatgacccatcagcacagagcggaggacagcaggaagcacctgccatgcccaggaggacagtgttactgctctacctacatgtgcacacaaactctgtttgtgttgaggttgagtactgttctttaaaatcattgttgaatgacaattagcaaaaacaagagccctcacatgtcctcgtggtggtatgctggcaccacgatttctccaagcccccggcttgctcatttcatccaggtgaggagtctggagtagagcagggcttctgaaatggtgacatgcacatcactctcctgggcatctggttaacatgcaggctccagttccccaggtctgggcggggctcaagatcgcatttctcataagctcccaggggatgctgctgctggtggtctctggaccacactctgaggagcgagggttggatgcgttatttcatcctcctgaccaccctgtgaagtaagtattctcagcctcattttatagatgaggaaacgcacccagctcaacctaacacaggtggcagggttggaacccaacgttggttctaactggcctctataaaaactttatactgcctcccattttcttctggggcttggaagggtagctgcaatttcaggcacaaacccacttaggaggtagcttagccattatgaaaatctataccaccataaatgtggactcataagtaattccttttttccgcttagtagcatagataatgtgtaacataaactcaaatctgctaattcagggagtctttttgcatattaggaagctattttaaagctgtttaatctgaactaatttatttaatacatttgtaatccgcattattggcttgctagctccatggggtcacacacttttatatttgttaacattcctaccagacgacagggctggtgggagcacacgcagagcatttgcgtttctacataaagctgtctctgtgctgcgtttttctaagttccaaggatacgctagaagattattccatgttatagactaatgtccacaaatatcaaactatttccatgttttgagtctgtgggaacataaagtttgtgttcttttaaaatcctcattcatgactttaagcataacaaactgacttaaaatgtactgtttctaaaggccaaattccagggattaatttttatgtggaaaatttcatctcagagcaaaattttatagcatagtcgtaaacctcaaagaatgggaatttgtaatgggcagagccatcgattcttaacaagagctgcattaacaggcagacgagacacataaaatggctccaagagcctcatggcaacatgtggagatgtagaatcttttacatggatttgcaagtaaacacatcctcttagtgccccaaaaaatcgggtaatcaggctaaaaaaatcaaagtaagtcatcatcagtccactggcatcctttggttagtttcagtggttgctacatttgttgactgttggctaattaattctgagcttgctaccactgagcaaaacaatgagtgggtggccggatgggagtgtcagagtcagactatcccggctccaactcctagctggcctctcaccagcagtttgcccttggacaaaagactcaccctctctgagcctcagtttccccatctgtaaagtggtaacaagaaaaatgtgcctcacagggttggcatgaatataagagatatatagtgcttgaaagtgctttgcatatagcagtaaacctttatgaatgtttacaaatgctaactttatgctgcagaaccattgaaaaggtatttctaattctttttttcttattattttattttactttaagttctgggatacatgtgctgtatgtgcaggtttgttacataggtatacatgtgtcatagtggtttgctgcacctctcaacccattatctaggttttaagccctgtatgcattagttatttgtcctattgcccttcctccccttgcctcccccagcccccaacaggccccactgtgtgatgttcccctccttgtgtccatgtgttctcattgttcaactcccacttatgagtgagaacatgcggtgtttggttttctgttcctgtgttagtttgctgaggatgatggtttccagcttcatccatgtctgtgcaaaggacatgaactcattcttttttatggctgcatagtattccatggtgtatatgtgccacattttctttacctggtctatcactgatgggtgttcgggttctttccaagtctttgctattgtaaataatgttgcaataaacatacgtgtgcatgtgtctttatagtagaatgatttataatcctttgggtatatacccagtaatgggactgctgggccaaatggtatttttggttctagatccttgaggaattgccacactgtcttccacagtggttgaactaatttacactcccaccaacagtgtaaaagaaaaaacaaccccatcaaaaagtggatgaagaatatgaacagacacttctcaaaagaagacatttatgcagccaacaaacatatgaaaaaaaaaaaagctcatcatcactcatcattagagaaatgcaaatcaaaaccacaatgagataccatctcacgccagttagaacggcgatcactatttctaattcttcaagtgatctttatctgcgagaatttctgttgtgagtgaagcacccgcggtggggcaggctgtggagggggaggcaactggagggggaggcagcggggcataccgagaagccctgggggtgagagctggggctgggacctgggctgggtgagatgctaactgggcttagagatgacagttacagattctgggcgagcagagcctccctttaccactcagaaatttttttctgaagctaatgagctctgagtagccgctgagctactaacttaccatacttggagtggctggatgagagctgaaatctcagctgatcacctccaatcaaatccctggcttaggctgcctctttttggccattcaggacagcaaggttccagccaccttagcttctcctatgcaggtctcaactggtagccgatccttaaagcccgtttggttccttaaataagcaactacctgcagatggaacctgagacgagctcagccacacagaaacgcttatctgtaggacttcactgaaggtccagtgcgtttcctcctaaggactgtaaacgctcaggtaaatatttgtcagatggattaatgaactgaagacctttatagaggaaaccttgaagagatatcgttagaatctcaagtccttgttgctaccaacaactcttgtgaaagtctttggtgtccctgccttgctccattttcaaggcccctgctgcacacacagatgcctcctaagctctgagatgcgttggtgactgcacaaactcatattagacgtgatagccatcagagtacttacgtgaaagatgcgatgtaaagatgatgagggaggagagagtgccgaatgcaaatgtttttacactttcatatttgtgtgttccacagacttccctctcccatgcccttctgctatgtgtgctgccattttctctgaatgaagggaaaagaaatattggcagctctcagctaaaattcccagtgatggacgtgctgtcatgcagccagggtgagctgtgtatcagggcatgaaccctgagtcacgacttgacctcggaacttcctttctgaagcaccatcttcaagtggtgcttaaaaggaataaaaacaaaactcaagagcactatctagtacatccgcccagacagcccctcagaggcgctgggagaggccctgtgcctgtgtttaagccacacatcccaagacagactctacaccatgtccccagacacccacaggagcgctcattatgcgtgtgtgtgtgcgtgtgtgtgtgtgtgtgtgtgtgtgtgttaggtgtgggcaatgttttcaaagtaaacttgtattcataaagtcaaaagttttgaaagtggtttttaaacaggttgaactgtgagaacattaaactgagtgggcaaggagcttaattaagatcggctccatggccgggcgtggtggctcacacctgtaatcccagaactctgagaagccgaagctggtgggtcgcttgaagtcaggagttccaggacagcctggccaacatggtgaaaccccatctctactaaaaatacaaaaattacaaaaattagcccggcatgttggcgcacgcctgtaatcccagctactcgggaagctgaggtgggagaatcacttgaaccggggagacagaggttgcagtaatcagaaatttcgccactgcactctagcctgggcgacacagcaagactgcatccaaaaaaagaaaaaagaaaagaaaaagattggctcccatggccaagatgcccagtgacagggaagctagccaaacacagtaagtgtgttgagacactggggaatagctgatggccgttaaatgaaagaaaaaaatgttgattttctttttttatatatgaaatattcattttacaccatgttaaatcccagagcgggctatttataaccatttcaaaatgcaaatatgttcattagcaaaggagagaagaacttttccagttccatgaagttcaccaaagccctaattttttttttttttttttttttttttttttttttttttttttctagacggagtctcactctgtcgcccaggctggagtgaagtggccctatcttggctcatggcaacttctacctcccagttgcaagcaattctcctgcctcagcctcctgagtagctgggatcacaggcgtgtgccaccacacctggctaatttttgtatttttagtagagacgggtttcgccatgttgaccaggctggtcttgaactcctgacctcaggtgatccgcccacctcggcctccgaaagtgctaggattacaggcttgagccaccgtgcctgccccacaaagccctaattttaagaaacagacaggtacagtggcctacagcgctcctcactaaggccctggcttgagggcaagcctatcatgtgactgagcctgaccaggaagtgctggcccaggtggcaaggagcctcggggctccagggacaaggggcgctggtagccagggaggggcggcttgaagtggctgcagcttctaattctttctgaagctgcctctttctgagggtgactccctcttcattcacccagcagggtgactctgagaagtcagggaaagtctggcacagggaggggagttccatttttaattcggaaattgctcaggaagaatcataccatccggatttccctcgcggctgtatattaataaatggtcactttccttgctgaaattctctggtttccttttatccacgtgaagcttctggaaactcttctgggtggttcttctgttgcttttctgcccctgcccccaaaaatgagaacatgagaaagtgatgtcttctagccacctggaggaccctgcggtgacatcagggcccagtccctgctgtcatgccccaggtgacgtgctgggctgacagcagggctggccgctaacgtcactgtcctggcttctaacgctggtagtaaccaacagagtttagttttgctttgacaactcctcctacagccaaaactattgttatggcccacatgtcattcctatttaccctaaataaggaaaaacaaaggctattctgggctcccggcagtgcttgtggtgggggttatttgcagcgttaccatggcaggctgccctttccaccacggccaccccgtgattttctctgaaaactgcgacagactcgcagcctgccctgaattttcttcacacagcctgggggcatccgaatgcacgggagatgttttacactcagatgaaacaaactgtttagacctcggggaaaagagactgtgcttgaacaaaatgaaccaggagaaagcgccctcctgagacatgtctctgctttcatgtttgaattgcctgggattctgttctctaatttctgatccttataaactaaaactgcctaggaacattgagcatcctgactttgaaggagtctctgtggtgtttttgtgctaccatacatggggaataatgatgtgaggcagagggagagggaatgaatgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaaggtacatttcccaagaactgctatggatgatgcatgctctttcgggtttgctgtggttcttcttggagtttggtctgaggacagagctgagaagaggagaagctctttctcaagaagtttctttctacctaagaggggtctgtcaactcagaacatttccgggtgggactccctttaggaagatgcatgtcaggctttttcatcttctttcaagcctggaattagtttgttcctgttggaggtgttatgcatgagtacacagtttgttgctttggagttttgtttttttcaaatgtctgtatataaggctgagacctcccctggaaattctgctacttgttaataattcctttttcttcaccctcatgagctgaaaactgcattttaaagaaaaggtatttctcaggatgtggctggttcattgaacactttcttaggtcatccatgtagtgacaggagctattaggaaggagaactgtgactctgagagatagagagccaaagaaagtgagagacagacagactggctgtgggatgagagcctcagaagccaccactctcccctgtggaaatgaaggttccattccatgtgcagctgtgttttttttctgatgcactttcctaaattaataatgtggaggtggaggtgagggtggattttaaatgaatcctatagggggaattatggcttatgtatgtatttttttccatttatagcatggcagagggatagacttttaaaaggtttataattgctcttactcctctgctgattttttagaaaatcctgtcagtcatctttgatcagaacatatttaggtaaatttctttctgaagagatcatgaaactctagattctaaaatgcgtggtgagaagtaattgtagtggatgaaggcttgggctttcataaagtgaggagatgccactccagctggacgggctcgtggagtctgcattcgagggattccctagtccgtccagtcatcacgggctgctgcccgcctgcccgtgccgtccaaggcacctggccttgggccggtatcaggtagccgcgcctgggtcacacctgccctccacgttcatctctccacctacagatcatagggaccgtttcctcattttattgtcatgcaaatgttgtacataaatacatggctataaacaggcagctcagagtaaccaggaggctcttttctcagtgacagatcacaccctcttagagtagtaatttttgaataattgttgcaaaatatgaaaacctttagcaaaactccagcaccactgaagtcatcaggaagtgtttgggagaatacgtgtctgtgctggatgctgttgaagcaggtcaggccgttggggtcccttcgttcttagggcttctccaccagcttctaaatggggaatgccaactttgtgccaggcacacactacctgctgagacactgtggatgaacaaggcgttgacccagggctcactctgtagaggaagaagaccagagaatggataccaccaagacagtgataagtgctgcaacagggttcagagctgcacaggaagtccccaaaggtagtgaacccatcatcggggcttaggaaagagcttttaaaggaagataaagccagcaggtgacgccaaaaactgggtatttctgtagggtagcttttttccctttcgttctacttgttgtactatacagtagagtagccaacccacctccaaggaaaataaaattcaaaatatataatgtaatcagtatgatgatagctcttattgttttgcttctgtacttcaagctgtgaagtcattcttgtaacacaggctgaattttccccctcaaccatggtgtttaatgagtgtgaatcttcattcaaccattaaaatctccaagagtatttttatactaacagttcacaaacttgaggcaattatagtctaagtagattccaactcctgcccccacccgtcttcctgccaccaccgccgcccggtctctggaggatcttggaaagaatttaccagcctttaggaacattcagcactttaaaagtgtcacagagccataaataaagagtaagacacccctaagactgtcatctcatcaccacacccgtctctgctgaggaggacagagacaggaaggaaatgcgacaagttcactgtgcagtagccaagcaggcccagccaacatgtgggagggtgggtgtctgtcccagcggtggggcaggaggcgtgcaggggaaggggctgcctggaggtaaggctctgcggtcagccagccctgggtttggtgctccaggaaaggccagcacgtaggggagtgaggtggggtgctgctgttggtagggtaggaagtgacctcgcagggtggggccagggcttcgtggccagtgggcggccatttctgtgacattgcaatgttctgcgtggatcgttttctggattcctgccaaggtgtttacttggcctggggaaagagaggaacgcatgaggggcccagaccttgccccctgacccatgatagggtctttgagggcatacataacacatctggagcttaaaaagaattaaactgtagaaataagacttcagtgaaggataatatattagtggaggaaagaccaaatggaagatggtgttaaccatcccacaaatagaaatgagtgttatattaggagcctaaggtgggacaaccacacttccccagagctctttaaaaatagcgcagacactcatgcctctagtatgattcagttcagctcctcattgaaccagggaagagaccgacagacttcacaccacttcttctgttcctgtaattctccactgtgcagcttgggatttcctggagatgtttccataaaaatagagagatgccatcatcactgtcgtcactgtcactgctgtacaataataaaagaaggtgctaggatgccttcctgtaagttttagactagatgtattaaaaagtatccggtatttccattgcagtgactcatctgttacagcatcatgaactacagcgccgtagaagggggatgtgaacgtttgactttggcctcaacttctttccttgcgtgccctgctttctagcactcttctgtggacatctgttactgttgaacaaggaaactcaaccagtggtctgtgttcagaatccgtgttaggcgtgtagcatcttggaagccccaaagcatcctattaattttctaagaatgctactattcctgcgggttttatttttctaaactttctgttttaacagttcttccagaattcattttcttcttagcctcccctttccagcccactcctccccaacccctaaaaacgaaacccaaaccccaggtgtctttcctttctgtggatgctgggctccacgcaccacagccacctccctgccctgccacgtgaaaacaggctgtgggtgtttagtggaattctcctgtttaaaatgactgagagggtgtgggaggacaggtggggggggggggttgccacacaccccctcgtgagcttgaaagggggtcatggagggagagggcatctcaatgcagggctcagggtctgggaatcctcacacacgtttccaagaacctgttgactgcagttttcactttgaggatctcctgggccctgcctggggaggctttgtggccctgaagagagtacaatgctcatcttttctgttgctagtgttctggctcctgtgacttaaagacgagaaggaggtctgtttccactgatgggttttgcccagagtccccagagcaaggctctgccgcgtgtgtgggccccgcaccagaccctgacgccctcaggggagggcttcgggagcacccaccggccaccgtcacctgcagccagggaccaagctgctgcagtgagatgaccaggctgtgaggatggtggtctctgggacccaggtatccctgggtctttgttgcctgcaggaagagctgcctcctgtgcccagggctgagtgccttcatggctcaggcctcatcaggctgccgccaccccagggcaccccacggggccactcgattcggtttgcaggctcctgaggacagtgttcctgctcccacagcctctgagcatgcccatgaacttgacctgccccaggcaccatgccactagggtgcccgtgaacccccagggccgacgctcatccatgtgctgtagatgcacctgccacggctgggcatgactcatatttggagcctcagggcaacagcatggtgcaggtgtcccagcagggcagggcggtacctgtgtgtggcaggtttataagaaagcagtccccttaaaaaggaagatggtggggcctttactttttttttttttttaagagacagggtctcgctatattgcccaggctgatcttgaactcctggtcttaaacaattcccccgtcttggtctcccaaagtgctgagattccaggcacgcctggcctggagtttagttttacagagagtaattccatgcactgtttcatacaactgagatctttcttatccttgcctgaattttaaaatcagatatattagctcagaagatgcacacctttcagtcaatatcacatgttccatgtgctgtgtcagaccaaaagaggaataaaatccagagcaaataaagatctaacataaaattcaaactccaaaaatcttaggaaaaaaatatgtttagaatattaaagaggaccttcccaatcaaacaggatgtttagaggccataaaggaaaaagagagtatttgatggcataaaagtttatagcatctatagagaaactcatggtgaagtttcaagaaatgactggctaggggaaatagttgcaacatgtaacagacaaagatgtgtaaccataatatgtaaagatttcatataaatacataagaaataaatgagaaaactataaatacaccaatatgattatgaaaaagagaaacacaaattaccataaccatagggaaagatctgaaattaccagtaattggagaaatacaaattaaaatgagatacatatttttgccatcagattgtcaccagttaaaagggcgagtctccagggtgaatgagggcatggggaacatgccttcttcctgggacagcctaaacgaatgcagcctttacaaaaggcaggttctcagtagccatgaggatgaaaagtgattatgccctgggtccagaaatgtcacttttaggagtctttcctacaagtatactgacaaacgtgtgccagccacacacttgcacatatacacatgcaattttgtggtcataagagaaaaaagaaaaaaagcaagccacctgaacagccaccagctggagaaggcaaatgccagtatgtttgtactctgtaacagacaggccagtgcacgtgtgttcttgtttaaagaggtctgtgatgtattaagtgaaaagacacaaacaagatatttgcacatcgattccaataactgaaaaaaggaaaggctttattttgtagcaaacacacacacatgcaacggaggcctgggctttcccccgggacggagtggggcttggtggagtcaggggcgctgtgggttgggatgggagactttacactgcactgtttccttctatatgatttaaattttcaagaagttttcattatttttataataaaaatccttttcaaatgaaacacaaatatgtaaaaaatgcccagagacttgtgaaaacataatttgatttgctttgctgcaaatgcttgtctgcatagctttccatagtcaagaacagatgacctagaaaggtgtcctccaagggaagagttgattcattgcaggactttgtgctgatccttccctgtcaccatgattttcctctatatccatgtccataaagcagtgaagttctcttgtaaagaaaacatttggaaatcctagggcatgctttaatttgtgaatactccgctatttaaccacaaaataaaaacaagcattggtaaaagaaggcattattcaggtcacaatagaaatgtgaccttatttctgctcacaggccatgggaagtatgacatgcttgtttacctaggaacacagtcttcgacttcggggttcagccctcaccactgtgttcactgcctttgtcctgagcggagtctctctgcttcctttcatgcttatccctgggctggtggctgacccctgcacagaccctcagggctgctggaggcgcactcgggcactctgcagccagtgcagccttatcctgttggcagtggctgtcctcacagagaacacacccatgcagctgggcagagcccaccggggccacacatcccagccccttctctcagcctgggggtgctgagtcgctcatcaattcaccttgtaccagttaagccacttagctgcctcccgtgtcaagaggggcaaagtaggggctccggactcagcctgggagacgtcacatggtgtgtgggggtagggtcctgagaaacacagggtcaaggccagagtgtcccagacacaggaaggttatgtgcaggggcagagtcgaagactgtgttcctaggtaaacaagcgtgtcatacttcccatggcctgtgagcagaaataaggccacttttctattggaacccaattgcaaagggcccaagcccctgctcgaagactcagagcaatttcagtcttttccaggaagcccccaacatgaaaattgttgataagccctggggagcgtttttgtgtgtgtgggtggggggggtggggccggggggggggccgggggtggcacatataagtgtggcagctccaatggacatnnnnnnnnnnnnnnnnnnnnnnnnnnnnnnnnnnnnnnnnnnnnnnnnnnnnnnctgccacttagcggacaggccacggggaacccaagagcaacagcacccccttggctggggcggggccggcaggcctcactgactgccagcttcgggagctgctcagggcatggcctctgagcctctgagcatggctttgtccgtgtccacagggaacagtgatgttcccaccagcctggcctctccctgcctgcgggggcagggggcccttggcaggtccacctgctctctgcacagctcagccaccagcctcctacacagtctgctcttcattctcaagacaccagcgcctctcctataggccccagtgtcccactgccctccactcccaccctcagtccctagggtgtgggggtctgagggtggaagtggagggccgtgctgaagggtaggacatgtggggatccagagaacccctcgtccagcctcaccctcggttcccagggtgtgggcagcagacgcacacagtcgtagccactggggaggcaccacctgatctctgcctgcatcgccccacgtatgagcggatacacttgacagatatgcctccccactggccggggcctgagccctgctgcggcacatgtacgtgcatgcatgtgtgtgcatgtgtgctgtgagcccagggcagcacagttgatggcttctctcttcttactcctgcctcccccagattcctgcactgtcttcctcttagcatccccgagccccttgctctgaatttacatcactgcacggtcagtcacttccttccagcacgggggacaaggagtgaagcaggcagcagagccatgggctggaagaggggagcagaaagtggctccaggccgcccgtgagccctcgacctgcttcctctcccaaaacgggggtctggctcacctgcttccagctgccggcccaatgtgctgtgactggaagtcactctgtgttgctggactcacatgtgaagtgtgtgtcaatggcatttaaggaatctttggggtggtggtgtcagaaacccaggggagacctgaccactcctaaagtgctgtgcctgaaggcctggaaacaatgtggatgtttcctaactcacctgcagagccacagccttggaggcaaggggctgaagttgatttttcctttcaagtatgggtccctaggggaattgctttgagaaactccactcaaccataaagacgggtttaacttttctagagcggtgacattggagaaatagcttcagtttgtggagacgttctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggtgagtaccctggccgccccggctccagagtcaggcagctgcaagaggcttaggagcccatcagggttcagaggccgggagtgctttcagttgacatgtaacaaacggggcgaagcgcacctcgtaagtgttccacttagtgagtccccacaaactgaacacaccagtgtgaccagcacccagtgaacatacagacacagcagtccccccagaagcctgcgtgacccctcccaggtctcccctggatctttgctgcccgacgtggctttgccagcttctgagctgtgcacgaacgggaccggccctgggtggtccctcgtgcctggctcctctggcttggcagtgcacttgtgagattcattgtgttgtaaaatcctgtcctgagctgggtcctggaggtgctgcggggacaaatcacgcgctcatcgtcactaaacgtgccggcagcacatgggtgccatgagctggaggacgcctggagcttaaggcctcgggagcttcctggggatcggcggtggggttgttggcggtgggcttgtcagcggtgggcttgtcggcggtagggttgtcggcggtgggttgtggagggtggggttgtggagggtggggttgtcggcggtggaccctcaagccaaactgcactatgatcaaacttgagagaccaggggctgctgtcccaagcctgttttacaggctgtggttttgatggcttccagccagagggttaggagcggtgagttcagcgagcgtataaatccttggcttccgtgatgggcagcgaggccgagtctccacagtgtggagccctgcggtatgctgagcacaggagccggtccttacggagcatccctcttcaggaacagggctgtgcagttccggctcccaccctgacttacagagcctgtccagggtatggggtgcagctgtccaggtgggtttcctggggtggccgctggccctgggacccctctcaggagtgcaggctcacacttcactaggatcattggtgcagccatccatatgggcagagctgaggtttgctgtctgctctgcagctcctgcaggtagtggggagaaggaaggggtgggtgctaccgagtgctatcttcagaccatggtgagggctagacggggcagcctcggggaggagatgggatgccaggggaagacgtgcacccttgacagccgtttcctcctcttgccccctgcatcctctcttgccccttctgtcctctctctggatgcccagttcagtccacaagcccctctggccctgttgtgttactttcctcgagcctccacagcatcctggggtcctttgtctggtgtccacagagctgcgccatccagacgcactgaacactttggcatcctgatgcctgtagattgttggacagagggaggactaattcttctgaagttctaaacacacagtgtatgggattcacctgtgttttgagagaggacagggagaaaatctcatcacagcagcagtttcagaaccgcagaaggctcagacatcgctgctttgccttaatgtattacgggctgtgaacgccacccctggacttggtggaaacaagcacagccttccttggccttctctccaggagctccagaacgcttggggtctctgtgcgcaggcacacagggagttttctgtcccctgcctgggcgctccccagtcttcctcccagacttgccctggtgttggcttctctctccctagtgtgggtcaggcagctccttgctctgttcctggtgcagacccagccccgcttgctgtccctgttcatagcaccttgtgtcctgaacaccagcacactggccacacccttaccaaccaagaggcccagcagaaaagcaaaaagtgtcaaaaaagtgtcttctgtgtcatgtggcggcagatttgtgtgatgccctttcccgggaagcgctggctgccccacctgcagagcctcccttccctgaaatcaggaaggtgacagagcgatgttcagaggtcccttcagggctgcacactgcgtggcaggtgaagacattcggcagccagtgaattgtgtccacacagtggtccacatccctgtctgggcctcgttttgttaatgtgcacatacagtgttccccctgagagctccgttctggagctgagctggggcttgcagagatccggctgcaccgagctatttctcctttttttctgagtaacctggaactgggagctgtccctcctcgaggtgtggctgttcctcctacggcttcagcatagcttagcaaaggactctgtgtgatgtttcataaaacacaagatgcattccagcacgatgaccagaggcagctcggcccaggcccttgctccacttcccgatctggtgtattagcccagttgatggttccccaaaagagaaaagagtggcagctgatgaggaagaaacctccattctctcctggacacagactcaggccttgctaatactatgggtgtggccatgctatccatttccctctctctgccctgagggtcccctaacccaggtcctctccacccaggaatgcccccacgcagccaggcttcctgcctcctaattccctacttctaacttcttttaagaaatgcctgttccccgtatacagtattaggggagcgatctgattcatttacactcagctcaggagtctcgatcagggctgattctgccaaatgtctaggggacatttgcagtgtctggcatcataagggggaatcctacaatgtgtcctacagtacgcgggcggccctgcaacaaagactcatctgtacagtgcgtcctacagtgcacaggcagtcccgcaacaaagactcatctgagtggatgtgagcggtgctgaggcggaggagccggccccaccaggtgctgagcactgccggacccaccaggtgctgagcactgccggacccaggggcacttcactgtaaaagaggctgcctgttaccatgagggggtctctctaggctggctctgaggcatccacagagcggagagctcttcccagcagtacgagtttggggtctggtctgggactctgccttgggaacagtttccccagtgactcctgcctcctctgctcatccagccattcagtggacactccgcaggagccaggcactgagtaggagggggaaacagtggccatgccccgcctccgccaccagcagcacctgcagtcccctggcggaggccaagaccccgctgccattctctccatcttcctaggggaggctaggggtctggctggccgattgtgcctttgggatgggggagtgtcaggcgtgggagctgtaggaggtgtttggggcaggtatgaggacctgtgtctcctccgtccccatgcctggcctggcccatgtgcagttggcgagggcagttccaagttccccgccttccccatccctaggtgaccacctgtgtcaggaagccccctcccaaggggcttggaaggggctgggaaggcacggctggctggtcagcatggcagggagggccctgtgccccctggcagagcctggcagtcctctgtctcctgggctccctgtgctgctgtgcaggcctgtgctccagggcaaggcggctggggaggatgagtgtgtctgggcagatgctgccatcctcatggcttctttccagttatcagggcccctgcaagcccctaagcacctcttcctttctcagcaccaatgtccgaggcctttctcctgcagcacccgaggccctgggagtccaggccctggcggcggctcagcaccctccagtcagcagctggggttggatgctcctcctgtcccctctgtggagcgcagcctcattaggagcctgtgcattgttggggagcctcctgtgagggcctgtttgtagagacccaccccagggctccatgagcacattagaaaatgatgttctatttaaacctggtgtgagaagtgctgggcattgaattaaccaacttctaggtgattaggcttcacactctgattaaacttactgttacgtctttctgctggaagcctggagagtggaggtggaaacatagcttggggcaataggatgggagtgagttttggtttggaggaggaggatgagcaggccagcagccttacttggctgaggaagcttcccgccctgctatgagcggcccctcgcctcctctacaggttttccactttgaccacaaggaagggccagaccaagcttaaccagacagcatcgctgtggccctggcttctctgcttcttgcggagagtcccgttctgagaagtggtgactgccccgctgccttctctggccccttcctgagggagtgcccagctcagccagttctggtccctgtcccatagggtgtgctcctgtgcaggtgcaggtgaggagccgcagccggcgcccctcctccccccgccagaggcctcctgcctctgtcagcaccctcctgttcacagaaggggcttatctttctccnnnnnnnnnnnnnnnnnnnnnnnnnnnnnnnnnnnnnnntccccccaccagagccctcctccccctgccaccaccctcctccccccgccagcaccctcctcccctcagccggcgccctcctccccccgccagagccctcctccccccaccagagccctcctccctccaccagcaacctcctcccctctaccagcatcctcctgacactggcaccttcctcccatgtcccttggcctgggacagtgcatgctgcatgaacgtgatgggtgtcccaaagccagtcaacctttgtcgccatgcggtagacactgtgtgtcccaggggggcccaaggaatggatgttactgggcctgaatgtggtggaagtagtgatttctggatgaaaatgaaaactagcaactcaggtgtgaattacatcacagacaaagcaaatgcttacatcatagcagatagcagcggcgggtccggatctgcatccttgtgcattcttgctgaggtagcctgagcttggtttctttggagcctggtttgtgtgacttctgagcattgagactgtctagatttcttttcattatcttagaccattcagtaatgggaaagcagtaaaggggcatgaatattctagacacagcccggagagctatttgaacaagttgctggaacatttcttgctggagctgagggagcccaggtgaccttttctgactgccagcagcctggcccagagggtccagcctggcctgtgtggacagcccaggggtaggggatggcatgcaggcagaagggtctggccatcagcggatggagggagaggcaggagagggacagggacctttacccagattgaagcatatgaaattgttaacattcagccattttgacctatagaaacagcaatttcaatttaaaaaattaacaaaaggaatcacatcacacatctcttcattatcaactcctacagggattaaatcgattgtgaaaatccaggtgcccattcttcatagccaggaggagcagccaggccccacccagcacagctgggctcctccagctccctggggttgacactgggaggggccctggctgttgcggaggaggacaagcacttggtggctgtcagccctcttgatgcagaaactcatgctcctcagatccacagtgccctgacatggggtgagctctccccacaagtccctctctgcagaagccacagagttagcctagagcatggctgtgtacctggtttgccccacagggtgttcgaacctaagttgatctagcttttaaaaattggggctgggtgcggtggctcacgcctataatctcagcactttgggaggccgaggtgggcagatcacttgaggtcaggagtttgagaccagcccagccaacatggtgaaaccttgtctctactcaaaaatacaaaagttagccaggtgtggtggcacgtgcctgtaatcccagctacttgggaggctgaagcaagagaatctggaggcagaggttgcagtgagctgagatcacgccattgcactccagcctggccgacagagggagacgccatctcaaaaataaaaaaataaaaaataaaaattgtgagatttcacatgaaaattggagtttccatcttctcttgaaaaagcagcctatggggccacaccctgaggctggggctgtgaggtggctgccatggagtgggcctgtgctgcccgggctgtcacctgtctctcgctggggacccttcagtgccgggcagcagcattgccatctgtgggtttgcacgtgggggttgtttttcagagaaaattttcttctgcactcaggcttctattgcaaggctgaagaccaagatagactgagagggccactggttcccagaaaaatgggtgagaaggtccttgtggaagtaaatactgttcctgcctggttaggagttgagacacgtgtctgggtcaacagtgctgtgcgtgtcctgtgcccagcctgacatggtcactcgtggccactgctgtccagtcatctccccaggcaaggccctcctctgtgactaaagcttatagccagagggacagaggtggccatgggctccccgctctctgaggctcggccctgcaccagcagcctctctgctggccttgggagcagcggtggccagagggcagacggtcctgggcaggtgtctgacagccaggagcccgctgtgctggggctcagaactcacagtgaggggacctctgggtgtgccatatgtgacgagtgcctttctctacctgggcagtgtccctctaccctcccctgcagatagaggctctgaggtgggccccaggctcaggggtgtttgagaaacccacaggcagtgtcctgggatccctcggagggcacagggagcaggggtttcagcgccacactgttcattcccactgcggctggagcgctggctcgctgtgccctgctgctctcactcctgcccacctcatacgtttagaaaagcatgtggaaaacgatggaaaggaatgattttcagtaaggcttgaaggagtggactaaagggcttactgatgcagttgtactcggtctgcctctgacactccagactaaagaaaagagccacaggcttcctctggcatcattgtggggatgaaccgcaggggaccgtttccctgcaggcaaggcagaccctgctgcaccacagaccagatgtgtgtgtttgtcggttgtccagtgacagctctccgttactgcatttcacggaaactgcatttccaagagcttagggtccggcgggttggccgcagcatgtctgtctgagtgagcaaggacttccaattatcaggctgcccaggtggtcatttgaaaggttttgccctttgctatgtctaattgaagcattagaggatagacaatttcacatcacctcaaaatgagaacatctcccttcaattaagggaaacaggaggccaagcggcccggcagaaactgcataaggatgctggaccccagctgcacgcagattcccacctgaaccacagtgggcagagctttggaagagtcaatgcttatctttaaagtgacagtgtctcaaatagtccttctactgatgttggcactgctcagaatgtttgggaattaccttcaggttttggggttatttttaagtgacaagatctcactttgttgcgcaggctggagtatagtggcatgatcataactcactgcagcctcgaacatttaggctcaactgatccccctgcctcagcctcctgcgtagctgtgactataggcacgcacaaccatgcctggctaatttttaaattttttgtagagacaagatctcactgtgttgcccaggctggtcttgaactccttgcctcaaacgatcttcccacttcagcctcccaaagtgctaggattacaggcctgagccactgcacctgactgggttgtttttatttgtttgtttgtttttttaatcaagggaaattttttaaaagcttctccacaatggcaaatcttcctttgcaaagagcaaatagttttgctcttggggatagatttgatttttggtaccagccaaaatccatttagagttaagtcttgttcattatatgggtgatcaaaccaaatgatacaattttggtgcaaaggcaagcacgactcaattagtgagactgacgtccgagttacaaactgatctgtagagaaaggtcaggaaggacccacagcaaactgacagctgtgcctgggaaggaagtaaggacaaaggaacactgatctgtgcagtaaaacttttatggtaagaatgtattcatgtattacctttgcaattacaaaacatcctctgatcatgtaaactgatgctaaaggcagtaatgttctgggcatctatagactcccagagtaattcatttgaacatggtttctatggtggctaaaataataattttaaataaaatgtatgaacatttttatcaacaaatttatagtaatcttttaaatatataaggtattagcattaataatctaatagtaaaatctgttggtttattttttgcttagtccttgaaagttggtgtggtttgttctgaaaaaaaaaaagagaagaagattaaaaattatcttaatgatcataactctgggtggcccctgttggggaggctcaccaggctggggtctggctcttggcaaagccccagcagctctgtgaccttgggtgaaggtcacagaaaatcccctctgagctctgacttcttctcacatgtgagacgaggcaactggtgctgaaatcaggatgatgcctgcctggatcttgtgtggttccacattttcctgctgcctggaactttctcattcccaggctgattcctcttgaagtccgattgctcactaaccccagcaccaagctgggagaggcacctcatattgcttttccccgctagcccattgcattgtcccagaaatagaaaggattcccttccttttcttccagcagaccttcctagatgatttgtcttttctcttaagggacgtgccctagattgagcagagttgggggatcttgaatctgagaagtctgatgatggattccccaggaggaagaaagggggaggtgcagtctctgacagccaggggtactggcctcacatccaggctgtgactgccatctagagtggaaaggacggtagtgataaaatatcaggatggtggagaggctgcatgaaaaaagggagaaaacagggaaaattgattttatcagaaggcaaaggtgttgctgaatatccaaagatcaatttcacctcttctttgaaattctcactgtggaacaggggaaaaatagatttccaactatttgaggccataaaatacattcattcactgggaggttagcccttgggtagaatcagaatacccagcagtagtcttgctttaccgcagactgaccgaggtgcctagagaggaatatgccctctgtcctcagtttccccccatctaaaatgagggataactggcttcattcggaggccttcaatctgtatcttgccatgaagaacagtaagaaatacattttatatcacaacacaaaagcctcctataatgcaattaaggcagaggttttacaaaacaatacttacagtgtgctcagatcatttctgttctgtttcagtttttggaatgctggctgtgacccacttaaatggattttccagctctctaagaggctgcaaagcacatggtggaaaacactgtgttcagtgctctccctggttgtttccagtccccacatctgatcattcctggggtcctctgtgtgtgtgtggaaaggagagtgtagctgagagcataagcccagcagggttcgggcgtggtgtggccttgcacacgtggacgcatggcagcaggcgacagcccatggtgcagcacaagggaaccctcagtaagtcatggctgcagacgactgtcctttaataatatgagatgtactggttggaagaaaaatgatccaataaatacagaaatgaaaaggattataaaatagtgctacgaacaattgtatgcaaaccaattggataacctagatgaaatgaaaagatattagaaacagcctaccaagactgaatcatgaagaaatagaaaatcttaatagatctatagctagtaaggagattgaaccaatggtctaaaatctccaacctggaccacatggcttcagtggtgaattctaccaaacatttaaagaattgacatcaatccttcttaaacttctagaaatttcaagaggtgggaacacttcctaactcattatgagatgaggccagcattcctgataccaaagccagacaaagacacagcagaaaaagataaccatagactaatatttcttataaatattgatgcaaaagtcctcaacaaaatactagcaaactaaattcagcagtatattaaaagggttatactggctgcgcacagtgactcacacctgtaatcccagcactttgggaggctaagggaggcagattacttgaggtcaggagttcgagaccagcctggccaacatggtgaaacctgtcactactaaaaatacgaaaattaaccaggcatgggggcacgcacctgcaatcccaactactcgggaggctgaggcaggagaatcacttgaccccgggaggcggaggttgcagtgacctgagatcgtgccactgtactccagcctggaagacagagcgagactctgtctcaaaaataataataatactaaataaaaattaaatttaaaaaagtaaaaggattatacatcatcaacaagtgggggatttattcccagaaggcaaggatggttccatacatgaaattcagtcagtgtcatacactacattaacagaatgaagttgggggtcccaaacttcattcagcaggtcccaagttcttgtcccacaatcatctcagttgatgcagaaatagtattgtcacaggatccttagggtgtcacttcgccagtcagaaacctttgtggctggtggtgccttctgcctgagtattgctcatgcccactgggctcatcctgcccacttcccctggcaggctgcgctcagctcacgttactggcccagatcccacacctgccaagggcaagccaggcacagaatggtgaggggtgtgtgagcaagtgagtgcaaggtccagccactgtgcacagccaggtgcgctggttgctgcagcagggcaggcagctccaggtactggcacaggtgcttgctctgtgcaaggctgcagctggaccagatacactgcatgcagcatccactgcaggcacttgcgtctggatgaggggaatgtgatggtacccggaagcttggagacaccaggaactgcagagtcccaaagatggtgtcacagccctggccaggagaaccctaggtctgggctgccctaagggtcacagctcttctttccttcttgtcccccacagtgtggtgagtggaggggcatgtttcagccctgtttatgttacagctcttttagtcccaccattcggccagtcacaagttcttgtcccacatccaagaagaatgaggtacatggacaactggtgggtgagaagttggagagaagcttcattgagcaacagaacagctctcaggagacccagactggatagctcctttctgtaggcaggtcatcctgatgtctgtctgtccagctcagatcagagaggagacccacagtgggtagctcctttccccagacaggtcatcccaatgtctgtctgtcaatgggtagctcctttctgtaggcaggtcatcctgacgtctgtccagctcagagcagagaggagacccatagagggtagctcctttccccagacaggtcatcccaatgtctgtctgtcaatgggtagctcctttcctcaggcaggtcatgccaataagtgtctagccgtcagtggagaggagacctgcagtgagtagctcctatccacaggcaggttgatccgatgtctgttcaagtcaaactgaatccaggatttttaatgagctcaaaagggaggaagtgcatgctgattggtccatggacggccacaggcaggcccagaaaaagcatcctaagttcttactctggtctgtggactccactcagaactgacagcttggcccccatgctttaggccattcctggcttgaaggtggggcttcagcagggacctgcccctttttgcccaggagcctgtctgcctcctgctgccatcagtcatgtacacggtgcccaggctgttggtgtcaaggggcacctgcaggcccacaccaacccaccctcagcccacccctgcctcagcctcccactgatgctcgtcagcacccaaagtccggagggggctgaggtggcagggggctggcatatcagcgctgccccaaattgtgacacacctggccaaattgtgacacacctggccaaattgtgacagtgcccaggctcagcctcagctttgctccaaaattggagcaggcagcaggagcggggagaagccaggtagcaggagcaggcacttctgagcctgcaggggcaggggacttcgctaggaccctgagagcacagggatgccctgggtccgcagctgcagctttgtgactgcagctgcacccaggagggcagggctcctgccctaccaactcagaagagggcagggctcccacctgttcctggctctcaccggctccgtggagcacacagccctggccatgcctcccctgctgcagccagcatcttcacagcagctgctccagatgggccaccactgccatcagtgtttgatgaaattcaacatactttcatgatagaaaccctcaacaaagtaggatggaaggaagctacttcaacatcataaaggctatctatgaaaagcccacagcttacatcatacttaatggtaaaagactgaaagcttttcctgtaagaccgggaacaagacaaggatgcctgctttcactacttctgttcaacatagtattaattagacattctagccagagcaattaggcaagaaaaagaaataaaagacattccaagtggaaaggaagaagtaaaagtatctgttagaagatgacatgaccttatgtgtaaaaactctaaagattctattttaaaaataacccaaaaagtgtcagaactaatgaatttggcaaagttagcaggatacagaatcaacatgcaaaaatcaattgcatttattttcatgtacaatgaacaattcggtaaggaaattaagaaaattccattttcaatagcatcaaaaaaagagaatacttagaaatatacttacccaaggaggtgaaagacttgtgcactgagcaatagaaagcattgctgaaagaaatggaagaaaatacaaataaatggaaagatatcttgtattcatgaattggaagacttaactatttttaagatgttagtactactaaaagcagtgtacagacttcagtgtaatcgcttttgaaatcccaatgaggctttttgcagaaataggaaaaataatccatcctaacgtttatatattatctcaagggaccctaaatatccacaataatctcaaaaaaaaaaaaaaagatttgaaaagttaaaggtctcacaattcctgatttcaagacttactacaaagctgtagtaagttttgtagtgtggtgctgggatatagacaaatatatagaccagtggaatagaacagagagtccagagataaaccctcaaatatatggtcaagtaattttcagaaaggatgccaaggccattcaatggggaaaggacagccttttcagagtggtgatgggggatctggatagccacatgcaaaagagtgacattggacccttataacatattcaaaaattaactcaaatggacaaaaatataaacataagagctaaaactttgaaattcagccttagtttgactgctagaacaaagtaccgtagaccgggtggcttataaacagcaaacactgatttctcattctggaggtcagacatgagagaccacagtgccagcacggttgggttcggatgaggccactcttcccggtggcaaactgccaccttctcttgtggaaagagcttgctagcctccagcctcttcttataagggtactggtcccattcatgaggactccaccctcattacctaattacctagcaaagattccacctccaaataccataacattggagtatttcccatctccccccaaaaaagtgccaaatggtctgatgtaaaaggaaaaaaattcagtcactgtgctccagatctgcaaattgcacatcttgattttcagcaccataaagacaatcatttggaagatccggtgatattttttctctttaatgcaaatgttttggtgtcaagcagattgaatttgtggggagttttcctgttagtgtggctgttcactgaccattcagaaggaagaaaatgtgaaacagattgctcaagtgtaaaggagtctgaaaatgtctgtcctcaagcctgcaagatttggaaccgttctgcgtcccttttccatagatataggaataataagtctggattcagtagagtcatttgaccagccagcccctcagggtggtccctgggtctgggcagccatgctctccggagctgcccttgggggcaacttccagggccaagccagagaggccagagctctagactaacgttagagttccaagtgtacgcagcagagaagacagctatgctgtgtgtgtgtgtgtgtgtgtgtgtgtgtgtgtgtgtgattgtgccttctgtggatatcggctagggactgtctcaggaaagcctctgcctttggcgtgtttactgctgtcaaaaccctgcccacagccttatagaccccaaagaaaaatgttctcatcctactcagagatgttcaaacaggagtgattgtctgacagtgactacactcacaggagaatgacaaacagcaaggcccagctgtcccttggtaccctcaggggattggttctaggacctccaaataacaccacagtcccagcatgctcaagtcccgcagtctgtcctgctgaacccatggacaaaaaaggtcggcccctccgtatgagaggcttttccatctcatgaatacacattgggttgaaaaaaatctgcgttttagtggaacagccaggtttaaacacatgttgttcaacggtccactgtattcattcacaatacagatttcattttagaaaaaaaaaaaaagcccaaaggaaaataaagacttttcacaaagttgaatgttataaagttgtttttgtttttgtttttgtttttgttttgagatgtgagatctctgctcactacaacctcggcctcccaggttcaaacaattctcctgcctcagcctcctgagtagctgggattgtaggcgtgcaccaccgtgcccagctaaattttttttgtatttttagtagagacggtttttcaccatgttggccaggctggtcttgaactcctgacctcaggtgatttgcctgccttggcctgccaaaatgctgggatcacaagcgtaaaccaccgcacccagcaatttttttttttttcgagatggagtctcgctcttgtcgcccaggctgaagtacagtggcatgacctcggctcactgcaacccctgcctcctgggtttaagtgattctcctgcctcagcctcccaagtagctgggattacaggcacccaccactacacccgactaatttttgtattttcaatagagtcagagtttcaccatgttggccagactggtcttgaactcctgacctcaggtgatccactcaccttggccttgcaaagttctgggattacaggcatgagccaccgtgcctggcctaaagttttttttgttttgtttttgttgttgttgttgttttttaccccatccactgcctccctatgtgacctcatgacatcaagaaaacagtgcatggtgcagataatctctgctgaggtttgtagtcatggtgactgcctcggtgggaagctgactgccatgctgggctaatgttttaatagcgcagatagtctttatgcagtggcgggccattggtctgtgtagcacctggggttcttctgaaaccaagtagccagagccagagaagaacttgcctgtaaggagactcttggttaatgcagcgcccaaccttaagagaaagctcctgaagaaatctggaattaacacaacattgcttaagctgcccccattcctcagcctttccattcaaaacaccacctttggaatactgtttaaaaaaataaggaaatgtcaatgaacttgttgtctttaaaggaatatcttaaaagagataatggaaattaggctgggcgtggtggctcaggcctgtaatcctagcactttgggaggccgaggcgggtggatcacttgaggtcaggagttcgagacaaacctggccaacatggtgaaaccccgtctctactaaaaatacaaaaattagccaggcatggtggcacatgcctgtagtcccagctactcaggaggctgaggcaggagaatcgcttgaacccgggaggcggaggttgcagtgagccaagatcatgccactgcactccagcctgggcaacagagcaagactccgtctcaacaacaaaaaaaaaaaaaaaaagagagagagaggtaatggaaatttatccccctttaactgtgcataacaacagcaagtaaccattacctgtgatgagaagagctacctgtttgctgaagcttatttaaggcactatgctaaggaattctcataaatggtatttgagcctcatgacaacctctttttacaaataagggaactgaggctgggagaaactaaatgagctgcctgagatcacagtttggaaagtggcagaagctgagctcggtggcacacacctgtagtcccagctatccgggaggctgaggtgggaggatgtgtttgaggccaggagttcaatgctatgagcacatttatgaaaatgtgctgctctccagcctgggcaacatagactttgtctcttaaaaaataataaatgaaaatgttttaaatttaaaaatgaaaagcatggccagaattctagcctatgcaatggctacctacctcagagacttcttacccttacagatgtatacctatgctgatagtggtagcctccatctgtataatattaaattgtcatcagataattcttgttaccttttttgttactgcctttgttccagggagaaaataagagaataaaaacatgcttgcaaggcagtgcacatacaagaggcctctgaaagctgctgccagacctgtgtgcccccagagcaggtgccctctcgtaagcatcctggggcaggtataacagcccctgataagtcctgctcagtgcgatgtgggtctcaaggaactggtccttataatggtcaaacatgagtgatttgagagtaacgtaacttaaaaagtaaactagaattcattcaaagtgatccctagagtaatgtccctctaacccactggcattccaggatgctttcttgagtttcttgggtttagagtgactccatgagccctgggaactgtgcagagcccctgtctcccagcccttggggacatgcagcaccagtatctgttggacatgtgcacatctgctcacatgttgcaatggaagaggactgagacccgctgcaaggaagtattccgtacatgtatagtgaggtcattaatgaacagctgggtgaatggctgcctcccttttggttgttattacaaggaaatagcctacaagacagggaatgcatttcagcctgtatgaagttattaacaaagttttgttcctattgcttaaaattctgtgaactactttaagtattatcttatttcacagcttattttgagtgatacaacaatgtaagcattagccaagaacatcagtgccttcattgttgattaaaattggccccataatgagtatgcgggaatgctgccatctgagcggcagccagctgtgtagtgagcccccttctccctgaaaatgttctccatagcatgtggggtgagtgaagagacccccaacctagacaagggagacacatctttgtactcagctatctgcactctctcagttggcacaagccccttggaggacaccagtcacagagtcacaccctcgtttgacagagatggagcaggagccagcaggcttcatcagcagcatgagaggtttaagggctaaggacggtgaccttgccaacaatcagcgtgtgacagccttggtggaatgaccagagaaggctgtggagcgagcatcagctaatggtacggggtggttgggattcagcctttctagaactccggtcagtcttcccatctgggttttctgggtagcagcctggggcacagagctggaatgccagccttctcgggttttggcctcaagctcttccaccacagcatgttgtagttataatgtccccatgtactgtgtgggtgaaaggcctgggaaaaaaagtttcctataaaagtaaataaattggggcagggggcaattgtcagtaaatagttaaataaattattatgtagtcataatttttgttatattattatacctcaataaagctggaaaaaactggtggtgatagaggaaagtgcttatgttatactctgtgaagaagagaatacacaactctggccacattatggttacaactgtataaatttaatatatgcaaatgaacaagcattagaaaagcacttaaagaaagaaattggcaaggtgcggtggctcacgcctgtaatcccagcactttgggaggccgaggcgggtgaatcacaaggtcaggagatcgagaggatcctggctaatatggtgaaaccgcgtctctactaacagtacaaaaaaaacaaaattagctgggcgtggtggcgggcgcctgtagtcccatctactcggtaggctgaggcgggagaatggcgtgaacccgggaggcggagcttgcagtgagccgagatcccgcccctgcactccagcctgggcaacagagcgagattccatctcaaaaaaaaaaaaaaaaaaaaaaatgaaatccgttcaagtattaggatgatgggactgtagatgcatttcctcccattttagatttttaattttgctgttacattcctgcaaaaaacaaaagccaggcaggaaaagttcccatctccaggccatcccgtctggcagatgtcccaaggcaggaatggcctgaactcctctctaccagtggccaactctcctgctccaggcttggttctcaggctttgagaacctcagggcagaacacctttttccaccccagcaagcaaaatgaataggtaacaattgtgcccttgttttgagcaacaggagcagatgggacctacactggtgggctggcctgggaaaggtccagggctggcttggcccgggcagcaaggctgaggaaggtggtgtggcggggaggagaccccagggctgcaggcatgccctgcgttaccctctgcacccctttcctggcctcaggaactctctgtgggatgcgttagaagacctgctgacaggccggataaggccaatgagagagggaacggagaagaggggcacctgggttcacaggccttaagaaagaatttagttacttatttaacaaattaaacaatgtgtgtcacgcatgtaggtctgggaaatgcattattaaaaacacacagtgcagaggtgcagcaccagcatacgggtggatttgggactctaaaatggctttggttgtgtgtggtacaagggagaatgtatacatgtattacgtgtgtagttttttaaagtacacatatagaggaaaagatgagacaagtctgatgagatgtcaacagcaacaattcttagttgtgggtgctgtgaatttcccagagaggaggagagtcctttagctgggcatggtgatttcagcactttagcaggctgaggcaggatcacttgagcccaggagttcaagatcagcttgggcagcatagcgagatccccatctcaatagatggattagatggatggataggtaaatagagagagagagagatacagatatttagatagatagcctagattgcttgatgaatggataagttggataggcagagacaaatggatagagatagattagaaggatagatggatagattagatggatgaatgaatagagagaaacagattagacagagatagatggatccatcgattgattagataggttaagatagtccttgcattcaggcaagccacagcaggtgccgcctagggcagcggcctctgcccagacactcagtgctgcagaacaggagggaggccggggcctgtggcgggcgagggaaatgcggggcccgaggactggggtgagggagagaggcggcggcccagaggagcagcaggcgcgcctctggcggtttcctgtccgggctggcggggccgccagtcggcgtggggtgcggcaaggggagcggggcgctgggtcagccgagggccgggcctcgggggcgcagccggactggacggcggctcctgtgggcacttggccgggtttgctggtttttcgggaaataaggccactggggacagtcactacgttttcaggaaccgctcagcccctctgagtgccccgcagatggacctggcggcgttcctggctacggctgactgggctcccggagcgaggagcgcccctgcgggcccagcctgggccctgggcggtgggagggcctccgcccccttcccgcttccgccccgctggcgccggacccccgccctcgtctgtgcctgccaggccgggcccttccctcccgtcacaggcggtccctgagcccacccttcgtctccgagcagctggaccgccgtatacgtttgccactgattccaggatgtccccgagtatcttaggaaagggccgtgttggacaaacgcggggctcggtgtttcttccgcgccgtccctcgctgctggcgccggggccgtcggaggctcagtgatggcccagcccgcccgtttccgagaattccccaaacgcgggcccctacacgctgagttcgcgctctcccgtgacggccgacagccccgcggaccctgctgacagccacactctgggctgaaaagggtaccacgcgtactttttttcccagcacgcgtggggccttggaaagaacctttactgaggcctgtggctggcctgtcaccttgtcaatctggccaaacgtttttgaaaaaggatgctaactcaccagatgtgaagttgcatctgccctgtgaataggtggactggagaagacactcgctggaggatcctgagcccaggctcggaaagggccgtccacctgcgagcgcggacttgcgcctctgctggaggccgggcagggcacgggcgggccccgggccacctctgccagggcttcctcaacccagcctgccctcatcgggcggccactgaatgcggttggacagtcatcttgaatgtatttcaagcacacaggtgtagagagtgagccatattccacttcaaatctaatctggccaggagttcaacttttccatgtttccttttgttcacagccctccatgtagacaagaggtctgaaaagggacgggctctttctcgctccacgttttttgtttgtttgtttgtttgtttatctattttttgttttttttttttcttctgtttttttgatacggagtctcactctgtcgcccaggctggagtgcagtggcaagatctcggctcactgcaacctccgcgtcccaggtttaagcgattctcctgcctcaccctcccgagtagctgggattacaggcacccgccaccacgcccaactaatgtttgtatttttagtagagacggggtttcaccatgttggccaggctggtctcgaactcctgacctcgtgatccatccgcctctgcctcccaaagtgctgggattacaggcttgagccatggcgcccggcctcgctccacgttttatgcagatccccgtttccagaagttgtgcttcatgtttttaggtgcggcggggctaatgattttcctctgtttcttgttccccccactctcctccccttcccctccgccaggaagggtgcctgtggccttcagacagcgccgcaccgcggctgggcgcctcggaggtaaggggccccaggaggtgatggctgcggggggcggggggggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggtggaaggggaggggcctcaccacgtgggctgacacttttggaggaaggcattgcctagaactttggtcaaaagcgggaggggacttcccctagaatcttccagggattattcctgctagtctaaagctccttatcaaaaacaatttgagaatcacttatctttacatgatcccgtaagcttctactaatgtgccttggcaagtgggcatggtttataaatatcatagcatgattcattcccacatctccaagtgtaataatgtggattttaaaataacatgtttttgcctttaagttaaaaatattggtgtgagagaaatcaatatctgtatgtacgtgtgtagatatgtgtgtatattaaatgcatgtatatacacatatatgtatacacacatacacatctatgcatatatgcgtgtgtgtgtgtatgtacgtatataaaagagccgtctcctagaagaaactgggatggtagaacaaatgagaagattttgtaagaaatgtactacctggattcattttgaaaaaataaattattataatcatatttatttgagtaaaaaatatttttcatgtcagtgactaaaaataactacaggaaacttttattcagattccagataactggaaaagtctaggagccacaaagaaaaaacagtcattttggggggaatttgttaaaaagtaattggcaatgatcttctctaagtaattaataaatcgacccaatgctttgtatctgctccacgtaccactgtgtgaagttataacttctgcttactcagagttctggccggcgcagtagctcatgactgtaatcctagcactttaggaagctgaggtgggtgggtcacttaagctcaggagttcaagacaagcctatgcaacatgacaaaaccccatctcaaaaaaaaaaaaaaaaaaaaagctaggcatggtggtgtgcacctgtagtctcagctactcaggaggttgaggtgggagaatcacttgagcccagaaggttaaggttgcaataagccaagatggcgccactgcactccagcctaggtgacagagccagaccctgtctcaaaaaaaaaaaaaattaagataaaaaattaaataaaaataaaaactcggagcccctccttacttttctgaaccataggttctaagttctagagctggcagggacctgagaaagcaggcagccctgtcctgtcctcgtaagttatagagaagccgaggactggacgatgtcactggtgaccagatccaagtgcaggccgcagtgctcttcgccctgtgactcttggagttcctagtgtgttctgtttccaaggggaaaatgcacacgtagcacgcacagaaactcccaggagcccaagctttccattacccacagctctccattgctcagccctcctggatgcgctgggatttggcaaggtgagtggtctgtcataaggaatcagaaaagtacacttttttttctggaattggattttcctgttttcttttttttttcctgggagatggtgttcaaactggtaggaacacacaccaagcgtaactttccttgattctgacacatttatggtcatcattgcgctcaaactgtcttcaagcctctcctcttttccttccagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatacatttgtcccttgggtttttgttttgtttttctttgtctttcagcaacaaggcacatgcatggggaaaatgctgtgtgttttaagacctgtctcaaagaaatacttcctgtggctccctagctaaacttcccactcagcttgtagtcactctgacttttcaaaaaaatcactacttcatattctactagaagcaattctggtcagatcatgattcgtttcccaatgctgggttctacacaggtcattcagacagtcatcaggtcccctcatgcaaggagtccccagagaaactgctcaccccacctgaggcgcccagggaggactttctagatgcctcaaaaagtctttgggtggctgtcacacaaaaccgaaatgctcagcccaaaatatgaacaagattcctaacaatgacaactattccacaatggaacagaccccctcagtgtgtgttttaaactccttggcattggaggtctccagtcagtgataatgtaacaacagagaggctctaaatttcctacaccgagagactagaatagtattatctctatgctctaaataagaatatgggttcacagatgatgactgtgtgtgcataaaaccccacacgatctaccaaactactaaagtggatttagcatggttgcaggatatgcaatttatttttgcatttctatgtacttataattagcaaatggaaactgaaattttgaaaataccattcaaaatggtatgggccccaaattctggtatgggccctaaattctaatggtacatccattttcgattctgaattaaattctttctttaagattattttggaaaggggatttgaagagagctataagaaggaatagagcaataggaaagtttctttcctgtcaaacagcaaatagtcactaattaaccacaccacactctggaataaattctgtaatctctgaatttagcaaaccattagagaaatattaaagataccccccaaatttgctaacgctaacaactatgcaaactttgttcctgcagacagctctgcacagaaggaatgaggggaatccaggcttgggatccctgcttatgcagaccataagcagcaaatccagtaaaacctgggactggcttctcacaacggagacacagggctcctctctcccccactgtccctgggaggctgtaccagctgtcactttagaagctgtctcagagccaaggatgtgggaactgttagcagaggaaacaggcaaatgagagaggagagagaaaatacaaaaggtatgctgagctggttcccactacgggccaaggggttcaaccacactcgagaaaccatgcaggctgtgcctctgaaggacaggaggctgggacatctcatctgcccactgctgaggagtgcccttacaggttcatcttcccagccaccctggctgtggactgagcaagctcagaaggcttcagcaaaatacctgagacagaaaaacaaaggcttggaagtgcttggaaactgctggtgcacaaaggaaccgcccgctctggctggagctgaagcgtgggagccaagaagcactcggctcagatgcctcggagacagtgcaaaccaagcgacagacagaacgggcggggttggaggggatgatggcagggagagagggcaagcgctatgtccaatgcccacaccactgccttctgtctgaaccccctccttgacgatggtctcgacaccaccctgccctgggcctccttaatgctccaaagctcgtgaatttgggttctccattgtacttcagtgccacctgactgttcccaaacccctccaacttctgaagctaagcaattcctggctttctttcacccacttattttagtcatttgttttgcaaacagaagtgtcaacagctgagcagaatccacctggccacacactcacctggttgccctctccccacggccagggggactgccagaaaggcatgcttgaaataatcccttggaaccttccagagacccacccagagtgggccatggaataaagcccctattctgctctcccatgatgacatgtgcacagcatatgagtctgttgctgagaacattctaattagatttccttcactacactgccttgatgttttgtttgaatggattctaattcaaacacacattttaaaacagcttcccaaaagtcttaatgtcatgtttctgtcaagactctagcttttgccttaataatgcaaacctcattcacccaactttaccctttcatgctaaaaaaatcagaagtgcaaaagctcagtttttgaacatagcagagtggtgactaaaaatactttctaaaggacttactagtaagcacatacatttttttttattattctaaaaaaaaaactgcagctgtatatagcggctcttatatcactttccctgcttacgaagccattttcatttacagagttgtatttgtctccactgttaccagtcatctataagcacaaaacgttctggcaacctacgccagcacctagagcaagccactccacgcaggcccgggggccactccacgcgggcccgggggccagggcttcagggcagtaggtgaggcgctgtatttggcatgggattcccaggtgatctggctccttgaatatttcccgcttacagttaaagggcagcacaggctttgaatcttaatagacctgggtggtccgaatattagcttcatctcaaattaattaatgtccctgacaggttttaaagtctcatctatagaacagcaacagcgatacttacctggcaggacagttgtgaagacgcaaggaatgtgcacgccgtagggcctgacatgtggggctcctcatgaaccatggctgttatcgctaaaactttcttgttctaggctgggcgtggcggctcacgcctgtaatcccagcactttgggaggccaaggctggcggatcacgaggttaggagatcgagaccatcctggctaacacggtgaagccccgtctctactaaaaatacaaaaagttagccggatgtggtggcacgcgcctgtagtcccagctacttgggaggctgaggcaggagaatcacttgaacccgggaggtggaggttgcagtgagctgagatcatgccactgcactccagcctcagtgacagagcaagactccgtttcaaaaaaacaaaacaaaacaaacaactttcatgttcgagatttaatttaaaaattttttgcctgaatacaacagatttgtaaatgcccttcgcctttggaatgccctccacactaaatggctgcagcttaaaatctcaatgaaataatcacagcactctgggaggccgaggggggcagatcacctgaggtcaggagtttgagaccaccctggccaacatggtgaaaccccatctctacaaaaatataaaacttagccgggcatgatggcaggtacctgtaatcccaactactcaggaggctgaggcacgagaatcgcttgaacccgggaaatggaggttgcagtgagccgagatcatgccattgcactccagcctgggcaacagaggagactccatctcaaaaccaaccaaccaacaaacaaaaaaacatcccagtgaaataaacaggtgctgattttatgcccagcaatgagtaccacaggggcttagagcaccgagtgacaaggcaaagaccaagtcactgggcccagaacttcctttccatgagtttgagatcagcctggccaacatggtgaaacgctgtctctacaaaaaatacaaaaattagccaggcatggtggcgggcgcctgtaagcccagctactcgggaggctgaggcagaagcatcacttgaacccgggaggcagagtttgcagtgagccgagatggtgccattgcactccagcctgggcaacaagagtgaaactccatctcaaaaagggcattcctaacttctgagggaacacctatcaatcatcagaaagccattaggagattattattggctgtacagaaacctaaagaggtggcagtcttacactgctggggtcatcagaagggaaaggaaagagaaatagaagggaaccaccaagcggatattgaagccaaaagagccgcaaggcaggaccctccattagaaatgcttatagaaggacctctagtatggggtaatcccctctgggaaaccaagccccagtactcagcaggagaaatagaatggggaacctcacgaggacatagtttcctcccctcaggatggctagccaccgaaggaaaaatacttttgcctgcagctaaccaatggaaattacttaaaacccttcaccaaacctttcacttaggcattgataacacccatcagatggccaaattattatttactggaccaagctttttcaaaaatatcaagcagatagtcagggcctgtgaagtgtgccaaaaacataatcccctgcactgcaggctatacatttcaatccctgtatctttaacctccttgttaagtttgtctcttccagaatcgaagctgtaaaactacaaatagttcttcaaatggagccccagatgcagtccatgactaagattcactgtggacccctggaccggcctgctagcccatgctccgatgttgatgacatcaaaggcacccctcctgaggaactctcaactgcacgacccctactatgccccaattcagcaggaagcagttagagtggtcattggccaacctccccaacagcacttgggttttcctgttgagagtggggactgagagacaggactagctggatttcctaggctgactaagaaaatccctaagcctagctgggaaggtgacggcatccacctttaaacacggggcttgcaacttagctcacacccgaccaatcagggagtaaagacagctcactaaaatgctaattaggctaaaacaggaggtaaagaaatagccaatcatctatcgcctgagagcacgagggagggacaatgatcaggatataaacccaggcattcaagccggcagtggctacccgctttgggtcccctctgtttgtatgggagctctgttttcactctattaaatcttgcaactgcaaaaaaaaaaaaaaaaaaaaaaaaaaaacctccatctcaaaaaaataaaattaaaaataaataaattacatctgtttcttctacttcattactttagttatacagttgttttaatgaagcacactgcagtgggggcggtgtttattatagcctttgtaacaaaatgtgaaaacccagaaggacctagggagaataaatggttcaaaatcatttggcttcttgccttgcttcccccacaccctctcctgcccttcctcctttcctctggctttccttgtctgaaggattcagggaaagcacacgtggatctggacactgtcactcaccattctctccacttgcctagctcagtcctgaagcagccctggatgcacccagggtcctcgggcagcctctcctgttgacgggccttctccttctgcgttccctctgctgacactggccgacccacctccttcaggaatgatatgtgcaagcacttagccttgtgccttactgacaatgccactgtaaaccccagaacactttcctcctgtctcttgctctgatacttctttcaccatctgctggtctccctctgcaagggttccagccaaggagaaccggcgatgggagaggcagggtgcctcaacctgctgggtcctcagcagcctgatggaggggccaccgcttctacagggttctcaccacacttgctgtttaaccaccatgagtgacaaaggcaaatgccacacagcaattctaagcccatcaggtgcatgagacaccaaacaccgctcacagacactgcggagggcacagactggctgtgtagcaggcactgcagtgcagaactgcccacacagtgtatgaggggccagggtttttgtttgatttgcattttattgtggtaaaaatacttaacatgagagctaccctcttaccacatttttaagcatataatacagtacaggttttaaggttggtaattttcatggaattcagaggccaacctctatattttggtgaaaactaacagttcttaatctgaactactcaacactaaaattttccacaaatggcagcttctgatcacttcagatgttccagtgattggtagcaattaaatggaaaattccaatctgagctggctccaagtatgccacaagtacaggatcagaagctatgaccactgtctgaccctcctcacagcagcaaagcaggaaacagcaaactcagtttgtaccaacggggcaatggggaatttcctgaggtcaaatcctccttggatgtgtgaaatatttaaacttagacgcaaagaaactagatttaataactgttgccattacttgccttctagtacggatttggatgtttcaaaatagtggccgagcacaggggttcacacctgtaatcttagggaggccaaggtgggaggattgcttgaggccaggagttcaagaccagcctgggcaacctagtgagacccccccggctctacaaaaagcgagcaaagaaacaaacaacaaaactgaaattagctgtgcttggtggtgtgcacctgtaatcctagctacttgggaggctggggtgggaggactgtttgagcccaggaatttgaggttgcagtgagttacgatcctgccactgtgctccggcctgggcaagagagccagatcctgtctctaaaaaaataaataattaaaaaaaaaaagaaaggggctgggtgcagtggctcacacctgtaatcccagcactttgggaggctgaggcaggtggatcacgaggtcaggagttcaagaccagcctgaccaagatggtgaaaccccgtctttactaaaaatacaaaaattagcccaggcacgatggcaggcacctgtaatcccagctacttgggaggctgaggcagagaactgcttgaacctgggaggcggaggttgcagtgagctgagatcgcaccactacactccagcctgggcgacagagcaagactccatctcaaaaaaaacaaacatacaactttttctttttttttnnnnnnnnnnnnnnnnnnnnatccatttccaaaaaaaaaaaaaaaaaaatatatatatatatatatgtaatttatatatggaaatagctacctaatggctttgccaacaccaagcccacccagaaagtgacagacatcactgaactggctcacataagtctcccatctcatagtccatcccaggtgaaggagaaaatgaagctggagcatgagaaattttaataaatacacgtttccttcctgcagtcagaaactgaggtcacagaagtgactatcgtcccatcctatcactttaaggacaaaaagatgaaaagagatctaaaagaagctgaaaggcaaagaagatgaaagcaccagcagaggaggaaggaaaggaatatttataataaattgacttgagcttctgtctccaaaaatacaagggatttcagaagccccaaagcctggcctcttacctgaataattggcaccaaaggaaagcactaaactggaagttgagatcccaattttaaatccaattcttttgtatttctttcttcaactaaaaatattggttctaatgtgacccatgaaatgtcaaattcattggttctataggcgtagggtttatgttgcaaaaaactattaatctaaaatgtgtttgaaatgcaattaatgaatgtttctcaacaaaaattgcattaggttttgtggacatatttgttcaataatattctcaactttttgttggaatatgagacttttatttcgggaccaaaagaagtgaggaatgcaaactgcgacccactgtatcctgcatcttcttgaataatgagaggataagaagtgcatgttgatgcaacactatggcaacaaagccctgtaattccagctccaggctgcagctgagcacgtgaggacttttggcacccttatcataagagaaccagagtcgccactattcttagagaagcaaagcaactgcactaattaagtcaccatattaagtgtccaaagaaaatactgactcaaatggaataaaatacacactagtcaaaatatgcttcagccattataaagtcacaaatcttgtacaaagaggagcacagacggtaaggctgaaatacacgtgtatgagaaaatgccatgtgttcattaaaaaaaaaaaatcacaggttttagagttaaacatctaattggtataacagaagatccagaattgccatcatttcttatcacatgcttagaatagcctttacggaactatcaaaatagaggataaggctgacctttgccatgtatttgattaaaaaatgaggggaagttcgttttatcaaaataaaaaggatgaagtttaggttttaatgttgtttctctaagaactaaaaatggcctagtatcagtcaaatgcagctggaagttcactgtcctctttctggagacagtgtgcctatcctcccctagagactgcaacagggaggcccacacagaagcgtcaagcagaacgtgtacctgacatgctcagggcaaatttgtctttttctttctcacttcaaagtttttctaacatttacattgttcaaaatccaaaagagaagaagctggacagagggagggagagggaaggaagagaggttgtgttcaatcctcactttcaaggacagtgaaaatctgctttggctgcaggcaggacgtgtttaattgtattcaacttttcttatggggcatgttgtcccagagaaaacgcactgaaacatgcttctccacaagcgcccttcatctgtagagacttgatactctgagaatgcctctggcggcctgtgcatctctccactatgactgtccaatcaagtcaccggaacaaagaacaggcttcatgttatacactgccctggaggtttctgaaatcaggatgcattctttctactaagaaaataattcttatcataattgccacaagataattatgatctgtaattattattgttggtgactgtcaatgatgcataaagaagaatacagcttgattttcaaagcctaaccctgaagaagcaagacaattaaaagcttgttttgactacttaaaatgaacaaacttgacacaaaagtcacaaaggaaaaattctagagggaaaatatcatcaattggcctgactcagcatttctcaaagacaagttacaagcgccaaatgcaggggaaagatgtttcaagaaccagaaggtcaggccaaaattcatgattgcagatgaattctgggaaggaggtgtggtcccccagaccattcaagtccagaaaggaagaatgaggtcttgactcccattgtcctcagggaacatgatgcagtacgttctgcaatctcatttaatactaacttaatactacataacatacaaatgatccaaaagagaacaatgttaacatctgcaaaatgaataggtaaaattccccacctctggttctatagatttctggctcaggtggttgaattccaaggcaggcagcaaagaggctcccacttctctgagtgcacatgtgccactcaggcatctgggccagtatgatctgacacactgagacacctccatgctcataaggacaattgagtagtgagctttcagtaccaaaaaatgtaagtggcttgcaaaaaagatatttaaacaggtacaaacaactttggtgacatttaatctattttattttaggccttatagaaactcaattttgaaaataaaaaataaatgaaggcccccatttcaaaaaatgaactttggccaacagaaaaaatatgtccacattacctaacaagttatattttcagaaggaatcctttaattcagaaatgtgtatctcacaaaaacatcttctcaacatatcatttcagaaaaagcaggaaagatgactttttttgcctcattggctaaaa

SEQ ID NO: 1667 - DNA, 8018 bp, Homo sapiens
atgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 1668 - protein, 306 aa, Homo sapiens
MPEAGFQATNAFTECKFTCTSGKCLYLGSLVCNQQNDCGDNSDEENCLLVTEHPPPGIFNSELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 1669 - DNA, 44089 bp, Mus musculus
  misc_feature (1)...(44089): n = A,T,C or G
tgatttgtaagagggattaacacctcaacagaacatcaacagattcattctgacccttcaggaactctaacattctcaacaaacaacaggagttctgtggtttcccaggatcaaatgcttgtcgcctttggaaggggccatgggaagtcttcacaacgcttgtaggacaccaactggaggtcatgaatggcattctagaaatttccataaaatggtttagttgtaacttgatcaacttattcataaaatgggaagccccaggaatgcaggtgatatttctgtcaagcatcaaagggcgagtattggggggagtggcatacactttggggtacctttcttgcttcatcccttgggaatgcttgacctggtgtgctgtttttctgtatttctctctgaccatgcctcttttcattggcatctcttagcttgcctatcctgggcagagactgctatgttttgtccactcttgtgacataccattctccaattctccaggcagacaatgccctgctcacgtaggtgtgtgtcacttacccatgcagctctccgaatgctctaacctctgagcgcccctgtttatttttccacagctgcagctgccctcagctctctatcagcacttaccaatgtgtgtttctaacccctcccaaaggaggcaaaactatgtttcccatttgacttctatagtgcaccacagataacggggccacgagtgtaataggcattcaggatgtttgccaaattaaattgatggtaatgcctcgccttgggaattaacccattgtaattggatagagaggttctatgtgataacttgataatctctctttgactgttgcatggagttgggggatcagcagcctataggctgtatagtactagaaacattgatccttggctcttgtttgatcatgactgatctgatatatatattatatattattatatattataataatatatatgtattatatatagtccaccgagtagataaaaagtaatgctaggttaatgttttgatttgtattcagctctggcttttagaagcagtggtgactcattgaatatttaactaacaaatgatgtgtcatgaaaggaaaattcaattaaagaagagaagagcaaacctcgaatactctgaatcatgttgtttggtgatcaaagtgcagttgacctcaacagatttgttattgccctgaacttcactgtgctccaatcctctaccactaaccctgattttatgctccatttaacatgaactcagtttggacaaggaaacaaagtgtgctttaagtaaaaaatcagggagctttttctgtttctgcctaaacttcaaatgactgtctttgtcttaggtgatttagcatgtcagcttcacttgctgttttaccatagagctcaactgtgcagtgatgaaaagcacttgctcaggccctgtggcccacactcgggaagtagaggcacgctgatctccctgggttcaaggccaacctgttctatagcaggagttccaggccagccagggctatatatacagtgagagtccatcttggggctgggggagggggggggaagagggtgggaaggaaggaaaagggagggaaagagggagaaagagagaaaagggaaggagggagggagaaggagagagggagggagagagagagagagagagagagagagagagagagagagagagagagatgaaggagatcgggtttgctcatgagtcacatggcaggagtgtggtttggccctccagtttcactcaagcatgattacctcatttgtgttctaagctcgaaaacttccctttcctgcaggtgcagaatctgtctctggaggacctcagagcatggcctctggggccagattcatgaatctgaatcctgctgcttccaccttttagccaggcttggcagatacagtctgtgcctcgggtgccctgaggtaccattaattacagccagaggccattctgaaggtgaagcaagttcatatttgaaagcatcttgtgtttgacacgtaatgagtgctaaacatgttagtgacacaacatgataaacgcctctcctgcatgtgtttgctgtcacagttctcataggtcaactaaacctgtttcaaaactttcaaataaataatctgttagatttgtttaagtcacactaactaaaaggactttaggccaagagtgtgtgtatgacagttgatttataaggcatttaggggaatatttttatgtgagcatctcacataacaaataccttcaggtaacagacagaaccttacataaacaaaaatcgcaactcctggatacaggctagcaactagagcagcagcagcagtggaatgacaaaggatcacgggaggctgactattaggggccctccagagggaaactcaaggaacatgaaacacagttgcatttagtcaaagggtgctcttaggagaaacaatcctttctgaaactttttacttattctttgtaaatattgtatcacacaccccaagcccactcattttatattcacccttacagccctcccaagaaataaacctctgtagaagttgcagcatgtcacagtgtgtcacagtacatacacccttttgtccacacatcttcacttgcaaatgttcattggcgtgaatcatggtctggtttgaggcctctggttctgtgctactgttcgcactggatcctcacctggactctgtttcaacaacacattcttatcttaaacactgagacagtctagcaagacaaaagatcagggctccctatgtagacttaggttaaagagataagctgattttacaaccactctggaagtcagtctggcagttcctcagaaaattggacatagtactaccagaagatccagcaattcctctcttggccatatacccagaagatgttccaactggtaataaggacacatgctccactatgttcctagcagccttatttataatgccagaagctggaaagaacccagatgtccctcaacagaagaatggatacagaaaatgtggtacatttatacaatagagtactattcagctattaaaaacaatggatttatgaaattcttgggcaaatgggtgtatctggaggatatcatcctgagtgaggtaacccaatcacaaaagaagtcacttgatatgcactcactgataagtggatattagcccagaaacttagaatacccaagatacaatttgcaaaacacaagaaaatcaagaagaaggaagaccaatgtgtggatacttcattcctccttagaataaggaacaaaatacccatggaaggagttacagagacaaagtttggagctaagatgaaaggatggaccatccagagactacccaacccatggatccatcccataatcagccaccaaatgcagacactattgcacatgccagcaagattttgctgaaaggaccctgatatagctgtctcgtgtgaggctatgccagtgcctggcaaatacagaagtggatgctcacagtcatctattggatggaacacagggtccccaatggaggagctagagaaagtacccaaggaactgaagggctctgcaaccctataggtggaacaacaatatgaactaaccagtaacccccagagcttgtgtctctagttgcatatgtagcagaagatggcctagtcagccatcgttgggaagagaggccccttggttttacaaactctatatgcccgagtacaggggaacgccagggccaagaagtgggagtgagtgggtggggagcagggtggggaggggggagggtataggggactttcgggatagcatttgaaatataaatgaagaaaatatttaataaaaaattgaaaaactaagagataagctggttaatgttactaggaaatggtcaagcaggcctatgtttatggtcatgtttgatgatctagtctggggatcataccctaaacagatttttttttttaatacatcccaaggtgagttaaatggcagaagtctcattgtcggtcctctttgagatgtagtgtttaccctgacagtatctgctgcaggcagcaagaattccctgtttgtaatgaaacccattctcgacacattactgcgtgccttctttctgggggtacccagaggaagaagggcccttccatcttctaaaggtgaaagaaacctcattccattccagagttcaacctgtctggttggttggacatgttgcatgaaccatgaagggtacagactgaaactggcttcgagttagttgtgagggaaagagggctggctcattgacctgcacaaagccctggtgctcactggtcccttggatcaggacgtctggcaagggaaggcaaactgcagatagcaagtgcctccagagccaagtgttctgccccctgcagctgcgaggagcagagcttagcaagtgtctgacagagagcaaggggaggggcaggaggcggtccttgggtatgtgcagattcaccttgatgagctgtggctgtcatagtgtcacatgcagaagatgagggaggctcccagaggaaaagagtttccttaacccgtggactatatctggcagtgttcctttctccagtaccttcagaccccgttgaacagtattcttggagagggaccttcagggaagtaaggctttccttaagagagtgagaactttggttggtggtttagtccttgggagttctggagggtctggttggttggtggtgttgttcttcctatgggttgcaaaccccttcagctccttcagtgctttctctaactcctccattggggccaccatgctcagtccgatggttggccgcatgcatctgcatcgacattggtcaggctctggcagagcctctcaggagctttatatcaggctcgagtcagccagcacttcttggcatcggcgatggagtctgggtttggtggctctacacatggagggacccatggctccagcagcatatgtgacagaggatagatgaccttatctggcatctggaggggaggcccttggtcctgtgatttcccagtgtaagggaatgctagggcggtgaggtgggagtgggcgggtgggggtggggaagcattgaagcatggagggggatgggatagggagtttgcagaggagaaaccaggaaggaagataacatttgagatgtaaataaataaaataaccaataaaaaattaaaattaagaaaaaagagagtgagaacttatctcgtaggattataggtgacagcagtctactctcacagctccaagggctttggttcttactgaagagatggcctagccagagctcgtcagtcgctgctgctcaactgacagctataagcaccagagtgtagagaggtcaaggggggtgaagagagagttctccatgaggccaacaaaaacgtgtcgtgccgggaaggagaagctcaaggcatgatggctaaggtatttaccccaccagaattgatacagagttttaataaagccagtatgggagctagtgagatggctcagtgagtagagcatgtgccacacaagtctaaagacctgagtttcgattcccccagaaccactgtcctgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaacatgacctcatggcggccaatctgaatcaaaccaccacagttggtcttacctcatgccccattaccatgtggtcaggatttaaagataagaactatgggggttactatttcatttcagtgcttctctttccctgaggctggccatttggagcgggagtcataggagttaggctctggtgtttgcataaggtgctggaagtcactgatcagtcttcaggcagttagggctgtgttattggagactgaggcagtctgctgtcacttgtgacctgtttgcctccaaagttactttgggggaaagtttggcattttttttacttagttaacacatagttaccatatggcccaaatattggggtgcttgtctaagaccaatagaagcacatctgtagagagtcttataagaacagcagctgtgttcaatgttttcccacctggagacaatccaaatgccttgtaaccagtgaacagatatctagggatgaatctcagatgcatctcgctaggtgaaaggagccaaacccaaaatggtataagttgtatgattcatgttgattatgttcaggcaaaggcaacattatggggacagtgattggatggcaatcaccaggagatgtcattagcttggggcactaactgcaaaaggacaaactgagagaagacgctggagggaggggaataatattctgtatcatacacaatacaaaacaagtcacccatctggatataaaattgggcgaagctaagccacttttgagttgctgttttgtattactggattttaaaattagaccaataagaaagtgttactgtcttggttagcttccccagatggatctcttcattccttggtgttggaatctaatgaatagaccccattttatttacatcatctatctttaatacctagttcttctcttcatcggaaaacctaccgcagtgttttcatttgattttatcaccacattccaaagtctttgtctggaagccttcctcttctattacgttaactttcttttttcttttgcaaatctcctaattcctcattatccagtgttctgtctggcttcctttagccccactgtaggctccgtctgtgaccgactgtggagtgcaggtgcctaggggaggcagaagtcttgtctgggcagcaggaagatagctagctgcatgatggaatctgatgatctatttgtttcctgggttgattttcatgtaggaacccccgaagaaaaggcatggtttatggttcttgcagtcagtgttagcttcgagggcaggggctttggaagcagccttttcaacagtaagtctgtcttttgcttctgttgtgtctgacttactatttcaactcaccagtaagtcagaacctacatgtttgaagttatatccccagcaccgcagaaaagagaaagagaaccttcgttttatttcctgtcttaccttcagtcatggtgaatctctgatttacgaaccggtggtcataagagagagagtaagacgggatagggagtgtgaaaagcagaaggttttaccatgatttacattgtggtgtgtacattgccagctactttttaatttatatacctatagaatacctgtgttattttttagtgcatcaaacttggaacttcccccatttctaagcagttttttggctcacggtttttggtggctacctgatgtgttgaaattgttaatgtttgtgtgtaatggacagctctgttgttctgtaaggacctatctagctactttcaaattaaatttctattgacacttaaaacatgaggtttcattatggcagttttcaaatgaagcttgtttttagtgattgtcatagctacttctctgcctgcaggactcccaggtcccctgcttcttcccttgctaggacccccataactgcctttactgttttatgtcacatatgaccttctgctcccttctgcagcctcctacctcagacttagtttcattgctgcatcccctcctccctcctccctctcccttcccctcctccctccctcttctcctcccccacttccccttctcctcactccccatgcacatgtttggtacatcgagttagtttctcttacacatctttatttgtatgtgtgaatgagttggagagtaatttcagtttcattcctgtgacatattttccagttctggcatggggtttttgttactcgataagaggtgtcatagagttttggaatatttgcatctgtgattatattattcttcttcgtcatattctataccttattttttcccttgatcataattgccacaagctgaccatatattaattaataattaattttaaagatagttatagactaatgaacttatatttttaaaaaaacctatgtttgtgactgcaatcgtctatggatcttttggacttttttttttaaccttgtaaacttattgtaccttattgtaacttgacattgaacagggcctcagctgccacttctaaccatcacaggctttctgtgatttgcaatacatgtttgatttctttctttaataaaagtacaggtttgttgaacttttaaaaacccacttccagtcgagctacatttaaaatttggtggtaaacagagagggaaaatcccttccatttcctcatttgaacactgagttcttactgggcatggtacaggtgttatcccttggtgactctgttttctgctcacagatattgctgtggtggagatgagcgacgccttccggcagccttccttgttttaccatcttggagtgcgagaaagcttcagtatggccaacaacatcatcctctactgcgatactaattccgattcactccagtccctgaaggtaacccccgccccttcacacagcatttaacttcaacactgtcagtgaggggcacattgctgtcatccaaaacatttgaagtagcttacatttatgaaaagttaattctgtccataagataattaggcaaggaagtctactcgccttgtgaggtctatctaattgaatataaaaatgtgaattgtttggtttcaggcccaggaataagggactagggtgcatattttacctatcaaagaaaacctggcctccaggttcccccagcatccctcagttcctgcctagcatacctacccccatccctgaactttctagcccaggggctgggctgcccttcctccagaggctcctccttctataatccaggacctctccctacccctttcttctccccctttcctctgcctcccccttccnnnnnnnnnnnnnnnnnnnncgcctccttcctagggccctggattcctcctgagagcagcttcctagtaaacctccctttaacatactctaatctggcttgaatgggctcatttcactggcagaaaaataacctattatacccaagtagaaaaacttagtgttagtttctgagttccaggtcaagtctcagtccataagatggttactaagaagtcctcagcaattaatggtagcatgtgctggaatctcagctaacaacatctttaggcaggacgattgtgagttctaggtccgcctgggctacataaaaagagatcctgtctcagaactccaaaaccaaaacaagcatcctacagtaacagaactcaaaacaggctgaagccttcagtccagacctctgagaaagaaagcccaaacgctatatgctaggcctggctggccaccaggacgtctcagagtataattccagctgaaggtatgcctcctttttgagaatgctttcagtagaggttctcgctgcagatccccagaaaactgggcataatttcagccaagacggtagaaggcaaaagaaactatttttttttttttctgtaaaatccaaactactataatatcattttcctccattaatagggtatgtaaaagccagtgtggtgtctgagatcacccatttcctccgggaaaccggctttgagcttcatgaggacttttgagaatcatctcagtcttccagtttccaaatcaaagtcagccttggggtagggccttagaagccagagcatggcttaacagctctgtcaaggcctccagccaaaactccatgcaaaaatcttaacaccatcttgcctttatctgagcactacagcactcgcgtggcctggatggcctgcagcttcattaagcaaacatatttaacttcctgccagacgaccattgttctgcatgtgagagccatagcccagctcagccctaggacatccactcctactctagctctgctcccccccccccccccccatccccagccctttgggaaacctctctcagttttctttcaagttggctttgtcttcctgcaggctaatctatacctgtgcttctctagttctgctccgtccgcccttggtgaaagagtcaggcagcttcattcattcttggtcttcgtttgtcttggactcaaactccttttgtgtttaaattgagctctttggttgattggaattgattttttttttcttttgaagtgtgatagattatgagctgaatttcatttttctacctgtggacgtctgctttctgcagcaccatttattaagctgtaggcttttcttcagtgtgtttttgacatctttgacaagtatcagatggcagtgattaccgtggaggacagaggatgccctcagggaattctctaccagagagagagagagagagagagagagagggggggggggaggctccaggaattagcctatgtccattttatttctaagtgctgagatggtataccatcttacctggcttttttgtttgtttgttttttataggctctggggcatgaactatagtcagcataacccagatttctttttctttttctttctttttttttttttttctttgagacagggtttctctgtgtagccctggctgtcctggaactcactctgtagaccaggctggcctcaaactcagaaatctgtagaccaggctggccccaaactcagaaatccactgcctctgcctcccaagtgctgggattaaaggcatgcactaccactgctcagctacaacccagatttcttattcagactgtttctagtcaggtcgttcagttgcaaagggtggaaataatacagagcaatttctgtagcctcagtttcctgagctctgtgctactgagaaaagctgtccttgtgcaggggccgctggcagcttaactttgtttctagtttgcagtaagtgtgacttcgacagaaaggagagctgcaggggacaaaagcagccatttaaacagtgcatcagggaagaggaagagaaaccacaaagagctggtcccccctccctggctctctccctggctctgcttagacatggaccagccttggacaccaaggagagtgcagctgaacccgcttcagttgcatttgctcctgggttagaagtggcgatgccaatgcagcagtgaattctcaaaaacagatcataggagaaagacttttaaagatgtaggctcctcaaaacccaattttaaaaacctgtaaaaattctttaagatcaatggctgagttatttaaaaggataattagaatctaatcatgtcatgtatttgcgtaaaattttataattatttatatttgtattgtatagtgttttcatacggtatacctgatcactgtttccacctccccagtccttctgtctcctccctacctccccactcacccgcctccacaccctttccttctcactgtagaaaacaggcaaacaaagcaaacagaaacacatacacatagaacaagcatgcaaaaaacaagcccataaaagcacaaaatcagaatccacaatgttcaagcaaaagtccaatgagaaaaaaaagtccaaaaccacctctatgagacacaaagtgtacacaaataacattgcgtccattttgtgctgtctactgctgagcacagggcctgcccttcagtgtggttattatacccaggagaaataagctatgtttaagaaaaaagtttttgctttgagaaagggaagttgactttctctgggatggtaacgacattttcacaattttctttaaatagcatgtgaacttcaagtatctattagtacttacggacaagactcttctgctgagagttctgacttatttcctgcatttaaaatggtcagggatcactcagtgtgtggagcagacgtctggaccccacaggctccctggctgtggagcagatgcacgcctcaaaaagaagtccctcctcatctccaacagcatgataactgagtctcccaaaacagaaggaggcagacaacagattgtaggaagaggcatacatatttaataatgtgcaagcacccaggatcacacagaatgtaaaatcaaagaagggcccagagttaaaacataaatattttcttcatgggagaagggagtaggggcatgtttagttttagaggaggagtggatgggtttttttccatgtgtgtgtgtgtgtgtgtgtgtgtgtgtgtgtgtgtgtgtgtgtatgtatgtatgtatgtgtgtgtgtgtatgtgtgtgtgtgagagagagagagagacagagagagagagacagagagagagagatagagacagagagagagggagagagagagatgcttgggtgtatatgcatatctttacattgtgaacatgtatatggatgcttgcacataggttcagtgtgcatatagaagcccagggttgatgtatacattttttcattgaggtaggatatctcagtgaaacccaaagcttgttagcaacattggtcttgctacttagaaacagcaatcacaggtgggctgtgctcacccggcacacatgtaggtttctggggatctgacctgaggtcctcaaacttagatggcaagccctttaacctccaagcctctcctctgcctgggatggttatcagtgttttggttttctgtgcaggatattcaccccagggcatgatgttgcgcccaagtactctgtcactgagctgcatccagggcattgaatgacacatacgtttaggggtgataaataggcctaagaacagacattcacctgggctccgaatgtgccatgtggtttcaattctagactttcttactgctcattgatcttctagaggagctggctttttaaatagataaggacattgggggtggggtggggagaggtggaggtgttttattttaactgccttgtgttatttcctgcattgtattgatttgcttaaaatatatccatgtaaaactgcttaatactatcaatatccattacgttaagaattatttgaggccagacctagttacacaggcatatacttctagcttctgtggagatatcgaaagatatcaaaagctgaaggtctgcctgggctttagagtgaaattcacgaccagcctaggcaacttgctgagactgtcagaaagtaagaggataaagggggtgaggggaggcatagctcaatgggagaccacacatgcagtatgtgcatggctctgagtttaactcccagtatcaccaaaaagttgtttttaaaatgtaaaaatagagcaaaaaggtaggacatatcattgtaacaggctacgcggcataaggccactcaannnnnnnnnnnnnnnnnnnnttcagagtgcccaacatagcatgttactctgggatattgtttctctgggtcccaacaaccatttctttcatcaccagcaattctattaagataaaacccgtagcccctgtgcttcttgtctttctccttcccttcatctgaggacacctcctacccacattggatctgcttgtacaacagagtagaatgaagaaataaacaaacactgatgagcagcataagatggttagatgctaaaggctctcatagatgcctggggtgtggaccagttaccaagagctgcctctgcagccctgcaccaaaaccaaaaccaaaactgaaacccagaaacccacttgtaatccaggcagcgctgtggtaaccaggagggtaaccaggacattctcccggcggcagcgagatacattggcacaacttctaaaagagcagtttggcaatgactaataacatcctgagatgggacagttttgaccctggatatgtatcgtagaaaacatggctcacacaagtaaggaaataccatcaaggagttctatgtaacgtagtttataattctccttctctgcaaaggaaagagtaaatacctactaggggaatgactaaataccttgtggtagttatttaatggactactatagagctcttaaggtgggtcaactagaatgctacagatgtacatcggtatattttatggtcatatgtgaaatcatagtatatgtttaaggcatcgtagcagctatctaaaatataatgtgcatgactatgcatcaaatgtttgcattagggatgggtagaagtgtgcttgggaattgagaataattacctgttaggagagggattgaggtgaggggtaagaagtcacatctctgatgtaatgtaagtttagggagtacacaggggaggcacatgctcatattttagacattttatattgaaatacttgataattaacagttctgaaggaaatgattgtctatgcctatgtacgccaggataactgaatacattttgggcatttgaattcccaaatattgttagtttcttttccctcctgttccggctgtgactggaggtctcagatgcatctttttctctttccgagcgagcatctgcttttctcccacttgttccacggtagaggaaatgattctcccgagatgagcaagctcatggccgatggtgatgcagctcgtgccaaatgcaactgttgtccgtggcagtctgtctgtgtttaccacatactctggctggacatggtgcgtgtgtttcgactgaccccacatgccctctctattatcttctggtcgccatctgatcagcatctctctagaagtgacactagaaatctcatgtgcacaaacccaaatttgtaacaacgtcattaagtcatctcttaaaaataagctgcttttaaacagcagagcagttccttaggacattaaaaatagattcccagcaggatccagcaatcttccttctggctgggtacacaaaaggattaagagcaagacatgaaagaaatatttgtatgcctgtgtttctaggaaacaagataactgaaaagggggagtggcaaagctgtattttgatggcaagtgggtgagcattctgtacgactgatggaaccttagtcagccgtaaaggcgattctgccacatgctgcagtgtggttaatccttggttagttaccgtcattgccctttcaagccgttctgtgccacccttggcctgtgatcttgttctgcagggacagaggaacttaatttcctttaaaccttgtctaggaagttggacattaaatctgggtttcaggtgcacatttttatataactgaaataaatagacatgatttagagttatgatacccatattttacattttgatatttatgctagtttgaggtaaattagaacatcagagtgatatttattacaagtatttcaaaatgtaaactgaattcttacctgtgctgtgtaaagccactcagattccaaaatgcttttaaatttataaaaccggggctggtgagatggcttagtgggtaagagcacccgactgctcttccgaaggtctggagttcaaatcccagcaaccacatggtggctcacaaccatccgtaacaagatctgattccctcttctggagtgtctgaagacagctacagtgtacttacatataatcaataaataaatcttaaaaaaaaatttataaaaccacacttctccctcccctcctctccagtcctgcagtgctgctcccttctcttaaaagctttgcctttctggaatatacttaaaagttctgttatactaaattttaattttttcaaagtatatgactcttaaattactaatggatttccactagcactttaaatatttcaactttgtacaaagtactcatttaaaagtcatttaaaatgtgaccctataaaatcctcttgcaattagtgagctggaagcacgggccccacccctttaaacagcctgtggagccttcagatgaattctaacatggtcaccagctattatctagaatcagcagtttttaaatttgcattgggacctggtctggggcaaactctatatcccatatacttacaatgccacaggaagtattccattcccatgcatttcctatgtcgcaggaaaccctttatcccatacacttacagtggatatcacagaaagttctctatgacatatacttatgatgggtgccattttacttgtttcagaattactttcatctgagctgtagtcattccttctcaaactgggaaagaggcaatttggggtaggagcacagagaccatgtgcataccagggctttatagatatttttctcaaaggatcttaaaatgatagggaatcagcaatgttgcatcttgtaaggcattagctgtagagtgaattaaacaaactctcgtaagatccactcccaccccacctacccacccactccatctagcctctgattaccatttgtcaaaggggaaagaaaaggcaggcttcacaggaactggaaggtgccacaccagttactgtcatcatttggagagactccagttagaggatgtgaattcgaataccttaaagggcaggaaaggcagagcaaaccatcttgttcattatatgatggcccttcctgtagaatctcattgtcatggcagtttaattgtcatcttctttgggttcctcatcttcgaaattaccagcaatttcctatgtcaagtgtgactctctgtacagaaaatcatcacacctacaactttttaacaatatatatatatttaaaaatatagaaatgttcaccagaataatttggtttaattaagcattactggaagaggtagttggtggcagaaggagaaagctggtaatagcaacacagtacaacgtgaagtcagtgttgagaggctgacagtgctgtggggctcagacgtcactcatgagacccaacagagagagtgtacctaccaacagcagagtttcccacagaagttttaaacatggaaaaaagtgatagggaaaaagaagaggaggaggaagaggagggggagaggaggaggaagggggagcattgaatgtgtgttatgacagctttggtgtaatagaacttgagtttcgaactatttttttttaagtgaaagttaaacatttctcatattgctttattcctacccatgaacaacgcagatgcaccgtgttcccagacctgatataagtcgcttgcttcggtgtgattaataccccacattgcacatagctttgaggtaaccacacatttatgtcacttagttttaaggtgtgatctcgtgaggcaaacaagttaggttctcactttctggatcagataggaaagatttccttagggttaaaaaattaactgcggagtgtacaatttagagcatatggcgtcagggtgaacagtcctaccgtctttggctcatcgtatagttcatggtttatgacactgcttgcgtggtgtgaaatgactgtagaagacaggtaggaaccgttctttgggaagacagcacataggctccagcccccagaggctgtagtgatgttccacagagcctcagcttatccatagtccctatctatcactcctctcccctgctacttccatttctgtgtctggtgtaccaaagccaggacaacagagaagtgactcctgttttagggaagtgaagatgtaccatttcgaggcgatggacagttaaggtgttccctgcctctgcctttcaatgtaccaatgctgcttgttccctggaccacctgttgaccaacctacttgcgcttgggggttggaggtgaaatggcttggaatccattgctcagactccaggagccgtgagaacactgcagcaagcttggataagctgccacaaactcctttattaatcctcgggtgggggcggggctttataccctccactcatgcaccccattggtcccaagcaagcatctcttccaagcagcagtttctgattggctggcattgtctgtgtcgtcaatccttagtctctcaggcaagtgttcaattagttcctcatgcaggagttgcctttgtggcttcacagcccctaacatttatgcagagatggctaccaccattcctcctacataccaatgtgttccaaaatctctcagcttgaagactcttgaaggggctaggagtgtagctcagttggtagagtgagagcccaacatataagaagcaccacacaaactgggtgtgatagcacactcctggagtagaggcaggaggattggaagtcaaggctatccttggctatagagtgaatttgacacaagtttgggttacatcgagattctgtcccaaaagacaaagaaacaaactacacttgaacattaagtggttggttgcgcaacacggttctttgttgctcaaaggttttctccactaaggcccaaaataacattctcttcttatttctgggtcaaaatgaacttttttgctttagatcagtgattgtattgaagcttttttttttattttttcaaacacccctttgattctctcttctatatatggcttgaagtgaactgtcttccttggttcccagaggtagcatttattgatattttttgtgagcctctactttccatctgtctctaggcagaatacccacccaccaccaggcatagcctttgcagtttcctctctactgcacagctcagcttctggcccaccctcatagctgacctccagttctataagaatagcatctcagagaaaccatagctcacaccatctgtatctttcttctgcctttttcttaaacgcgttctcacgaccggccaggaagaacacaacaaaaccagaatcttttgcggcaaaactttattgcttacatctttaggagtaggagcgcaagcccccagccccaaaaacgaaaacccccaaaaccgaaaacgaaaccccgtccctatttaggagagttatccttcgcctaggacgcatcactccctgattggctgcagcccatggccaagttgacgtcatgggaaaggcagagtacatgtagtggaaaatacccttggcacatgcgcagattatttgtttaccacttagaacacagctgtcagcgccatcttgtgacggcgaatgtgggggcggctctcaacatctccccctttccttttaataagagcaataggccacccatattaatgagagtggagatagaggtcaaatccccagtgtgcaggtaaaggagccatgtacaggattagctcttaggctcacaggcttttactcagagcaaccctgacctgctcccgtgtcgttttgcctggagagaaggacacttggacactcaacctttttgaaagatgacatgtctccctagaataggctcatatatgctgcagagcccttttactgcagtgcttagccgtgcaactctctcgggctgctgaagcacactcactctattccgtgcaatgagactagcctcgtgggatgcaagagctgagtggccagcgacctattgcctaagcatagatatatcaggggaagcaccatgttctagagctgcaagtgcctgggcaataaccaccttgtctctcctagtttgggccttaagcttacagaccaaccaaagaagcaacactaatccacagcaaagtatatctccaaataatatcaatcccacccattttttaaagaagggaaatgttgaggagatccaattgggtaatcctttggtcagggacaggtccaagcgcgtggagttgacctgaagtctcaattcccgaaggatctgttcaaattcagccgtccaattctgtaacatatactgaaaaagactttttgacaaattagctgccctagtaaatttctcatactgaatggaagtaacacacaatcccggaaacttttgttcacatctcagctgagctatttgccataatacatctagttgtttttggacaagatctatgagttgattaaccagcatgagaccaccctgtatcttgacattagctgaggcctgtttatctatgactgtagtcactgaggctgacaaagtgttaatggtgtcagtcgtctggacctgtccagacagagccaaggctgtctgaatcaaggccaaactcagtttctagttagtggtaaaaaagcaggggaatacttgagcattatacatcaccgtcattaggagtggaaatgtcgacattatctcccaacgctgctctctctttattattgacgccctggacatcaccaagacgagggacatcagtattcccttggtcagtctggattttttgggtgagtctttttggtatccaaaatgggttgtcttcattttgtgggaaaacacagatagcttttctggatcttatcaaaataggatccgggccataccatttattatcaaggacatttttctatttaaccatctcattgggcctatctggctctgaacaatgacgtttagccgtagcatggccatgaacatcaatatttaaaaaattgagtgtaaagagtgccatagacacagacactcttggtacttggggtagagtctcttcaattcccctcttctgttttataagataggctttgagggtgcgatgcgcacgctcaacaataccctgtccttgagggttgtatggaagtccagtcaggtgggtcacgtccatctgacggcagaactgctggaatttttgagatgtataagctggtccattatcagtcttaaggagtttgggtttcccccaagcactccatgtctcaagacaatgttgaatcacatgtgaggccttttctccggttaacggagaagcaaacatgatgtcagaacatgtgtcaatggacacatggagatattgaagttttctaaaggaagaaacatgtgtaacatccatttgtcagacctgtagaggtcgaataccgcgtgggttaattcccacatgaggaactggcaagaactcacagtagttttgacattgagtaacaatgtcacgggcttttttttttgtcaaggagaaacgactgcgtaatgttttagccgtcacatgaaaattgttatgaaaattttttgtagcctctaccggggatgatagggcagcagccaccactttagtggccttatctgccaaatcattttttagagccatggggccaggtaggcctgaatgggctctaacatgagtaatataaacaggaaatcttttagataacaaaactaattgtatctgttgaaaaatattggcaactctactggaaggcttaatcactccagccacttctaaaagatttattgcattaaccacataacaggaatctgacacaatattaaggggttctaaaaaggtttttaaaacttctaaaaccactaaacattctaccacttgaggtgaattttcattatattgtttggataccactttaccattagccacataggcacctatgtcagtttttgatccattagtatataccacaatttcatttttaagtgggtttcttactgttatttgtggaaacacaacagattgattttgggcaaactgtaaaattggatgttttggataatggttatctatttgtcctgaaaaggaggtaactaaaactgcccaatcattagatgtggctgccaaggtttgaacctgtgcagcggtataaggtacaattaaaagatatggacttcgcccaaagtgggtgattgctgcttttaggcctttaagggcaagctgtgcaattgcatcaggataccaatctattattttagctggggatacgtttggatggatccacaacaatggcccattctgtcacaaaactgcggttggcaattgtgctgttttaaagacacacaaactgaaaggctgcgaatcttcaatacgttgtaattgtgcatcctgtaaggcttttttcaccttttgtaaggcctggttagcagctagagtaagagccctaggggaggagatatgaggatctccttctaaaataccaaacaaaggccttaactcagcggaaggaatctttaaaaaaggtctgagccaattaatatctctcaacagcttttgaaaatcatttaaggtatggaggtgatctcttcttatctctaccttttggggcataatcttatctggggacaccacagagcccaagaattgtcctgtatcagaaatttggacttttcctgtggctatctgtaaaccccactgacttaaagttttaagtagaaaaggatatgccttttgtagcatggtaaggtttttatggcacaggaggatgtcatccatgtaaaggagcaaaattaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtatacttattctgtgtaccatatttcctctttgttcctactctctttccccgctttacttctgatagattgtcctgaattttatctagaattttcagccctatcttaatcacttgataacatgtgaaaaagaacaaaagggctcctaacactagaaaaagttcaaggccaaacatgccttgtaaagctatttcccactttacttttgatagactgtcttgactttccttagaaagttcaagaccagacttaccttgtaaagctgtactcactggtactcctgttccccagctgaagagttctgaattcatgcagttgaatccttctcaacagtctgttttacgggaaccttcgttaccataacccgcagttctggttccggaatgagggatctttcttgtgccggtgatggttaactcccgtcccgagttttcttgtattttctcgtcccgggtttcggcaccaactcttaaacgcgttctcacgaccggccaggaagaacacaacaaaaccagaatcttttgcggcaaaactttattgcttacatctttaggagtaggagcgcaagcccccagccccaaaaacgaaaacccccaaaaccgaaaacgaaaccccgtccctatttaggagagttatccttcgcctaggacgcatcactccctgattggctgcagcccatggccgagttgacgtcatgggaaaggcagagtacatgtagtggaaaaatacccttggcacatgcgcagattatttgtttaccacttagaacacagctgtcagcgccatcttgtgacggcgaatgtgggggcggctcccaacaccttttagttcttcatgctcttattgctgtgatgaaatgtcttaacaagaagcgaattgggaggaaggacttatataagcttgtgattcgaggggatgacccatcaatgccgaagttagttcatggagtgtggatctggaaattctgacagcagcaagtgcagagatggatggaaaaagagataagcagataggtaggtaggtaggtaatgatgatgatgatgatgaagatagatagtgatgaggaagaggatagtagacagacagatggacaggtaggtggataccagagagaagtagagtggaatgtggcccccgagactcactttccagtgacttacttcatccatctagtcccggtctcctaaaggacccatggcctcttgaaacaagtgccaccctcaggaccaagttttcaaacacaggaactcataggggcaatttcagctcaaaccataacaggatgtctatgtgcctatatgttcacacagacgaatgtccttttaaaaatgtaaaaatgctcgtttgtttgaaactaagtcctaactcatggccaggatgcccaggaacctgctgtgtatttcaggctagctgaaatgtatggcaactctcctgaactcgcctcctgagtgctgggattagaggtgtgagcctggcttgctagtggtttgtgctcccctacgtctgtttagcatccggatgccagccactctgctgggctctgtgtctctgctctcaccttgctggatctggctgctcccctcagccagatggactttccagaaagaagccacaaataccttacatttcctgtttccatggcaacatgcacaccatcttccctaatacacagtctcattttctgttttctaaatcatgattccctcaccgccagtgaagcttgtgtaccacggcatttccacatcctcgccgcagcgcctctcgttatggtaatgtctggtaatataggagtagtggtagataccttttaatcaatggaaagctacatatgtcggtcattttcatgagcccattctttacaatataggaaacaggaatagtgtccatgtggtatatttatcccattacatgcctcatagaaaaaacatctaaattacactggcctttattgtcagatgcccttattatctgtgtgtgaggttgccattggccaagataccgtttcttacctgcagctccctaacatgctgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggcactctgtttagggatttgtacagacttgtgttgttgtgtgtgcatgtgttgttgtgtgtacttgtgttgttgtgtgtgcttgtgttgttgtgtgtgcatgtgttgttgtgtgtgcttgtgttgtttgtgcttgtgttgtttgtgcttgtgttgttgtgtgtgcttgtgttgtttgtgcttgtgttgttgtatgtgcttgtgttgtttgcgtgtgcttgtgttgcttgcatgctgtgcgtgcttgtgttgttactatcgaacaccacatcacacttttgtgttctcttacccatttttcatatgcagaaacgtaagcgtataatttcagactgcaaacactaatgcttttacagtgttcctctgatgtctctgattgattgctaatataaatgttaatacaaatttacctgcatacaatgtttagtaaggccatgggttttcgttataccatttgctaagactgttgttctcttattttttaggaaattatttgccagaagaatactgtgagtatttggcttaactttccaattttttttttttacttttttcttttccattaattaatctgttatttctaaatctgtacagatggtcaattttcatttcttttactcctttttagagcttctcacatgtctgtatgaacacaattatgttctctaactcatcatagtggatattataacaatggaagataacactaatacctactttttgaatatataattatgttttagaaaaaaactttcatagtacattcaatgttacagaactataattggcaatatcaaggcatataacaaagaaatatatatgtgtatatatattatccatatatgtcaatatctatggatataaatacatagatgtatatgtatatatgtgttgatatacatggatatatacatatgtgaatatataaatatatatcatatatattttctgtgtttctgtttgtctatcatgtatcttctattttgaggcattcaggcaaattcttaggttgtctttttgtctttgtttgtatagtgctggggactgaacccatgggcatctacttgttaggcaagtgttctaccactgagccaaatccccaagccctttctctaagcctgaaattcttccttgagatcacattacagagcgcaaactcctcatacagaattaaattaatgtgaaaaccagagatatttaatattttaaattaaaaaagactgcatgggaaatgttgaactattaccgtagaaatgggaatggccctgtggctcagtggtatattttatcttgggaagtaaggcagtgtttaagaaccctaaaacaggtatacatctacaattcagagcgagaataacatgtgacataagacctacataattccacatgagatggcaagattaacgttatagttggtgggtttaagatttcaccacaaggaagacgcattgcagtgtggataatgtggccattttaaactcttatctctcacatttcatcaggaaatgaacacttccattccatgcttcagtgctgtgtaacacattttattcagctggtattaattaaatgtgaatggtatgctaggacctgggtgtggtgcctaccaatcacactagtgcttgagaataaaaacagtggtgtttataactgttgtgtgagatcaaattgtgggaatgctagagtatcaggacaggtaaacaaagaatcaaacagatacatttttaggaaattagggcacatgacttgctgaagagatggtggccatcattatatcaaagcccaccaaaggaggtagcattccctaagcctgaagggcaggaagggtaagaggagcctcgtgccttgtgatattgatttaggttctgctgcaatctggggactggatgtgatctgacttatgtatacttccttcagtgtgtttgaatgctgtgaccatttccttccaggcgtttgactccttctccacacgtacttttgttccttcatatagttcttaaggattaaaaaggaagatcagcattattgatatctctggatatggtcaagtataggttttagattttgagcattaggattttacacatatagacagagcgaggggaaaggagagaagaacagagagatagagagacagagagagaatatgcatccagcttgggcagtggctccagtcaaaggattaagttaggtggctgtgctgctctgagatccgggtagcatcctaggagaacaagttctttttcactcttcctgattggcctccccatcactttgtaaagggcaacttgatttggtttaaaccccacatctccccttgtggaagtccttctcatactctgacgtcaggtcagtctcatttcttgctcactgccgacacccaggtgcttcaaagcataacatgctcataaataattaaatctggccataaaagctcatgcttgtagtgagctgtcattattacttcatgcagatgcctgtgaaggcgatatcgggagggagagcaagtgcagcgccctatgaaggtcatgtgagatggttaattcaccctaacaacaacaacatgctctatctacagagaaagcactgggcgagaagcttgaatacaccaaggccaggagcttggtctaagctcgatgccacctcgcctgtaaagtggcaccaagagcctcttctgtgtgtgttgtggtcatgtaagcactgaggctatggtgacagtaaggccacatgtcccttcttccttgcaagtactgagttaatgtttgctcttgccagtcagggccgagcagtaagagagtgcacactccctgcacgcctgaggccaggactcctagtgctgtccaggaggcacacatcccgtctactgctcagacctttgcatacgcttttctttatgggtttcccttagaggtccctggcatttcattgggttatctcaaatcagaccctgatctgtgtttacattcccatgcaccccaaatccctcccggtctttcgaaggcaagctatactccttccaagtgagcgttccattccagcccacttcaagtttcagtctctttagtcttctcagagtttagctggggggggggggggctctatgtggggtctgctgcctgaggttcttaagaaagcagcgtgctgacagtgaggccgcattcttgcttcctggtaatgcaaccattcttgtaaagaggccccacttggatccaccttcagcgccttcccgtgcatgcagctgtatctccgtcccagttgattctccttttgggtgctaagcttgagctttataaggacttactggttcaggttgcctcaaccccgagctggttatgccacatagctttctgcctcatttccttacatcttggctcctgctcttacagtctatcctgttgcctacccagaatgcccacgtgcacagccactcttgttttgtcttctctgcccaggatcctctgctcgcttcacactcctcagaatacatagttgaaagtctttagcttgccttgcggtccttttctttgggccctaactgcagtcagacttgcttaccccggggtctatagtccggttccctttgtcatctcccaacagtgcttctgttgggcacaaatgtcccttcatttggcatgatctggaaactgctaggtcagccaagcctggtcttagtgactctgggagagggcacagactgcagctagcgaaaggcaggatgtgcaggggttgggagtctgtggacagcagcctaagccttaccctcatcacaggctcgcctgtggggcttcgtgcagctttgtttgtagctcacgtaggtagatgttaaagactgtctgggagctgggtagagagaggatagcaggcagtcagtgtggaggtcagagtgtagcagggaaggcagtgtggaccaggaaaaccattgcagagactcaggcaggtgtaaggtgtgtgcacctccttgctagcagagaggagggagtcaggcaaatctgagcttgtagagccaggagagcaagggctgcgacagtctcacagtctcgggtttcagtgagtgggagacaagatagtgtggacctggaaggaagcagctgtattctgggcttgctcctgccttcccaggggaacccttaaactcccagtgaaactcctaagctctcagtgttttgttctccttttgttgagcctgattgaatttctgattccctggaggctggaagttatgcttaaatcattcttgttttagcacgtatcctagtagcaacgtgtgacggcacatgcatatttaatggctgataaaagatactttatcatgtgcaagtcctaattatactgaagtaagcaattaaggaagttggaaaattctgtttttcatgggtcatcaataagaaatgaatctcttctgtttccctttgcactcagaattattgttaagaataataactttagtcactgtaacacgacctggcgttttttttgtcagtgtggtaccccccctaggcaagctccctactgtctggtgcctcctgtctctctaggtgtgcaccgggaactacaccttcatcccctacatggtgacaccacacaacaaggtctactgctgtgacagcagcttcatgaagggcctgactgagctcatgcagcctaacttcgagctcctgctggggcccatctgcttacccctcgtggaccgttttgttcagcttttgaaggtggcgcaagcgagttccaggtaacacttggtgcccacagtgggcgatgagcctgcagtgctgtcctgctttgtttatttgtgtctcttgtcacatgttcctacttaagagccagggaacaatttgcagtaccttctgagtgggggagaaagtgtgtcattttcgttcacaagtcaaatggccccaatctattaattgttttataataatgacaaaggtatgtatgtatgtatgtatgtatgtacttataagtacttatattcatttaacttatttttaaataattttatttatataatcttatttataaataatatgcttataaagaaataaacacacacatgcacacggtcagttatggctacatcagaataaatttccagagacttttagtataagcgccaaaacatggcaggatttgctaagaagatagtttagctaagaataatccttggcacttgctgcccatcctgacagctttagttcaggccccaaaatggtagaaggagaagaatggttcctgtaaagttggcctcagacaacccatccccgagactaggcacacacaaaagcgcacacacatgctctaagtcagaaatgtaaaatagttctcttgattccaatagctctggccggcctggaacttcttatgtggtctcaaactctttatggaggggggcttccaatactcaaagatttacctgcctctgcctcctctgagtgcgaggatcatgagcatatgtccagcaagtgtgattaaaaaaaaaaaaagaagaatcagttgtttatggtaatggataatggtactgagctagagagtaaaggttgtagtgaagtaagatcatgggcctatctaaattaattgggataatttgcactcgagttagtaagatgaatattaaaatttgtatattttttgaaatatggcagaaatctaaaagaaatacatggactcccaaatttgttaataatgccagatacacatatgttaatgtgctggaaactagtcgtggacaaatgtcatgcgttttcctcataaagtactgtatttcagtgaattgatttctagagctaactctttgaaatgtctggtgtttcgccagccagtacttccgggaatccatactcagcgatatcaggaaagcacggaacctgtacactggtaaagaattggcagctgaattggcgaggataccggcaacgggtagacaatattgaagttttgacagcagacattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctccctctctctctctctctctctctctctctgtgtgtgtgtgtgtgtgtgtgtgtgtgtgtgtgtgtcctctgtctctctgttagtaaaagcctttcctggtatttgtagatataattcttttttttttctgtgacagaacttgtgtttgctatttatattttataacgttcagtgctttatcaatatgatactacttttttagcaaatatagttgtccttgggcagttgttaaaaatttgttccaaactctttaaaggtactcagattcaaggatgttcaagtccttatataatgatatagtatctcctatgacaatcacacattctctatacatttaaagcaatctctagataactatatctaacataatatgatgctatgtagatggttgttttttcctgttcagggaaaaaaatctgcatgttcagtatagacatttctccaaatattttcaatgcatatttgatggaaccgggactgagacttcacaaggacatgagacaacctcagtatcatctgccttcccatactggttcattcaagtatgaggaagttttgaggaagcaaatgtgtttcccatgcagagacagttttcccaaggaccactgcgaacatgattagttatgatcagaactctgccggtgactctgtctgagtcacttttgacagagtctatcttggcccccactctgtcttctgcctatgtcatagcccagcttccagtgcagctccccaggtgcagttgtcgcagagggtcacccgtgctctgaccacggatggaaccagcatcctgagtagtccaaaagacttagctgtatcgctctttccttcacagtaacagggatgagcatgcatgtcgctgcagaagaaaattactctttttttaaaaaaggaaaagacatctaattcatgtagaactcactgtgtatcataaattccctcccttttcaactgaggcccctacacattggaaaggctgagtaattgtccctgaaggctcccagtgggtacatgctgtcctagaaagccagcatgacattcagctagaacccatgtgtttgcttccctacccaatagaactggagagcttgtcaacttcaccaatagacatagactgtatagacagaaagccattttgtctttaatttattaaacatcctatacatcttatagatgtagataaggtaagctctctctagagtgtatgctctttgtcaaacacatacaccccccccttttttttttttaagtaaaatgtattttgaagcaaactgagaaaaatcctaggaatctcttagaatttgactttgtgtgccttgtctctctttccaaaagtaacatacaacagaatggaaagcatgcttgtataaagcaataatctaaattcaagatgtttagtaaagatagaacttaggaacaaaaaattgcaatagtagttgagcttatgacaatacacataactttaaaagtaattgtatttaaaatatatctcatatataacttagtcatttaaaatatcttttatctttaattttaatatatcaattgagttatatagctctcatccccacaaattgtagagtattttttcaccctacaaggaaaccttctacccattagcattcaccctttccccacagcacatatcctcctgctcctggcaaacactgtgctctgtctgtattgattgttctattttaaatatttctcaaaagtattgtcagccttttgtgactttacttttcacttagcataatattttcatcattggagaaatgtaaagtatgattctgagaaccagccacacctactacttaataataagctacatggagttcaaggccagtcctgataactcagggagttgctgtctcaaaatccaaagtgaaaaaagaaatatggacatatctcataggacgtatagctcagtggtagggtgcttgtctaacatgcccgaggtctcttcgaggccagtaccataagaactacatgagaccatatccacagatgctcagccacatggagaaaccagtcaactcttgggtggatttgagcttagaattatctatgcattaattttttttttgttcttttgaaacaaaagccattgaaaactaatgtcaagagtttttccttatttatagtatttgatcctgctccattcaaggtcacagggtgcacactccatagaattccaccatcttgaacctgttcataggccgcaggaagatcaggactctggtcatcttgtccactcacacctcacaagagatctttgactgacccagtagacatacatcagtataagacagcttaggacaaggtccatagaggatctcagaatcaaattatttttattctgccaaactttactaatgtaaatcaatacatgaaacaggcaattggtctatgattggttttatgatctatataaaaacaatgctctctactttaggagaaatctccctggagacagagcaaaagctcttgacatcatgatccccatggtacaaagtgaagagcaagttgcttcggatatgtattgtctcgttggccgaatctacaaagatatgtttttggattcaaatttcactgacacggaaagcagggaccatggagcatcttggtaagactggaggatgggaagtatcttcttgctcccctgtgatgcacaaaactgtgcagtgggcagaagggaagcattcggactatgtctgtttgattgtatattgtgagctaaattttgatttttccaactttagtacatgatttgatgagattcatttaacctggaaggctaagtttacataaattagatggaaaagttaagaatgtaatttgatttgaaatgtataccatgaaaagcaaagtacaattttgtgagaaaaataatagaaaaacatcgagagatttgaagaagtcaaaaaacacacaagtttgtgggtaaaccagcttaatatttaaatggttccagaagggcttttcatatgatttgatttctaaagtttatttgaaagactaaagggccaagaataggcagagcgatttttgaggctaatggaggagcctgctctaccaggggaagctcacgagattgcagttatgtctccggcaagtgaaccactgtagcgcagtggcttctgcttagcagacagcttatggcagggtgtgggaagcactggagaagcgaggggccaatggcagggtgtgggaaacactggagaagtgaggggccaatggcagggtgtgggaaacattggagaagtgatggccaggggaagggttagcacttcagtagtggtgctgggagtggatttatctccccagaaaagttggatctctagtttacttcattttacttcttatttaaatttgctatttttgtttttctggtggtagatatcaaacccagggcctattttatgctagacaagcataagctacaactccggccccagatctctttcttaagctctgtgcaaaagtttaattctaagtgagtcaaaaagctccaaacatgaaaataaaaatatactaaggaaaatacttttagcataaaacctgcaaattatgtttatggctttcggttaggaatgaatttcttacaaggcctaaaaatactgaacaagcaagaaaatcctaagcaacaacaaacaaacaaacaaaaaaggcaaaagattttgaagactggactatgttaaagtgtgcggctgatccttaaggttctggatactgggagtggggagggggggagtggcttcggttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcggttgtgctgatcttccctgctgatgacaattagaactactgggaagtcatagaggatcagaacttggggaagaagaacacagagttaatctcccagagctctccctggactcaaatagaaaaatcacaatcttaatggcctaaggacacgatgctaggtgtccagagttctagagataacccttgagtaatggccatgccacagaggatggagaagcaggatccgcacctgaactcctccttggctgaaccctgggtgaaggagcctccaagtaaaatggcagctataaggctgtagagcagcacagaaattccagtagctgctcactgcagaggagacagttttcagttggaagtcattgacttagagaatcccaaactttcaagtgaaactctaaaaggccaagccttaggatgaagggagcatagtaatttaaggccatcatcgaaccatgctaaaaaactaaagccaaccttccatatgctaggacagattgctagtgctatgtttgcctcttatggtgatttgaatgacaatggccttcttaggctcctgtatttgaatgtttagttgccagggagaggaagtgtttgaagaggattaggaggagttggctttgttggggtaaaagtggccttgatggcagaattgtgtcactgagggtgtgctttttccaaagcccacaccaggaccagtgtctgttgcttgtctctcttgtctctgagactctgcctgccatctgtggatcagtagataaagctcttacctactgctccagtgccatgcccatttggttcttgccatgatgattatggactaagtctccaaaactgtaagcaagcccccgatttaaattgcattcttttatatttgtgtttgtgatggtgtctacttacagcaataggacggtagctaagacagaagttggtactaggaactgagatattcctatgacaagcctggtcatgctgtttggtggagtgatatggaagacttagggacgttggactataaaactggttgagtcctttaagtgggacttactgggccgtccttgtagggatgtggaagatagtagtgctaagaatcatttggactatgcaggcccagctcaagaggcttcagaagggatgactattggcagatggcctggagaccatttttgtgatattttggcaagaatgtggctacttttttcactcttgtcctgaaaatatgccctaggctaaattcaagagtttttttaatttaatgagattggcagaggagatttctagacagcctagtattgcatgtgccacatggttatgaccactcttgtgcaactctacattgagaagcaacaagtgaagcaaagagaaatactaaaggttcagattggggagaaaaggagcaccggggatgcaaagctagggccaaggcttgtgcttgataaacagattaaagaaaagtccagtgctaaatggaataaagggagtggtaacctctgggcaaggccacacccacccaacgctgccatctaaaagctctcagggatctcctctgcctaaacacttgaaggcataggccagtgtcattcaagaagggggcaggttccagccctagcaaacagaagaacttggcagctttggccatgttactctggctttagggttaataaggacacaggagtaaaatgcttgttgaaggaaggcactgaggaagaaccaaggggagtcctgcatggatgcctggcaaagctggtatgtggagctgggaaagcctggactgggttggagatcccaggatgttggagatgccagagccctgggacgcctgccaaggggagctgctgattgtgaaccatcccgaaagggaaaaatgtgctgcagttaacaaagctgggaggagattggaggagtctaacaacagaatttggagtttgccctgctgggtttcattcttgctttggtccagtgtttcttcactatgctccctctgttcccttttgtaatggtcatgtatattctgtgccattatatgttggaagtgtgtgacctgctttttcattttgattttacagtgggttacagttaagagattgccttgagtcttgggacttttgaacagcgttgagactgtgaaagactctggagagtttagacgttgaaagaaaggggttttgccttaggatgtgggtcagagcctctggggtgaggtaatggaatgtggcagcttgaaagagaatggccttcatagactcagacatttaaaaagctaagtcaccagggagtggaactatttgagaacgattagaaggactgagagatgtggcgttgttggaggaaggctatcactgggctaggcccagtctggcttgctcttcccaccccaccctaccccacccctacctggtgtttagggatcagtatataaaggtctcagacactgctccaccacaatacctgtctacttctcaccatgatgatcatgtgctaacctgtaaggaaggccccagttaaatgctttcgtttataagggttgccttggttatgatgtctctttacaacaatagaacagtgaccaaactcttcagaaaaaagagaatccagactctgcaacatattctctatgtctattactccatgaaaagttactgaaggtgtgaaaaagtatggccccatgatcaagaaaaaagccaggcatagaatcacgttcacagggttggtcatggtgatttatgtatgtgtgcttgcaatcccaacacgtgggaggtagagataacaggatcaggagttcagtggaagtctcatctacacaatgagtttgggacctccctaggctccgtgagaccctatctcagatgaaggacgggagaaagggaagaagggatgaagggagggacgaaggaaggaaggaagctaggaaggaaagaagaaatcaaccaatgggcaagataggctttggaattgtcaaaggacaggacataaaaagagtaataaaatgttaaagcatacactagaaaagatgaatatgatgaacatcaaaacaatcatccatcctgaccaagtaggtttcatcccagggatgcagggatggttcaatatatggaaatccatcaatgtaatccagtatataaacaaactcaaagacaaaaaccacatgatcatctcgttagatgcagaaaaagcatttgacaaaatccaacacccattcatgataaaagtcttgggaaagatcaggaattcaaggcccatacctaaacatgataaaagcaatctacagcaaaccaatagccaacatcaaagtaaatggtgagaagctggaagcaatcccactaaaatcagggactagacaaggctgtccactctcgccctacctattcgacattatacttgaagtcctagccagagcaattagacaacaaaaggaaatcaaggggatacaaattggaaaggaagaagtcaaaatatcactttttgcagatgatatgatagtatatataagtgaccataaaaagtccaccagagaactcctaaacctgataaacagcttccagtgaagtagctggatataaaattaactcaaacaagtcaatggcctttctctacacaaaggataaacaggctgagagagaaattagggaaataacacccttctcaatagtcacaaataatataaaataccttggtgtgactctaactaaggaagtgaaagaacttcaagtctttaaagaaagaaattaaagaagatctcagaagatggaaagatctcccatgctcatggattggcaggatcaacattgtaaaaatgactatcttgccaaaagcaatctacagattcaatgcaatccccatcaaaattccaactcaattcttcaacgaattagaaagggcaatcggcagattcatctggaataacaaaaaaccgaggatagcaaaaactcttctcaaggataaaaacctctggtggaatcaccatgccggacctaaaactgtactacagagcaattgtgatcaaaactgcatggtactggtatagtgacaggcaagtagaccaatggaacagaattgaagacccagagatgaatccacactcctatggtcacttgatctttgacaagggagctaaaaccatccagtggaaaaaagacagcattttcaacaaatggtgctggcataactggcggttatcatgtagaagaatacgaattgatccatttctatctccttgtactaaggtcaaatctaagtggattaaggaactccacataaaaccagtgacactgaaacttatagaggagaaagtagggaaaagcctcgaagatatgggtacaggggaaaaattcctgaatagaacagcaatggcttgtgctgtaagatcaagaatcgataaatgggacctcacaaaattgcaaagcttctgcaaagcaaaagacaccgtcaataagacaaaaaggccaccaacagattgggaaaggatctttacctatcccaaatcagataggggactaatatccaatatata

SEQ ID NO: 1670 - DNA, 435 bp, Mus musculus
atattgctgtggtggagatgagcgacgccttccggcagccttccttgttttaccatcttggagtgcgagaaagcttcagtatggccaacaacatcatcctctactgcgatactaattccgattcactccagtccctgaaggtgtgcaccgggaactacaccttcatcccctacatggtgacaccacacaacaaggtctactgctgtgacagcagcttcatgaagggcctgactgagctcatgcagcctaacttcgagctcctgctggggcccatctgcttacccctcgtggaccgttttgttcagcttttgaaggtggcgcaagcgagttccagccagtacttccgggaatccatactcagcgatatcaggaaagcacggaacctgtacactggtaaagaattggcagctgaattggcgaggataccggcaacgg

SEQ ID NO: 1671 - protein, 145 aa, Mus musculus
  VARIANT (1)...(145): Xaa = Any Amino Acid
IAVVEMSDAFRQPSLFYHLGVRESFSMANNIILYCDTNSDSLQSLKVCTGNYTFIPYMVTPHNKVYCCDSSFMKGLTELMQPNFELLLGPICLPLVDRFVQLLKVAQASSSQYFRESILSDIRKARNLYTGKELAAELARIPATX
